United States Patent 11,931,406 (FLAVIVIRUS VACCINE) - sequence listing, part 40

SEQ ID NO: 15227 - RNA, 9873 nt, Artificial Sequence
  derived and/or modified CDS sequence (opt3) from DENV-3__KF955332__SS-prME
accagccugugccucaugaugaugcuucccgccacacuggcuuuccacuugacuuccagagacggcgagccuaggaugaucguggggaagaacgaacggggaaaaucuuuacuguuuaagacggcaaccgguauuaauauguguacacuaauagccauggaucucggcgagaugugcgacgauacugucaccuacaaauguccacugaucgcggaaguugagccggaagacauugauugcugguguaaccuuacaucaaccugggugacuuaugggacaugcaaucaggcuggagagcaucgccgagacaagcguaguguagcccuggcaccccacgugggcauggguuuggauaccagaacgcaaacuuggaugagcgccgagggggcuuggaggcaggucgaaaaaguggagaccugggcacuccggcauccuggauucacaauccuggcccuguuucucgcucacuacauuggcacuuccuuaauccagaagguugugauauucauccugcuuauguuggucaccccaucuaugacaaugcgcugugugggcguagggaacagagacuuuguugaaggacugucgggugccaccuggguggaugucgugcuagagcauggcgggugcgugacgacuauggcgaagaauaaacccacacucgacauugagcugcagaagaccgaagcaacucaacuugccacacugaggaaauuguguaucgagggaaagauuaccaacaucacgaccgauucacggugcccuacacagggcgaagcuauacucccagaggaacaggaccagaauuaugucuguaaacacacuuacguugaucgcgguugggggaacggaugcggccuguucggcaaggggagcuuagugaccugcgccaaguuucaaugucuggagcccauugagggaaaaguagugcaguaugaaaaucucaaguacacagucaucauuacugugcacaccggugaccagcaucagguuggcaacgacacacaaggggugaccgucgagaucacuccucaggcaaguacgguggaagcuguacuuccagaguauggaacacugggcuuggaaugcuccccgcgaaccggucuagauuucaaugagaugauccugcucacuaugaaaaacaaggccuggaugguucacagacagugguuuuucgaccugccccuuccuuggaccucuggggcgacaaccgagacuccaacauggaauaggaaagaacuguuggugacguuuaagaacgcccaugcaaaaaagcaagaggucgugguccucggcagccaggaaggagcuaugcacaccgcccugacuggcgcuacagagauucagaauuccgggggaaccucaauauucgccggucacuuaaagugucggcugaaaauggauaagcuagaacucaaaggcaugaguuacgcaaugugccugaacacauuugugcuuaagaaagagguuagcgagacucagcaugggaccaucuugauuaagguggaauacaagggagaggacgcccccuguaaaaucccuuucucuacggaagauggccaagguaaggcucacaacgggcgucugauaaccgcgaauccaguagucacaaaaaaggaggagcccgugaacauugaagcagagccgccuuucggcgaauccaauaucguuaucggaauuggcgacaaagcccucaagaucaacugguauaagaaagggucaagcauuggaaagauguuugaggcuacugcccgcggugcaagaaggauggccauacugggcgauaccgcuugggacuucgggagugugggaggcguccuuaauucucuggguaaaauggugcaucagaucuuuggguccgccuacacagcauuguucagcggcguaucguggauuaugaagaucggaaucggcgugcuccugacuuggauuggguuaaacucuaaaaauaccuccaugucauuuaguugcauaguuaucggaauuaucacgcuguaucuaggcgcggucgugcaggcugauauggguugugugauuaacuggaaggggaaggaacucaaaugcggaagcggcaucuucgucacaaaugagguucacaccuggacugagcaguacaaguuucaagccgacucccccaaacggcuggcaacagccauagcuggugccugggaaaacggcgugugugggauccgaucuaccacucgcauggagaaucuuuuguggaagcagauugcaaacgaacugaauuauauccucugggagaacaauauuaaacugaccgugguagucggagauaucauaggcguguuagaacaggggaagagaacacugacgccacagccuauggagcuuaaauacagcuggaagaccuggggaaaggcuaaaauuguuacugccgagacacaaaacucaaguuucaucauugacggccccaacaccccagaaugccccuccgcgagcagggccuggaaugugugggaggucgaagacuaugguuuugggguguucacaacuaacaucugguugaagcuccgggagguuuacacccagucuugugaucaucgccugaugucagcugcaauaaaagacgaaagagccgugcacgcugauaugggauacuggaucgagagucagaagaauggcagcuggaaacuagagaaggccuccuuuauugaaguaaagacgugcacauggccuaaaucucacacccuguggucgaacgguguccucgagagcgacaugaucauuccaaagucccuggcaggcccgaucucacagcauaaucacaggcccggguaucauacucaaaccgcgggaccuuggcaccuuggcaaauuggaacuggauuucaacuacugcgaggggacaacuguggugauaaccgagaauuguggaacacguggcccaaguuuacggacgaccacugucucugguaagcucauucacgaauggugcugucgaagcugcacacugcccccucuuagauauaugggggaggacggauguugguacggcauggaaaucaggccaaucaacgagaaagaagagaauaugguuaagucccuggugucagccgguagcggcaagguagauaacuuuaccauggggguguugugccucgcuauucuguucgaggaagucaugcgcggaaaauucggcaagaaacauaugaucgccggggugcuauuuacuuucguucugcuccugucuggacagauuacauggcgggacauggcacacacccuuauaaugaucggcuccaaugcuagugauagaauggguaugggggugacguauuuggcccugauugcaacuuuuaagauccagcccuucuuagcccucggauuuuuccugaggaaacuuaccagccgcgagaaccugcuacucggcgucggccuggcuauggcgacaaccuugcaacugccggaagacauugagcagauggccaaugggaucgcauuaggacucaugacucugaagcuuauaacacaguuugaaaccuaccagcuguggacagcuuuggugucucucacuuguuccaacaccaucuucacgcugacaguugccuggcgaaccgccacucuaauucuggcuggugugucacuucucccucugugccaaaguagcucgaugcggaagaccgauugguugccaaugacagucgcagccaugggcguacccccucugcccuuauuuaucuucucccucaaagacgcgccaaagcguagaucuuggccucugaaugagggggugauggcuguuggacuugugagcauucuggccucaaguuugcucaggaacgauguccccauggcaggcccacugguggccggugggcuacugaucgcuuguuauguaauaacuggaaccuccgcagaccuuacgguggagaaagccgcggacgucacaugggaagaggaagcugagcagaccggcguuucucauaaccucaugauuacuguggaugacgauggcacaaugcgcaucaaggacgaugaaaccgagaauauccugacuguguuguuaaaaacagcccugcucauugucagcgggauauuuccguacuccaucccugcaacccugcuuguguggcacacguggcagaagcagacucaacggucaggaguucugugggacguacccagcccacccgagacccagaaagccgaauuggaggaagguguguacagaauuaagcagcagggcaucuucgggaagacacaagucggagugggcguucagaaagaggguguguuucauaccauguggcacgucacaaggggggcugugcuaacucacaacggaaagcgacuggagccuaauugggccaguguaaaaaaggaucucauuucuuauggcggcggguggcgccuguccacccaguggcaaaaaggagaagagguccaggugaucgcaguugaaccagguaagaaccccaagaauuuccagacgaugccuggcauauuccagacaacuaccggggagaucggagcuauugcccuugacuuuaaaccgggcacaagcgguucgccaaucauuaaccgggaagggaagguggucggauuauacggcaauggcgugguuaccaaaaacgggggauaugugucagguaucgcgcaaacuaaugccgagcccgauggcccuaccccagagcuggaagaggaaauguucaagaaaagaaaccucacaauaauggacuugcaucccgggucuggaaagacgaggaaguaccugccugcaauuguccgugaggcuaucaaacgccggcucagaacucugauccuugccccgaccagggugguagcugcagaaauggaggaggcccugaagggcuugcccauucgauaucagacaaccgccacuaaaagugaacacacaggucgggagaucguggaucuaaugugccaugcuaccuuuacgaugcgccugcucuccccaguuagagucccuaauuacaacuuaauaauuauggacgaagcgcacuucacugaucccgcaagcaucgccgcuaggggguauauuucuacacgggugggaaugggcgaggccgcagccaucuuuaugaccgcuaccccaccuggcacugcggaagccuucccccagagcaaugcaccaauacaggacgaggagcgagacauuccggaaagauccuggaacucagggaaugaguggaucacagauuuugugggaaagaccgucugguucguaccuaguaucaaagcugguaacgacauugccaacugucugcgcaagaauggcaagaaagugauccaacuuagcaggaagacauuugauacugaauaccagaaaacgcgucugaacgacugggauuucguugugaccacagacauuucugagaugggggcaaauuuuaaggccgaucgggucauagaccccagaaggugccucaaaccagugaucuugacugauggacccgagcgcguuauucuggcuggcccuaugccagugaccgccgcguccgcagcccagcgaagaggucgggucgggaggaacccccagaaggaaaaugaccaauacaucuucacaggccagccucucaacaaugaugaggaccaugcucacuggaccgaagccaagaugcugcuugacaacaucaauacuccggagggaauuauaccagcucuauucgaacccgagcgcgagaaaucagcagccaucgauggcgaauaucgucugaagggggagaguagaaaaacguuuguggaauugaugcggaggggagacuuaccuguauggcuggcucacaagguggccagcgaggguauuaaauacaccgaucgcaaguggugcuucgacggcgaacgaaacaaucagauccucgaggagaacauggauguugaaauuuggacaaaagagggggaaagaaagaagcugcggcccagguggcuugacgcacgcacuuauuccgauccacuggcgcucaaagaguuuaaggacuucgccgcuggaagaaaaucuaucgccuuggaucuggucaccgaaauaggcagggugccuucgcaucuagcacaccggacacguaaugcucuggacaaccucgugaugcuucauaccagcgagcacggugggcgcgccuaccgacacgcagucgaggaacugcccgagacuauggaaacauuauugcugcucggccugaugauccuucugacgggaggcgccaugcucuuuuugguuucagggaagggaauugguaaaaccacuaucggccugauuugugugaucguauccagugggauguuauggauggcugauauaccacuacaguggauugcgucugccaucgugcuggaguucuuuaugaugguccuccuuauuccugagccggaaaagcaaagaacaccccaggacaaucagcuggcauaugugguuaucggaauauugacccuggcugccaucguggccgcaaacgagaugggccuccuggaaaccacaaagagggaucuugguaugagcaaagagccaggggucguauccccuacuucauaccucgacguggaccugcaucccgcuucugccuggacguuguaugcgguugcuaccacagugauuacuccaaugcugcggcacaccaucgaaaauagcacagccaacgucaguuuagcagccauugcuaaccaagcagugguccuaaugggccuggauaagggauggccuaucuccaaaauggaccucggcgugccccuucuggccuuggggugcuacagccagguuaauccgcugacccucacugcggcugugcugcuuuuaguaacgcauuacgccauaauuggaccaggccugcaggcaaaggccacacgcgaggcucagaaaagaaccgccgcagguaucaugaagaacccuacuguggaugggaucaugaccauugaccucgaucccgucaucuaugacucuaaguucgagaaacaauugggacagguuaugcugcuagugcugugugcuguccagcuccuucugaugaggacaucaugggccuugugcgaagcgcugacucucgccaccggcccaauaacaacgcugugggaggguucccccggcaaguuuuggaauaccacuauugcagugaguauggcuaacaucuuccgggggagcuacuuagccggagcaggccuugcuuuuucgauuaugaaaucuguagggacaggacgaagaggcaccgguucccagggggaaacucugggagagaaguggaaaaagaagcucaaucaacuaagccgcaaagaauucgaucuguauaagaaaucaggcaucacagagguggacaggaccgaggccaaggaagguuugaaacggggcgagacgacccaccaugccguuagucgugggucugcgaagcugcagugguuuguggaaagaaacauggucauaccugagggaagggugaucgaucucggcugugggcgcggaggcugguccuacuauugcgcuggucuuaaaaaggucacagaagugcggggguacacuaagggaggcccgggccacgaggagcccguuccaaugagcaccuauggguggaauauuguaaaacugaugucaggaaaggacguguucuacuugccucccgaaaaaugugauacacugcucugcgacaucggugagaguagcccuuccccaacugucgaagagucucgaaccauuagaguguuaaagaugguugagcccuggcugaaaaacaaucaguucuguaucaaggugcuuaacccuuacaugccaacagucauugaacaccuggagaggcuacagcgcaaguauggcgggaugcucgugcggaauccccugagcagaaacuccacccaugaaauguacuggaucucaaauggaacuggcaacauaguaucuagugugaauaugguuucgcguuugcugcucaacagguuuacgaugacacaccggcgcccgaccauugagaaagaugucgaccuuggugcagggacucgacaugugaacgccgaaccugagaccccaaauauggacgugaucggagagagaaucaagaggauuaaagaagagcacagcuccacauggcacuaugaugacgaaaaccccuacaagacgugggcuuaucauggcucuuacgaggucaaagccaccggcucagcaagcuccaugauaaaugggguugugaagcuguuaacuaagccuugggauguagugccaauggucacacaaauggccaugaccgacacuacacccuucggacagcagcggguguuuaaagaaaagguugauacccgcacaccgagaccuaugcccgguacuaggaaagugauggagaucaccgcugaguggcuguggcgaacguugggccggaacaagaaaccacgucucugcaccagagaagaguucacaaagaagguccgcacuaaugcggccaugggggcaguguuuaccgaagagaaccaaugggacagugcuagggccgcaguagaagaugaggaguucuggaaacugguugaccgggaaagagagcuacacaagcuuggaaaauguggcucuugcguguauaauaugauggguaagcgcgaaaaaaagcugggggaguuuggaaaagccaagggcagcagggcuauuugguacauguggcucggcgcccgauuccuggaguuugaagcguugggguuccugaacgaggaucauugguuuucacgggaaaauuccuacaguggagucgagggugaaggccuccacaagcuuggguauauccugagagacauuagcaaaaucccuggaggcgcaauguacgccgaugacacagcugguugggacacuaggauaaccgaggaugacuuacauaacgaggaaaagaucacgcagcagauggaucccgagcaccgccagcuggccaaugcaauuuucaaauugacauaucaaaacaagguggugaaaguccagcguccaacccccaaggggacuguuauggacaucauuucucggaaggaucagagaggauccggccaggugggcacauacgggcucaauaccuuuacuaacauggaagcucaacugguaaggcagauggagggagaaggugugcuaucaaaaaccgaccuugagaauccucaccugcucgagaagaaaaucacacaguggcuggaaaacaagggcgucgagcgcuugaaacgaauggccauaagcggggaugacugcgugguuaagccaauugaugaccgguucgcuaacgccuuacuggcacucaaugauaugggaaaggugagaaaagacaucccgcaguggcaacccucgaagggcuggcaugauuggcagcaggucccuuucuguucucaccauuuucacgaacuuaucaugaaagacgguaggaagcuggugguaccaugccgcccccaggacgagcuaauugggagagcgcggauaagucaaggagccggcuggucccugaaagaaacggcuugucucggcaaggccuaugcacagauguggagcuugauguacuuccacaggcgugaucugcgacuugcuucaaacgccaucugcuccgcaguuccugugcauugggucccaaccucucgcacuacauggagcauucacgcccaucaccaguggaugaccacugaggacaugcugacaguguggaauagaguuuggaucgaggauaaccccuggauggaagacaagaccccugugacgacaugggaggaugucccguaucucgggaaacgggaagaccaaugguguggaaguuuaauuggucugaccuccagggcgacuugggcucagaauaucuugaccgccauacagcaggugcgcagccugaucggcgaugaggaguuucucgacuacaugccaucuaugaagagauuccggaaagaagaggaaucagagggggcaauuugguga

SEQ ID NO: 15228 - RNA, 9873 nt, Artificial Sequence
  derived and/or modified CDS sequence (opt3) from DENV-3__FJ639720__SS-prME
accagccugugccucaugaugaugcuucccgccacacuggcuuuccacuugacuuccagagacggcgagccuaggaugaucguggggaagaacgaacggggaaaaucuuuacuguuuaagacggcaaccgguauuaauauguguacacuaauagccauggaucucggcgagaugugcgacgauacugucaccuacaaauguccacugaucgcggaaguugagccggaagacauugauugcugguguaaccuuacaucaaccugggugacuuaugggacaugcaaucaggcuggagagcaucgccgagacaagcguaguguagcccuggcaccccacgugggcauggguuuggauaccagaacgcaaacuuggaugagcgccgagggggcuuggaggcaggucgaaaaaguggagaccugggcacuccggcauccuggauucacaauccuggcccuguuucucgcucacuacauuggcacuuccuuaauccagaagguugugauauucauccugcuuauguuggucaccccaucuaugacaaugcgcugugugggcguagggaacagagacuuuguugaaggacugucgggugccaccuggguggaugucgugcuagagcauggcgggugcgugacgacuauggcgaagaauaaacccacacucgacauugagcugcagaagaccgaagcaacucaacuugccacacugaggaaauuguguaucgagggaaagauuaccaacaucacgaccgauucacggugcccuacacagggcgaagcuauacucccagaggaacaggaccagaauuaugucuguaaacacacuuacguugaucgcgguugggggaacggaugcggccuguucggcaaggggagcuuagugaccugcgccaaguuucaaugucuggagcccauugagggaaaaguagugcaguaugaaaaucucaaguacacagucaucauuacugugcacaccggugaccagcaucagguuggcaacgacacacaaggggugaccgucgagaucacuccucaggcaaguacgguggaagcuguacuuccagaguauggaacacugggcuuggaaugcuccccgcgaaccggucuagauuucaaugagaugauccugcucacuaugaaaaacaaggccuggaugguucacagacagugguuuuucgaccugccccuuccuuggaccucuggggcgacaaccgagacuccaacauggaauaggaaagaacuguuggugacguuuaagaacgcccaugcaaaaaagcaagaggucgugguccucggcagccaggaaggagcuaugcacaccgcccugacuggcgcuacagagauucagaauuccgggggaaccucaauauucgccggucacuuaaagugucggcugaaaauggauaagcuagaacucaaaggcaugaguuacgcaaugugccugaacacauuugugcuuaagaaagagguuagcgagacucagcaugggaccaucuugauuaagguggaauacaagggagaggacgcccccuguaaaaucccuuucucuacggaagauggccaagguaaggcucacaacgggcgucugauaaccgcgaauccaguagucacaaaaaaggaggagcccgugaacauugaagcagagccgccuuucggcgaauccaauaucguuaucggaauuggcgacaaagcccuccgcaucaacugguauaagaaggggucaagcauuggaaaaauguuugaggcuacugccagaggugcaaggcggauggccauacugggcgauaccgcuugggacuucgggagugugggaggcguccuuaauucucuggguaagauggugcaucagaucuuuggguccgccuacacagcauuguucagcggcguaucguggauuaugaaaaucggaaucggcgugcuccugacuuggauuggguuaaacucuaagaauaccuccaugucauuuaguugcauaguuaucggaauuaucacgcuguaucuaggcgcggucgugcaggcugauauggguugugugauuaacuggaaagggaaggaacucaagugcggaagcggcaucuucgucacaaaugagguucacaccuggacugagcaguacaaauuucaagccgacucccccaagcgacuggcaacagccauagcuggugccugggaaaacggcgugugugggauccgcucuaccacuagaauggagaaucuuuuguggaaacagauugcaaacgaacugaauuauauccucugggagaacaauauuaagcugaccgugguagucggagauaucauaggcguguuagaacaggggaaaaggacacugacgccacagccuauggagcuuaaguacagcuggaaaaccuggggaaaggcuaagauuguuacugccgagacacaaaacucaaguuucaucauugacggccccaacaccccagaaugccccuccgcgagccgggccuggaaugugugggaggucgaagacuaugguuuugggguguucacaacuaacaucugguugaaacuccgcgagguuuacacccagucuugugaucauagacugaugucagcugcaauaaaggacgaaagggccgugcacgcugauaugggauacuggaucgagagucagaaaaauggcagcuggaagcuagagaaagccuccuuuauugaaguaaagacgugcacauggccuaagucucacacccuguggucgaacgguguccucgagagcgacaugaucauuccaaaaucccuggcaggcccgaucucacagcauaaucaccgucccggguaucauacucaaaccgcgggaccuuggcaccuuggcaaguuggaacuggauuucaacuacugcgaggggacaacuguggugauaaccgagaauuguggaacacggggcccaaguuuacgaacgaccacugucucugguaaacucauucacgaauggugcuguagaagcugcacacugcccccucuuagguauaugggggaggacggauguugguacggcauggaaauccgcccaaucaacgagaaggaagagaauaugguuaaaucccuggugucagccgguagcggcaagguagauaacuuuaccauggggguguugugccucgcuauucuguucgaggaagucaugcggggaaaguucggcaaaaagcauaugaucgccggggugcuauuuacuuucguucugcuccugucuggacagauuacauggagagacauggcacacacccuuauaaugaucggcuccaaugcuagugauaggauggguaugggggugacguauuuggcccugauugcaacuuuuaaaauccagcccuucuuagcccucggauuuuuccugcgcaagcuuaccagccgagagaaccugcuacucggcgucggccuggcuauggcgacaaccuugcaacugccggaagacauugagcagauggccaaugggaucgcauuaggacucaugacucugaaacuuauaacacaguuugaaaccuaccagcuguggacagcuuuggugucucucacuuguuccaacaccaucuucacgcugacaguugccuggcggaccgccacucuaauucuggcuggugugucacuucucccucugugccaaaguagcucgaugcguaagaccgauugguugccaaugacagucgcagccaugggcguacccccucugcccuuauuuaucuucucccucaaggacacuccaaaaagaaggucuuggccucugaaugagggggugauggcgguuggacuugugagcauucuggcuucaaguuugcuccgcaacgauguccccauggccggcccacugguggcaggugggcuacugaucgccuguuauguaauaaccggaacguccgcugaccuuacaguggagaaggcagccgacgucaccugggaagaggaagcggagcagacuggcguuucucauaaccucaugauuacaguggaugacgauggcaccaugcggaucaaagacgaugaaacugagaauauccugacaguguuguuaaagaccgcucugcucauugucagcgggauauuuccguacuccaucccugccacgcugcuuguguggcacacuuggcagaaacagacccaaagaucaggaguucugugggacguacccagcccacccgagacacagaaggcagaauuggaggaagguguguacaggauuaaacagcagggcaucuucgggaagacccaagucggagugggcguucagaaggaggguguguuucauacaauguggcacgucacucgaggggccgugcuaacccacaacggaaaacgccuggagccuaauugggcuaguguaaagaaagaucucauuucuuauggcggcggguggcggcuguccacgcaguggcaaaagggagaagagguccaggugaucgccguugaaccagguaaaaaccccaagaauuuccagacaaugccuggcauauuccagacuaccacaggggagaucggagcaauugcucuugacuuuaagccgggcaccagcgguucgccaaucauuaacagagaagggaaaguggucggauuauacggcaauggcgugguuacuaagaacgggggauaugugucagguaucgcccaaaccaaugcggagcccgauggcccuacaccagagcuggaagaggaaauguucaaaaagaggaaccucacgauaauggacuugcaucccgggucuggaaaaacucguaaguaccugccugccauuguccgcgaggcaaucaagcggagacucaggacccugauccuugcuccgacacgagugguagccgcugaaauggaggaggcacugaaaggcuugcccauucgguaucagaccacugccacaaagagugaacacaccggucgcgagaucguggaucuaaugugccaugccacguuuacuaugagacugcucuccccaguuagggucccuaauuacaacuuaauaauuauggacgaagcucacuucacagaucccgcgagcaucgcagcccggggguauauuucuacccgagugggaaugggcgaggcugccgcaaucuuuaugaccgccacuccaccuggcacagcugaagcguucccccagagcaaugccccaauacaggacgaggagagagacauuccggaacgcuccuggaacucagggaaugaguggaucaccgauuuugugggaaaaacagucugguucguaccuaguaucaaggcagguaacgacauugcuaacugucugaggaaaaauggcaagaaggugauccaacuuagccguaaaacuuuugauacggaauaccagaagacccggcugaacgacugggauuucguugugacaacugacauuucugagaugggggccaauuuuaaagcagauagagucauagaccccaggcgcugccucaagccagugaucuugaccgauggacccgagcgaguuauucuggccggcccuaugccagugacagcugccuccgcggcacagagacgggguagggucgggcgcaacccccagaaagaaaaugaccaauacaucuucaccggccagccucucaacaaugaugaggaccaugcccacuggacugaagcuaagaugcugcuugacaacaucaauacgccggagggaauuauaccagcccuauucgaacccgagcgugagaagucagcugcaaucgauggcgaauauagacugaaaggggagagucggaagaccuuuguggaauugaugaggcgcggagacuuaccuguauggcuggcccacaaaguggcuagcgaggguauuaaguacacagaucgaaaauggugcuucgacggcgaaagaaacaaucagauccucgaggagaacauggauguugaaauuuggacuaaggagggggaacggaaaaagcugaggccccgcuggcuugacgccagaaccuauuccgauccacuggcacucaaggaguuuaaagacuucgcggccggaaggaagucuaucgcuauagauuuggucacagaaaucggccgggugccuucgcaucuggcccaccguacccgcaaugcacuagacaaccuggugaugcuccauacuagcgagcacggugggcgagcuuacagacacgccgucgaggaacuucccgagacaauggaaacgcuguuauugcugggccucaugauucugcuuaccggaggcgcaaugcuguuucucguuucagggaaaggaaucgguaagacuacaauuggcuugaucugugugauaguauccagugggaugcuguggauggccgauauuccauuacaguggaucgcuucugcgauugugcuagaguucuuuaugaugguccugcucaucccugagccggaaaaacaaaggaccccccaggacaaucagcuugccuaugugguuauaggaauccugaccuuggcagcuauuguggccgccaacgagaugggccugcucgaaacaacuaagcgggaucuggguaugagcaaggagccaggggucguauccccuacgucauaccuugacguggaccuccaucccgcaucugcuuggacccuguaugccguugcgacaacugugaucaccccaauguugcgccacacaauugaaaauagcaccgcuaacgucagucuggccgcaaucgccaaccaagcuguggucuuaaugggccuagauaaaggauggccuauauccaagauggaccugggcgugccccuccuugcacuggggugcuacagccagguuaauccguugacucugacggccgcggugcuccugcuuguaacacauuacgcuauuaucggaccaggcuuacaggccaaagcaaccagagaggcccagaagaggacugcugccgguaucaugaaaaacccuaccguggaugggauuaugacaaucgaccuggaucccgucauauaugacucuaaguucgagaagcaacucggacagguuauguugcuggugcuaugugcaguccagcugcuccuuaugcggacuucaugggcucugugcgaagccuugacccuggcgacaggcccaauuacgacccucugggaggguucccccggcaaauuuuggaauacuacaaucgccgugaguauggcaaacauuuuccgagggagcuaccuggcuggagccggcuuagcauuuucgaucaugaagucuguagggaccggaagacgcggcacugguucccagggggaaacacuuggagagaaauggaagaaaaagcugaaucaacucagcaggaaggaauucgaucuauauaaaaagucaggcauaaccgagguggaccggacggaggcuaaagaaggucugaagcguggcgagaccacacaccaugccguuaguagagggucugccaaauugcagugguuuguggaaaggaacauggucaucccugagggacgcgugauugaucugggcugugggcggggaggcugguccuacuauugcgcgggucucaagaaagucacugaagugcgaggguacaccaagggaggcccgggccacgaggagcccguuccaaugagcacauauggguggaauaucguaaagcuuaugucaggaaaagacguguucuaccugccucccgaaaagugugauacuuugcugugcgacauuggugagaguagcccuuccccaaccgucgaagagucuagaacaaucagggugcucaaaaugguugagcccugguuaaagaacaaucaguucuguauuaaagugcugaacccuuacaugccaaccgucaucgaacaccuugagcgccugcagcggaaguauggcgggaugcuagugagaaauccccucagccguaacuccacucaugaaauguacuggauaucaaauggaacgggcaacauuguaucuagugugaauaugguuucgaggcuguugcugaaccgguuuacaaugacccaccgccgaccgacuaucgagaaggaugucgaccucggugcugggaccagacaugugaacgcagaaccugagacaccaaauauggacgugaucggagagaggauuaaacggauaaaggaagagcacagcuccacguggcacuaugaugacgaaaaccccuacaaaaccugggccuaucauggcucuuacgaggucaaggcuacuggcucagccagcuccaugaucaaugggguugugaaacuucugacaaagccuugggauguagugccaauggucacccaaauggcaaugacugacacaacccccuucggacagcagcgcguguuuaaggaaaaaguugauacaagaacuccgaggccuaugcccgguacccgaaaggugauggagauuacggccgagugguuauggcggacccugggccguaacaaaaagccaagauugugcacacgcgaagaguucacuaaaaaggucaggaccaaugcugcgaugggggccguguuuacagaagagaaccaaugggacagugcacgggcugccguagaagaugaggaguucuggaagcucguugacagagaacgcgagcugcacaaacuaggaaaguguggcucuugcguguauaauaugauggguaaaagggaaaagaaacuuggggaguuuggaaaggcaaaaggcagccgagccaucugguacauguggcugggcgcucgguuccucgaguuugaagcccugggguucuugaacgaggaucauugguuuucaagagaaaauuccuacaguggagucgagggugaaggccugcacaagcucggguauauucuuagggacaucagcaagauaccuggaggcgcgauguacgcagaugacacugccgguugggacacccgcaucacggaggaugaccugcauaacgaggaaaaaauuacacagcagauggaucccgagcaccgucaguuagcuaaugccaucuucaagcugaccuaucaaaacaaaguggugaagguccagcggccaacucccaaagggacaguuauggacauuaucucuagaaaggaucagaggggauccggccaggugggcaccuacggguugaauacuuuuaccaacauggaagcacaacucguacgccagauggagggagaaggugugcugucaaagacagaccuagagaauccucaccuucuggagaaaaagauaacgcaguggcucgaaaacaaaggcgucgagcgacugaagcggauggcuauuagcggggaugacugcgugguuaaaccaaucgaugacagauucgccaacgcuuuguuagcccugaaugauaugggaaaggugaggaaggacaucccgcaguggcaacccucgaaaggcuggcaugauuggcagcaggucccuuucuguucucaccauuuucacgaacucauuaugaaggacggucgcaaacuugugguaccaugcagaccccaggacgagcugauagggcgggcaaggaucagucaaggagcgggcuggucccuaaaggaaaccgccugucugggcaaagcuuaugcccagauguggagccucauguacuuccaccgucgagauuugcgccuggcaucaaacgcuauuugcuccgccguuccugugcauugggucccaacuucuagaacaaccuggagcauccacgcacaucaccaguggaugacuacagaggacaugcuuaccguguggaaucggguuuggauugaggauaaccccuggauggaagacaagacgccugugacaaccugggaggaugucccguaucuggggaagagggaagaccaaugguguggaagucucaucgguuuaacuucccgcgccaccugggcgcagaauauacugacagcuauccagcaggugagaagcuugauuggcgaugaggaguuucuggacuacaugccaucuaugaaacgguucaggaaggaagaggaaucagagggggccaucugguga

SEQ ID NO: 15229 - RNA, 9873 nt, Artificial Sequence
  derived and/or modified CDS sequence (opt3) from DENV-3__GQ868626__SS-prME
accagccugugccucaugaugaugcuucccgccacacuggcuuuccacuugacuuccagagacggcgagccuaggaugaucguggggaagaacgaacggggaaaaucuuuacuguuuaagacggcaaccgguauuaauauguguacacuaauagccauggaucucggcgagaugugcgacgauacugucaccuacaaauguccacugaucgcggaaguugagccggaagacauugauugcugguguaaccuuacaucaaccugggugacuuaugggacaugcaaucaggcuggagagcaucgccgagacaagcguaguguagcccuggcaccccacgugggcauggguuuggauaccagaacgcaaacuuggaugagcgccgagggggcuuggaggcaggucgaaaaaguggagaccugggcacuccggcauccuggauucacaauccuggcccuguuucucgcucacuacauuggcacuuccuuaauccagaagguugugauauucauccugcuuauguuggucaccccaucuaugacaaugcgcugugugggcguagggaacagagacuuuguugaaggacugucgggugccaccuggguggaugucgugcuagagcauggcgggugcgugacgacuauggcgaagaauaaacccacacucgacauugagcugcagaagaccgaagcaacucaacuugccacacugaggaaauuguguaucgagggaaagauuaccaacaucacgaccgauucacggugcccuacacagggcgaagcuauacucccagaggaacaggaccagaauuaugucuguaaacacacuuacguugaucgcgguugggggaacggaugcggccuguucggcaaggggagcuuagugaccugcgccaaguuucaaugucuggagcccauugagggaaaaguagugcaguaugaaaaucucaaguacacagucaucauuacugugcacaccggugaccagcaucagguuggcaacgacacacaaggggugaccgucgagaucacuccucaggcaaguacgguggaagcuguacuuccagaguauggaacacugggcuuggaaugcuccccgcgaaccggucuagauuucaaugagaugauccugcucacuaugaaaaacaaggccuggaugguucacagacagugguuuuucgaccugccccuuccuuggaccucuggggcgacaauugagaccccaacuuggaauaggaaagaacuguuggugacauuuaagaacgcccaugcaaaaaagcaagaggucgugguccucggcagccaggaaggagcuaugcacacggcccugaccggcgcuacugagauacagaauuccgggggaacaucaaucuucgccggucacuuaaagugucggcugaaaauggauaagcuagaacucaaaggcaugaguuacgcaaugugccugaacaccuuugugcuucguaaggagguuagcgagacacagcaugggacuauuuugaucaaaguggaauacaagggagaggacgcccccuguaagauaccuuucucuaccgaagauggccaagguaaagcucacaacgggcgccugauuacggcgaauccaguagucaccaagaaagaggagcccgugaacaucgaagcagagccgccuuucggcgaauccaauaucguuauuggaaucggcgacaaggcccucaaaauuaacugguauaagaaggggucaagcauaggaaaaauguuugaggcuacagccagaggugcaaggcggauggccauccugggcgauacugcuugggacuucgggagugugggaggcguccuuaauucucuggguaagauggugcaucagauuuuuggguccgccuacaccgcauuguucagcggcguaucguggaucaugaaaaucggaauuggcgugcuccugacauggauaggguuaaacucuaagaauacuuccaugucauuuaguugcaucguuauuggaaucauuacccuguaucuaggcgcggucgugcaggcugauauggguugugugaucaacuggaaagggaaggaacucaagugcggaagcggcauauucgucacgaaugagguucacacauggaccgagcaguacaaauuucaagccgacucccccaagcgacuggcaacugccaucgcuggugccugggaaaacggcgugugugggauucgcucuacaaccagaauggagaaucuuuuguggaaacagaucgcaaacgaacugaauuauauucucugggagaacaauaucaagcugacugugguagucggagauauaauuggcguguuagaacaggggaaaaggacccugacaccacagccuauggagcuuaaguacagcuggaaaacguggggaaaggcuaagaucguuaccgccgagacucaaaacucaaguuucauuaucgacggccccaacacaccagaaugccccuccgcgagccgggccuggaaugugugggaggucgaagacuaugguuuugggguguucaccacaaacauaugguugaaacuccgcgagguuuacacucagucuugugaucauagacugaugucagcugcaaucaaggacgaaagggccgugcacgcugauaugggauacuggauugagagucagaaaaauggcagcuggaagcuagagaaagccuccuuuaucgaaguaaagaccugcacguggccuaagucucacacacuguggucgaacgguguccucgagagcgacaugauuaucccaaaaucccuggcaggcccgauaucacagcauaaucaccgucccggguaucauacccaaacugcgggaccuuggcaccuuggcaaguuggaacuggauuucaacuacugcgaggggaccacaguggugauuacugagaauuguggaacccggggcccaaguuuacgaacaacgaccgucucugguaaacucauccacgaauggugcuguagaagcugcacucugcccccucuuagguauaugggggaggacggauguugguacggcauggaaauccgcccaauuaacgagaaggaagagaauaugguuaaaucccuggugucagccgguagcggcaagguagauaacuuuacaauggggguguugugccucgcuauccuguucgaggaagucaugcggggaaaguucggcaaaaagcauaugauugccggggugcuauuuaccuucguucugcuccugucuggacagauaacuuggagagacauggcacacacacuuaucaugauuggcuccaaugcuagugauaggauggguaugggggugaccuauuuggcccugaucgcaacguuuaaaauucagcccuucuuagcccucggauuuuuccugcgcaagcuuacuagccgagagaaccugcuacucggcgucggccuggcuauggcgaccacauugcaacugccggaagacaucgagcagauggccaaugggauagcauuaggacucaugacccugaaacuuaucacucaguuugaaacauaccagcuguggaccgcuuuggugucucucacauguuccaacacuauuuucacccugacgguugccuggcggacagccacccuaauccuggcuggugugucacuucucccucugugccaaaguagcucgaugcguaagacugauugguugccaaugaccgucgcagccaugggcguacccccucugcccuuauuuauuuucucccucaaggacacaccaaaaagaaggucuuggccucugaaugagggggugauggcgguuggacuugugagcauccuggcuucaaguuugcuccgcaacgauguccccauggccggcccacugguggcaggugggcuacugauagccuguuauguaauuacuggaaccuccgcugaccuuacgguggagaaggcagccgacgucacaugggaagaggaagcggagcagaccggcguuucucauaaccucaugaucacuguggaugacgauggcacaaugcggaucaaagacgaugaaaccgagaauauucugacuguguuguuaaagacagcucugcucauagucagcgggaucuuuccguacuccauuccugccacccugcuuguguggcacacguggcagaaacagacucaaagaucaggaguucugugggacguacccagcccacccgagacccagaaggcagaauuggaggaagguguguacaggaucaaacagcagggcauuuucgggaagacacaagucggagugggcguucagaaggaggguguguuucauaccauguggcacgucacacgaggggccgugcuaacucacaacggaaaacgccuggagccuaauugggcuaguguaaagaaagaucucaucucuuauggcggcggguggcggcuguccacccaguggcaaaagggagaagagguccaggugauagccguugaaccagguaaaaaccccaagaauuuccagacgaugccuggcaucuuccagacaacuaccggggagauuggagcaaucgcucuugacuuuaagccgggcacaagcgguucgccaauuaucaacagagaagggaaaguggucggauuauacggcaauggcgugguuaccaagaacgggggauaugugucagguauagcccaaacuaaugcggagcccgauggcccuaccccagagcuggaagaggaaauguucaaaaagaggaaccucacaauuauggacuugcaucccgggucuggaaaaacgcguaaguaccugccugccaucguccgcgaggcaaucaagcggagacucaggacucugauucuugcuccgacccgagugguagccgcugaaauggaggaggcacugaaaggcuugcccauccgguaucagacaaccgccacuaagagugaacacacaggucgcgagauaguggaucuaaugugccaugccaccuuuacgaugagacugcucuccccaguuagggucccuaauuacaacuuaauuaucauggacgaagcucacuucacugaucccgcgagcauugcagcccggggguauaucucuacacgagugggaaugggcgaggcugccgcaauauuuaugaccgccaccccaccuggcacugcugaagcguucccccagagcaaugccccaauucaggacgaggagagagacaucccggaacgcuccuggaacucagggaaugaguggaucacagauuuugugggaaaaaccgucugguucguaccuaguauuaaggcagguaacgacaucgcuaacugucugaggaaaaauggcaagaaggugauucaacuuagccguaaaacauuugauacugaauaccagaagacgcggcugaacgacugggauuucguugugaccacagacauaucugagaugggggccaauuuuaaagcagauagagucaucgaccccaggcgcugccucaagccagugauuuugacugauggacccgagcgaguuauccuggccggcccuaugccagugaccgcugccuccgcggcacagagacgggguagggucgggcgcaacccccagaaagaaaaugaccaauacaucuucacaggccagccucucaacaaugaugaggaccaugcccacuggaccgaagcuaagaugcugcuugacaacauuaauacuccggagggaauaaucccagcccuauucgaacccgagcgugagaagucagcugcaauugauggcgaauauagacugaaaggggagagucggaagacguuuguggaauugaugaggcgcggagacuuaccuguauggcuggccuacaaaguggcuagcgaggguaucaaguauaccgaucgaaaauggugcuucgacggcgaaagaaacaaucagauucucgaggagaacauggauguugaaaucuggacaaaggagggggaacggaaaaagcugaggccccgcuggcuugacgccagaacuuacuccgauccacuggcacucaaggaguuuaaagacuucgcggccggaaggaagucuauagcuuuggaucuggucaccgaaaucggccgggugccuucgcaccuagcccaucguacacgcaaugcacuggacaaccucgugaugcuucacaccagcgagcauggugggcgagcuuauagacacgccgucgaggaacugcccgagacuauggaaacauuauugcugcucggccugaugauucuucugacgggaggcgcaaugcucuuuuugaucucagggaaaggaauugguaagaccacuaucggccugauauguguuauuguguccagugggauguuauggauggccgauaucccacuacaguggauugcuucugcgaucguacuggaguucuuuaugauggugcuccuuauaccugagccggaaaaacaaaggacaccccaggacaaucagcuggccuacgucgugaucggaauuuugacccuggcagcuaucguugccgccaacgagaugggccuccuggaaaccacaaagcgggaucuugguaugagcaaggagccagggguggucuccccuacuucauaucucgacguagaccugcaccccgcaucugcuuggacguuguacgccguggcgaccacaguuauuacuccaaugcugcgccauaccaucgaaaauagcacagcuaacgugaguuuagccgcaauagccaaccaagcugucgugcuaaugggccuggauaaaggauggccuauuuccaagauggaccucggcgucccccuucuggcauuggggugcuacagccaggugaauccgcugacccucacugccgcgguucugcuuuuagugacgcacuaugcuaucaucggaccaggccugcaggccaaagcaacaagagaggcccagaagaggaccgcugccgguauuaugaaaaacccuacuguagaugggaucaugaccauagaccucgaucccgugauuuacgacucuaaguucgagaagcaauugggacaggucaugcugcuaguucugugugcagugcagcuccuucugaugcggacaucaugggcuuugugcgaagcccugacucucgcgaccggcccaaucacaacgcugugggaggguucccccggcaaauuuuggaauaccacuauugccgucaguauggcaaacaucuuccgagggagcuauuuagcuggagccggccuugcauuuucgauaaugaagucuguggggacaggaagacgcggcaccgguucccagggggaaacucugggagagaaauggaagaaaaagcucaaucaacuaagcaggaaggaauucgaucuguacaaaaagucaggcaucacagagguagaccggaccgaggcuaaagaagguuugaagcguggcgagacgacccaucacgccgugaguagagggucugccaaacugcagugguuuguugaaaggaacauggugauuccugagggacgcgucaucgaucucggcugugggcggggaggcugguccuauuacugcgcgggucuuaagaaagugacagaaguccgaggguauacuaagggaggcccgggccaugaggagcccgugccaaugagcaccuacggguggaauauuguuaagcugaugucaggaaaagacguauucuacuugccucccgaaaagugugauacacugcucugcgacaucggugagaguagcccuuccccaacuguggaagagucuagaaccauuagggucuuaaaaaugguggagcccuggcugaagaacaaucaguucuguaucaaaguucuuaacccuuauaugccaacagugauagaacaccuggagcgccuacagcggaaguacggcgggaugcucgucagaaauccccugagccguaacuccacccacgaaauguauuggauuucaaauggaacuggcaacaucgugucuaguguaaauauggugucgagguugcugcucaaccgguuuacgaugacacaucgccgaccgaccaucgagaaggauguugaccuuggugcugggacuagacacgucaacgcagaaccugagaccccaaauauggacgugauuggagagaggauaaaacggaucaaggaagagcauagcuccacauggcacuacgaugacgaaaaccccuauaaaacgugggccuaccacggcucuuaugaggugaaggcuaccggcucagccagcuccaugauuaauggggucguuaaacuguuaacuaagccuugggaugugguaccaauggugacacaaauggcaaugaccgacacuacacccuucggacagcagcgcgucuuuaaggaaaaaguggauaccagaacaccgaggccuaugcccgguacucgaaagguuauggagaucaccgccgaguggcuguggcggacguugggccguaacaaaaagccaagacucugcacccgcgaagaguucacaaaaaaggugaggacuaaugcugcgaugggggccgucuuuaccgaagagaaccaaugggacagugcacgggcugccguggaagaugaggaguucuggaagcugguagacagagaacgcgagcuacauaaacuuggaaaguguggcucuugcguuuacaauaugauggguaaaagggaaaagaaacugggggaguuuggaaaggcaaaaggcagccgagccauuugguacauguggcucggcgcucgguuccuggaguuugaagccuugggguuccugaacgaggaucacugguuuucaagagaaaauuccuauaguggaguggagggugaaggccuccauaagcuuggguacauccugagggacauaagcaagaucccuggaggcgcgauguaugcagaugacacagccgguugggacacucgcauuaccgaggaugacuuacacaacgaggaaaaaaucacgcagcagauggaucccgagcaucgucagcuggcuaaugccauuuucaaguugacauaccaaaacaaagucgugaaggugcagcggccaacccccaaagggacugucauggacaucauaucuagaaaggaucagaggggauccggccagguuggcacauaugggcucaauaccuuuacuaacauggaagcacaacuggugcgccagauggagggagaagguguacuaucaaaggcugaccuugagaauccucaccugcucgagaaaaagauuacccaguggcuggaaaacaaaggcguggagcgauugaagcggauggccaucagcggggaugacugcgucgugaaaccaaucgaugacagauucgcuaacgccuuacuggcacucaaugauaugggaaagguuaggaaggacauuccgcaguggcaacccucgaaaggcuggcacgauuggcagcaggugccuuucuguucucaucacuuucaugaacuuauaaugaaggacggucgcaaacuggucgugccaugcagaccccaggacgagcuaaucgggcgggcgaggauuagucaaggagccggcuggucccugaaggaaacagcuugucucggcaaagccuacgcacagauguggagcuugauguauuuccaccgucgagaucugcgccuugcuucaaacgccaucugcuccgcaguaccuguucacugggugccaacgucuagaaccacuuggagcauucaugcccaccaucaguggaugacaaccgaggacaugcuggcggucuggaaucggguguggaucgaggauaaccccuggauggaagacaagacuccuguuacaaccugggaggaugugccguaccucgggaagagggaagaccaaugguguggaaguuuaauaggucugacgucccgcgcuacaugggcccagaauaucuugaccgcaauucagcaggucagaagccugaucggcgaugaggaguuucucgacuacaugccaucuaugaaacgguucaggaaggaagaggaaucagagggggccauuugguga

SEQ ID NO: 15230 - RNA, 9873 nt, Artificial Sequence
  derived and/or modified CDS sequence (opt3) from DENV-3__GQ868627__SS-prME
accagccugugccucaugaugaugcuucccgccacacuggcuuuccacuugacuuccagagacggcgagccuaggaugaucguggggaagaacgaacggggaaaaucuuuacuguuuaagacggcaaccgguauuaauauguguacacuaauagccauggaucucggcgagaugugcgacgauacugucaccuacaaauguccacugaucgcggaaguugagccggaagacauugauugcugguguaaccuuacaucaaccugggugacuuaugggacaugcaaucaggcuggagagcaucgccgagacaagcguaguguagcccuggcaccccacgugggcauggguuuggauaccagaacgcaaacuuggaugagcgccgagggggcuuggaggcaggucgaaaaaguggagaccugggcacuccggcauccuggauucacaauccuggcccuguuucucgcucacuacauuggcacuuccuuaauccagaagguugugauauucauccugcuuauguuggucaccccaucuaugacaaugcgcugugugggcguagggaacagagacuuuguugaaggacugucgggugccaccuggguggaugucgugcuagagcauggcgggugcgugacgacuauggcgaagaauaaacccacacucgacauugagcugcagaagaccgaagcaacucaacuugccacacugaggaaauuguguaucgagggaaagauuaccaacaucacgaccgauucacggugcccuacacagggcgaagcuauacucccagaggaacaggaccagaauuaugucuguaaacacacuuacguugaucgcgguugggggaacggaugcggccuguucggcaaggggagcuuagugaccugcgccaaguuucaaugucuggagcccauugagggaaaaguagugcaguaugaaaaucucaaguacacagucaucauuacugugcacaccggugaccagcaucagguuggcaacgacacacaaggggugaccgucgagaucacuccucaggcaaguacgguggaagcuguacuuccagaguauggaacacugggcuuggaaugcuccccgcgaaccggucuagauuucaaugagaugauccugcucacuaugaaaaacaaggccuggaugguucacagacagugguuuuucgaccugccccuuccuuggaccucuggggcgacaaccgagacuccaacauggaauaggaaagaacuguuggugacguuuaagaacgcccaugcaaaaaagcaagaggucgugguccucggcagccaggaaggagcuaugcacaccgcccugacuggcgcuacagagauucagaauuccgggggaaccucaauauucgccggucacuuaaagugucggcugaaaauggauaagcuagaacucaaaggcaugaguuacgcaaugugccugaacacauuugugcuucguaaggagguuagcgagacucagcaugggaccaucuugauuaaaguggaauacaagggagaggacgcccccuguaagaucccuuucucuacggaagauggccaagguaaagcucacaacgggcgccugauaaccgcgaauccaguagucacaaagaaagaggagcccgugaacauugaagcagagccgccuuucggcgaauccaauaucguuaucggaauuggcgacaaggcccucaaaaucaacugguauaagaaggggucaagcauuggaaaaauguuugaggcuacugccagaggugcaaggcggauggccauacugggcgauaccgcuugggacuucgggagugugggaggcguccuuaauucucuggguaagauggugcaucagaucuuuggguccgccuacacagcauuguucagcggcguaucguggauuaugaaaaucggaaucggcgugcuccugacuuggauuggguuaaacucuaagaauaccuccaugucauuuaguugcauaguuaucggaauuaucacgcuguaucuaggcgcggucgugcaggcugauauggguugugugauuaacuggaaagggaaggaacucaagugcggaagcggcaucuucgucacaaaugagguucacaccuggacugagcaguacaaauuucaagccgacucccccaagcgacuggcaacagccauagcuggugccugggaaaacggcgugugugggauccgcucuaccacuagaauggagaaucuuuuguggaaacagauugcaaacgaacugaauuauauccucugggagaacaauauuaagcugaccgugguagucggagauaucauaggcguguuagaacaggggaaaaggacacugacgccacagccuauggagcuuaaguacagcuggaaaaccuggggaaaggcuaagauuguuacugccgagacacaaaacucaaguuucaucauugacggccccaacaccccagaaugccccuccgcgagccgggccuggaaugugugggaggucgaagacuaugguuuugggguguucacaacuaacaucugguugaaacuccgcgagguuuacacccagucuugugaucauagacugaugucagcugcaauaaaggacgaaagggccgugcacgcugauaugggauacuggaucgagagucagaaaaauggcagcuggaagcuagagaaagccuccuuuauugaaguaaagacgugcacauggccuaagucucacacccuguggucgaacgguguccucgagagcgacaugaucauuccaaaaucccuggcaggcccgaucucacagcauaaucaccgucccggguaucauacucaaaccgcgggaccuuggcaccuuggcaaguuggaacuggauuucaacuacugcgaggggacaacuguggugauaaccgagaauuguggaacacggggcccaaguuuacgaacgaccacugucucugguaaacucauucacgaauggugcuguagaagcugcacacugcccccucuuagguauaugggggaggacggauguugguacggcauggaaauccgcccaaucaacgagaaggaagagaauaugguuaaaucccuggugucagccgguagcggcaagguagauaacuuuaccauggggguguugugccucgcuauucuguucgaggaagucaugcggggaaaguucggcaaaaagcauaugaucgccggggugcuauuuacuuucguucugcuccugucuggacagauuacauggagagacauggcacacacccuuauaaugaucggcuccaaugcuagugauaggauggguaugggggugacguauuuggcccugauugcaacuuuuaaaauccagcccuucuuagcccucggauuuuuccugcgcaagcuuaccagccgagagaaccugcuacucggcgucggccuggcuauggcgacaaccuugcaacugccggaagacauugagcagauggccaaugggaucgcauuaggacucaugacucugaaacuuauaacacaguuugaaaccuaccagcuguggacagcuuuggugucucucacuuguuccaacaccaucuucacgcugacaguugccuggcggaccgccacucuaauucuggcuggugugucacuucucccucugugccaaaguagcucgaugcguaagaccgauugguugccaaugacagucgcagccaugggcguacccccucugcccuuauuuaucuucucccucaaggacacuccaaaaagaaggucuuggccucugaaugagggggugauggcgguuggacuugugagcauucuggcuucaaguuugcuccgcaacgauguccccauggccggcccacugguggcaggugggcuacugaucgccuguuauguaauaaccggaacguccgcugaccuuacaguggagaaggcagccgacgucaccugggaagaggaagcggagcagacuggcguuucucauaaccucaugauuacaguggaugacgauggcaccaugcggaucaaagacgaugaaacugagaauauccugacaguguuguuaaagaccgcucugcucauugucagcgggauauuuccguacuccaucccugccacgcugcuuguguggcacacuuggcagaaacagacccaaagaucaggaguucugugggacguacccagcccacccgagacacagaaggcagaauuggaggaagguguguacaggauuaaacagcagggcaucuucgggaagacccaagucggagugggcguucagaaggaggguguguuucauacaauguggcacgucacucgaggggccgugcuaacccacaacggaaaacgccuggagccuaauugggcuaguguaaagaaagaucucauuucuuauggcggcggguggcggcuguccacgcaguggcaaaagggagaagagguccaggugaucgccguugaaccagguaaaaaccccaagaauuuccagacaaugccuggcauauuccagacuaccacaggggagaucggagcaauugcucuugacuuuaagccgggcaccagcgguucgccaaucauuaacagagaagggaaaguggucggauuauacggcaauggcgugguuacuaagaacgggggauaugugucagguaucgcccaaaccaaugcggagcccgauggcccuacaccagagcuggaagaggaaauguucaaaaagaggaaccucacgauaauggacuugcaucccgggucuggaaaaacucguaaguaccugccugccauuguccgcgaggcaaucaagcggagacucaggacccugauccuugcuccgacacgagugguagccgcugaaauggaggaggcacugaaaggcuugcccauucgguaucagaccacugccacaaagagugaacacaccggucgcgagaucguggaucuaaugugccaugccacguuuacuaugagacugcucuccccaguuagggucccuaauuacaacuuaauaauuauggacgaagcucacuucacagaucccgcgagcaucgcagcccggggguauauuucuacccgagugggaaugggcgaggcugccgcaaucuuuaugaccgccacuccaccuggcacagcugaagcguucccccagagcaaugccccaauacaggacgaggagagagacauuccggaacgcuccuggaacucagggaaugaguggaucaccgauuuugugggaaaaacagucugguucguaccuaguaucaaggcagguaacgacauugcuaacugucugaggaaaaauggcaagaaggugauccaacuuagccguaaaacuuuugauacggaauaccagaagacccggcugaacgacugggauuucguugugacaacugacauuucugagaugggggccaauuuuaaagcagauagagucauagaccccaggcgcugccucaagccagugaucuugaccgauggacccgagcgaguuauucuggccggcccuaugccagugacagcugccuccgcggcacagagacgggguagggucgggcgcaacccccagaaagaaaaugaccaauacaucuucaccggccagccucucaacaaugaugaggaccaugcccacuggacugaagcuaagaugcugcuugacaacaucaauacgccggagggaauuauaccagcccuauucgaacccgagcgugagaagucagcugcaaucgauggcgaauauagacugaaaggggagagucggaagaccuuuguggaauugaugaggcgcggagacuuaccuguauggcuggccuacaaaguggcuagcgaggguauuaaguauacagaucgaaaauggugcuucgacggcgaaagaaacaaucagauccucgaggagaacauggauguugaaauuuggacuaaggagggggaacggaaaaagcugaggccccgcuggcuugacgccagaaccuacuccgauccacuggcacucaaggaguuuaaagacuucgcggccggaaggaagucuaucgcuuuggaucuggucacagaaauaggccgggugccuucgcaccuagcccaucguacccgcaaugcacuggacaaccucgugaugcuucacacuagcgagcauggugggcgagcuuauagacacgccgucgaggaacugcccgagacaauggaaacguuauugcugcucggccugaugauccuucugaccggaggcgcaaugcucuuuuugauuucagggaaaggaaucgguaagacuacaauuggccugaucuguguuauaguguccagugggauguuauggauggccgauauuccacuacaguggaucgcuucugcgauuguacuggaguucuuuaugauggugcuccuuaucccugagccggaaaaacaaaggaccccccaggacaaucagcuggccuacgucgugauaggaaucuugacccuggcagcuauuguugccgccaacgagaugggccuccuggaaacaacuaagcgggaucuugguaugagcaaggagccagggguggucuccccuacgucauaucucgacguagaccugcaccccgcaucugcuuggaccuuguacgccguggcgacaacuguuaucaccccaaugcugcgccauacaauugaaaauagcaccgcuaacgugaguuuagccgcaaucgccaaccaagcugucgugcuaaugggccuggauaaaggauggccuauauccaagauggaccucggcgucccccuucuggcauuggggugcuacagccaggugaauccgcugacucucacggccgcgguucugcuuuuagugacacacuaugcuauuaucggaccaggccugcaggccaaagcaaccagagaggcccagaagaggacugcugccgguaucaugaaaaacccuaccguagaugggauuaugacaaucgaccucgaucccgugauauacgacucuaaguucgagaagcaauugggacaggucaugcugcuaguucugugugcagugcagcuccuucugaugcggacuucaugggcuuugugcgaagcccugacccucgcgacaggcccaauuacgacccugugggaggguucccccggcaaauuuuggaauacuacaaucgccgucaguauggcaaacauuuuccgagggagcuauuuagcuggagccggccuugcauuuucgaucaugaagucuguggggaccggaagacgcggcacugguucccagggggaaacacugggagagaaauggaagaaaaagcucaaucaacuaagcaggaaggaauucgaucuguacaaaaagucaggcauaaccgagguagaccggacggaggcuaaagaagguuugaagcguggcgagaccacacaucacgccgugaguagagggucugccaaacugcagugguuuguugaaaggaacauggugaucccugagggacgcgucauugaucucggcugugggcggggaggcugguccuauuacugcgcgggucuuaagaaagugacugaaguccgaggguauaccaagggaggcccgggccaugaggagcccgugccaaugagcacauacggguggaauaucguuaagcugaugucaggaaaagacguauucuacuugccucccgaaaagugugauacucugcucugcgacauuggugagaguagcccuuccccaaccguggaagagucuagaacaaucagggucuuaaaaaugguggagcccuggcugaagaacaaucaguucuguauuaaaguucuuaacccuuauaugccaaccgugaucgaacaccuggagcgccuacagcggaaguacggcgggaugcucgucagaaauccccugagccguaacuccacucacgaaauguauuggauaucaaauggaacgggcaacauugugucuaguguaaauauggugucgagguugcugcucaaccgguuuacaaugacccaucgccgaccgacuaucgagaaggauguugaccuuggugcugggaccagacacgucaacgcagaaccugagacaccaaauauggacgugaucggagagaggauuaaacggauaaaggaagagcauagcuccacguggcacuacgaugacgaaaaccccuauaaaaccugggccuaccacggcucuuaugaggugaaggcuacuggcucagccagcuccaugaucaauggggucguuaaacuguuaacaaagccuugggaugugguaccaauggugacccaaauggcaaugacugacacaacccccuucggacagcagcgcgucuuuaaggaaaaaguggauacaagaacuccgaggccuaugcccgguacccgaaagguuauggagauuacggccgaguggcuguggcggaccuugggccguaacaaaaagccaagacucugcacacgcgaagaguucacuaaaaaggugaggaccaaugcugcgaugggggccgucuuuacagaagagaaccaaugggacagugcacgggcugccguggaagaugaggaguucuggaagcugguagacagagaacgcgagcuacauaaacuuggaaaguguggcucuugcguuuacaauaugauggguaaaagggaaaagaaacugggggaguuuggaaaggcaaaaggcagccgagccaucugguacauguggcucggcgcucgguuccuggaguuugaagccuugggguuccugaacgaggaucacugguuuucaagagaaaauuccuauaguggaguggagggugaaggccuccauaagcuuggguacauucugagggacaucagcaagauaccuggaggcgcgauguaugcagaugacacugccgguugggacacccgcaucacggaggaugacuuacacaacgaggaaaaaauuacacagcagauggaucccgagcaucgucagcuggcuaaugccaucuucaaguugaccuaccaaaacaaagucgugaaggugcagcggccaacucccaaagggacagucauggacauuaucucuagaaaggaucagaggggauccggccagguuggcaccuaugggcucaauacuuuuaccaacauggaagcacaacuggugcgccagauggagggagaagguguacuaucaaaggcugaccuugagaauccucaccugcucgagaaaaagauaacacaguggcuggaaaacaaaggcguggagcgauugaagcggauggccauuagcggggaugacugcgucgugaaaccaaucgaugacagauucgcuaacgccuuacuggcacucaaugauaugggaaagguuaggaaggacaucccgcaguggcaacccucgaaaggcuggcacgauuggcagcaggugccuuucuguucucaucacuuucaugaacuuauuaugaaggacggucgcaaacuggucgugccaugcagaccccaggacgagcuaauagggcgggcgaggaucagucaaggagccggcuggucccugaaggaaacggcuugucucggcaaagccuacgcacagauguggagcuugauguauuuccaccgucgagaucugcgccuugcuucaaacgccauuugcuccgcaguaccuguucacugggugccaaccucuagaacuacauggagcauccaugcccaccaucaguggaugaccacugaggacaugcuggcggucuggaaucggguguggauugaggauaaccccuggauggaagacaagacaccuguuaccacgugggaggaugugccguaccucgggaagagggaagaccaaugguguggaaguuuaaucggucugacaucccgcgcuaccugggcccagaauauauugacugcaauccagcaggucagaagccugauuggcgaugaggaguuucucgacuacaugccaucuaugaaacgguucaggaaggaagaggaaucagagggggccaucugguga

SEQ ID NO: 15231 - RNA, 9873 nt, Artificial Sequence
  derived and/or modified CDS sequence (opt3) from DENV-3__FJ639721__SS-prME
accagccugugccucaugaugaugcuucccgccacacuggcuuuccacuugacuuccagggacggcgaaccuaggaugaucguggggaagaacgaacggggaaagucuuuacuguuuaagacggcaaccgguauuaauauguguacacuaauagccauggaucucggcgaaaugugcgacgauacugucaccuacaaauguccacugaucguugaaguggaaccggaagacauugauugcugguguaaccuuacaucaaccuggguaacuuaugggacaugcaaucaggcgggagagcaccgccgagacaagcguaguguggcucuggcaccccacgucggcauggguuuggauaccagaacgcagacuuggaugagcgcagagggggccuggagacagguggaaaaaguugagaccugggcucuccggcauccuggauucacaauccuggcacuguuucucgcccacuacauuggcacuuccuuaauccagaagguggucauauucauccugcuuauguuggugaccccaucuaugacaaugcgcuguguaggcguugggaacagagacuuuguggaaggacugucgggugcuaccugggucgauguggugcuagagcauggcgggugcgucacgacuauggccaagaauaaacccacacucgacauugagcugcagaagaccgaagcgacucagcuugcaacacugaggaaauuguguaucgagggaaagauuaccaacaucacgaccgauucacggugcccuacacagggcgaagccauacucccagaggaacaggaccagaauuauguuuguaaacacacuuacguggaucgcgguugggggaacggaugcggccuguucggcaaggggagcuuaguaaccugcgcuaaguuucaaugucuggagcccauugagggaaaagugguccaguaugaaaaucucaaguacacagugaucauuacuguucacaccggugaccagcaucaggugggcaacgacacacaaggggucaccguggagaucacuccucaggccaguacgguagaagcaguucuuccagaguauggaacacugggcuuggaaugcuccccgcgaaccggucuagauuucaaugagaugauccugcucacuaugaaaaacaaggcuuggauggugcacagacagugguuuuucgaccugccccuuccuuggaccucuggggccacaaccgagacuccaacauggaauaggaaagaacuguuggucacguuuaagaacgcgcaugccaaaaagcaagagguggucgugcucggcagccaggaaggagcaaugcacaccgcucugacuggcgccacagagauucaaaauuccgggggaaccucaauauucgcuggucacuuaaagugucggcugaaaauggauaagcuagaacucaaaggcaugaguuacgccaugugccugaacacauuuguucuuaagaaagaggugagcgagacucagcaugggaccaucuugauuaagguagaauacaagggagaggacgcacccuguaaaaucccuuucucuacggaagauggccaagguaaggcccacaacgggcgucugauaaccgcuaauccagucgugaccaagaaggaggagcccguuaacauugaagcggagccgccuuucggcgaauccaauaucgugaucggaauuggcgacaaagcacucaagaucaacugguauaagaaagggucaagcauuggaaagauguuugaggccacugcucgcggugccagaaggauggcaauacugggcgauaccgccugggacuucgggagugucggaggcgugcuuaauucucuggguaaaaugguacaucagaucuuuggguccgcuuacacagccuuguucagcggcgugucguggauuaugaagaucggaaucggcguucuccugacuuggauuggguuaaacucuaaaaauaccuccaugucauuuaguugcauagucaucggaauuaucacgcuguaucuaggcgcaguggugcaggcggauauggguugugucauuaacuggaaggggaaggaacucaaaugcggaagcggcaucuucguuacaaaugaggugcacaccuggacugagcaguacaaguuucaagcugacucccccaaacggcuggccacagcaauagccggugcuugggaaaacggcgugugugggauccgaucuaccacucgcauggagaaucuuuuguggaagcagauugccaacgaacugaauuauauccucugggagaacaauauuaaacugaccguagucgugggagauaucauaggcguuuuagaacaggggaagagaacacugacgccacagccuauggagcuuaaauacagcuggaagaccuggggaaaggcaaaaauugugacugcugagacacaaaacucaaguuucaucauugacggccccaacaccccagaaugccccuccgccagcagggcguggaaugucugggagguggaagacuaugguuuugggguuuucacaacuaacaucugguugaagcuccgggagguguacacccagucuugugaucaucgccugaugucagccgcuauaaaagacgaaagagcaguacacgccgauaugggauacuggaucgagagucagaagaauggcagcuggaaacuagagaaggcuuccuuuauugaagucaagacgugcacauggccuaaaucucacacccuguggucgaacggugugcucgagagcgacaugaucauuccaaagucccuggccggcccgaucucacagcauaaucacaggcccggguaucauacucaaaccgcaggaccuuggcaccuuggcaaauuggaacuggauuucaacuacugcgaggggacaacuguggucauaaccgagaauuguggaacacguggcccaaguuuacggacgaccacuguuucugguaagcucauucacgaauggugcugucgaagcugcacacugcccccucuuagauauaugggggaggacggauguugguacggcauggaaaucaggccaaucaacgagaaagaagagaauauggugaagucccugguaucagcggguagcggcaagguggauaacuuuaccaugggggucuugugccucgccauucuguucgaggaagugaugcgcggaaaauucggcaagaaacauaugaucgcugggguucuauuuacuuucgugcugcuccugucuggacagauuacauggcgggacauggcccacacccuuauaaugaucggcuccaaugcaagugauagaauggguaugggggucacguauuuggcucugauugccacuuuuaagauccagcccuucuuaacccucggauuuuuccugaggaaacuuacaagccgcgagaaccugcuacucggcgugggccuggcaauggccaccacuuugcaacugccggaagacauugagcagauggcuaaugggaucgcguuaggacucaugacacugaaacuuauaacccaguuugaaacauaccagcuguggacugccuugguuucucucaccuguuccaacacgaucuucacacugaccguggcauggcgaacugcuacccuaauucuggccggugucucacuucucccucugugccaaaguagcucgaugcggaagacagauugguugccaaugacuguagccgcuaugggcgugcccccucugcccuuauuuaucuucucccucaaagacgcaccaaagcguagaucuuggccucugaaugaggggguuauggccgugggacuugucagcauucuggcgucaaguuugcucaggaacgaugugcccauggcuggcccacugguagccggugggcuacugaucgcauguuaugugauaaccggaacguccgccgaccuuacagucgagaaagcugcagacguuaccugggaagaggaagccgagcagacuggcgugucucauaaccucaugauuacaguggaugacgauggcaccaugcgcaucaaggacgaugaaacugagaauauccugacagucuuguuaaaaaccgcgcugcucauugugagcgggauauuuccguacuccaucccugcuacgcugcuuguuuggcacacuuggcagaagcagacccaacggucaggaguacugugggacgugcccagcccacccgagacacagaaagccgaauuggaggaaggugucuacagaauuaagcagcagggcaucuucgggaagacccaagugggaguuggcgugcagaaagagggugucuuucauacaauguggcacgugacucgaggggccguacuaacccacaacggaaagaggcuggagccuaauugggccagugucaaaaaggaucucauuucuuauggcggcggguggcgccuguccacgcaguggcaaaaaggagaagaggugcagguuaucgcuguggaaccagguaagaaccccaagaauuuccagacaaugccuggcauauuccagacuaccacaggggagaucggagccauugcacuugacuuuaaaccgggcaccagcgguucgccaaucauuaaccgggaagggaaggucgugggauuauacggcaauggcguugugacuaaaaacgggggauaugucucagguaucgcucaaaccaaugccgagcccgauggcccuacaccagagcuggaagaggaaauguucaagaaaagaaaccucacgauaauggacuugcaucccgggucuggaaagacuaggaaguaccugccugcgauugugcgugaggccaucaaacgccggcucagaacccugauccuugcaccgacaaggguaguggcugccgaaauggaggaggcucugaagggcuugcccauucgauaucagaccacugcaacaaaaagugaacacaccggucgggagaucguugaucuaaugugccaugccacguuuacuaugcgccugcucuccccagucagagugccuaauuacaacuuaauaauuauggacgaagcccacuucacagaucccgcuagcaucgcggcaaggggguauauuucuacccgggugggaaugggcgaggccgcugccaucuuuaugaccgcaacuccaccuggcacagccgaggcuuucccccagagcaaugcgccaauacaggacgaggagcgagacauuccggaaagauccuggaacucagggaaugaguggaucaccgauuuugucggaaagacaguaugguucgugccuaguaucaaagccgguaacgacauugcaaacugucugcgcaagaauggcaagaaaguuauccaacuuagcaggaagacuuuugauacggaauaccagaaaacccgucugaacgacugggauuucguggucacaacugacauuucugagaugggggcuaauuuuaaggccgaucgggugauagaccccagaaggugccucaaaccaguuaucuugaccgauggacccgagcgcgugauucuggcaggcccuaugccagucacagccgcuuccgccgcgcagcgaagaggucggguggggaggaacccccagaaggaaaaugaccaauacaucuucaccggccagccucucaacaaugaugaggaccaugcacacuggacugaagccaagaugcugcuugacaacaucaauacgccggagggaauuauaccagcucuauucgaacccgagcgcgagaaaucagccgcuaucgauggcgaauaucgucugaagggggagaguagaaaaaccuuuguagaauugaugcggaggggagacuuaccuguguggcuggcacacaagguugccagcgaggguauuaaauacacagaucgcaaguggugcuucgacggcgaacgaaacaaucagauccucgaggagaacauggaugucgaaauuuggacuaaagagggggaaagaaagaagcugcggcccagguggcuugacgcucgcaccuauuccgauccacuggcccucaaagaguuuaaggacuucgcagcgggaagaaaaucuaucgccuuggaucuggugacagaaauaggcagggugccuucgcaucuagcucaccggacccguaaugcccuggacaaccucgucaugcuucauacuagcgagcacggugggcgcgcauaccgacacgcuguugaggaacugcccgagacaauggaaacguuauugcugcucggccugaugauccuucugaccggaggcgccaugcucuuuuuggugucagggaagggaauugguaaaacuacaaucggccugauuuguguaaucguguccagugggauguuauggauggcagauauaccacuacaguggauugccucugcuaucguccuggaguucuuuaugauggugcuccuuauuccugagccggaaaagcaaagaacaccccaggacaaucagcuggcguauguugugaucggaauauugacccuggccgcaaucgucgcugccaacgagaugggccuccuggaaacaacuaagagggaucuugguaugagcaaagagccagggguaguguccccuacgucauaccucgacguugaccugcaucccgccucugcauggaccuuguaugcuguggccacaacugucauuaccccaaugcugcggcacacaaucgaaaauagcaccgcgaacgugaguuuagcugccauugcaaaccaagccgucgugcuaaugggccuggauaagggauggccuaucuccaaaauggaccucggcguuccccuucuggcuuuggggugcuacagccaggugaauccgcugacucucacggcagccguacugcuuuuagugacacauuacgcgauaauuggaccaggccugcaggcuaaggccacccgcgaggcacagaaaagaacugccgcugguaucaugaagaacccuaccgucgaugggaucaugacaauugaccucgaucccguuaucuaugacucuaaguucgagaaacaauugggacaggugaugcugcuaguccugugugccgugcagcuccuucugaugaggacuucaugggcauugugcgaagcucugacccucgccacaggcccaauaacgacccugugggaggguucccccggcaaguuuuggaauacuacaauugcgguaaguauggccaacaucuuccgggggagcuacuuagcaggagcuggccuugccuuuucgauuaugaaaucuguggggaccggacgaagaggcacugguucccagggggaaacacugggagagaaguggaaaaagaagcucaaucaacuaagccgcaaagaguucgaucuguauaagaaaucaggcaucaccgagguugacaggacggaggcaaaggaagguuugaaacggggcgagaccacacaccaugcugugagucgugggucugccaagcugcagugguuugucgaaagaaacauggugauaccugagggaagggucaucgaucucggcugugggcgcggaggcugguccuacuauugcgccggucuuaaaaaggugacugaaguucggggguacaccaagggaggcccgggccacgaggagcccguaccaaugagcacauauggguggaauauugugaaacugaugucaggaaaggacgucuucuacuugccucccgaaaaaugugauacucugcucugcgacaucggugagaguagcccuuccccaaccguggaagagucucgaacaauuagaguuuuaaagaugguggagcccuggcugaaaaacaaucaguucuguaucaagguccuuaacccuuacaugccaaccgugauugaacaccuggagaggcuacagcgcaaguauggcgggaugcucguacggaauccccugagcagaaacuccacucaugaaauguacuggaucucaaauggaacgggcaacauagugucuaguguuaauauggucucgcguuugcugcucaacagguuuacaaugacccaccggcgcccgacuauugagaaagauguggaccuuggugcggggacccgacaugugaacgcugaaccugagacaccaaauauggacgucaucggagagagaaucaagaggauuaaagaagaacacagcuccacguggcacuaugaugacgaaaaccccuacaagaccugggcauaucauggcucuuacgagguuaaagccacuggcucagcuagcuccaugauaaauggggugguaaagcuguuaacaaagccuugggauguggucccaauggugacccaaauggccaugacugacacaacccccuucggacagcagcggguuuuuaaagaaaagguggauacacgcacuccgagaccuaugcccgguaccaggaaagucauggagaucacggcagaguggcuguggcgaaccuugggccggaacaagaaaccacgucucugcacaagagaagaguucacuaagaaggugcgcaccaaugccgcuaugggggcgguauuuacagaagagaaccaaugggacagugccagggcagcuguugaagaugaggaguucuggaaacugguggaccgggaaagagagcuacacaaacuuggaaaauguggcucuugcgucuauaauaugauggguaagcgcgagaagaagcugggggaguuuggaaaagccaagggcagcagggcaauuugguacauguggcucggcgcccgauuccuggaguuugaggcuuugggguuccugaacgaggaucauugguuuucacgggaaaauuccuacaguggaguggagggugaaggccuccacaaacuuggguauauccugagagacauuagcaaaaucccuggaggcgccauguacgcggaugacacugcagguugggacaccaggauaacggaggaugacuuacauaacgaggaaaagaucacacagcagauggaucccgagcaccgccagcuggccaaugcuauuuucaaauugaccuaucaaaacaagguggucaaaguucagcguccaacucccaaggggacagugauggacaucauuucucggaaggaucagagaggauccggccagguaggcaccuacgggcucaauacuuuuaccaacauggaagcccaacuggugaggcagauggagggagaagguguccuaucaaaaacagaccuugagaauccucaucugcucgagaagaaaaucacgcaguggcuggaaaacaagggcguggagcgcuugaaacgaauggcaauaagcggggaugacugcguugugaagccaauugaugaccgguucgcuaacgccuuacuggcucucaaugauaugggaaaggucagaaaagacaucccgcaguggcaacccucgaagggcuggcaugauuggcaacaggugccuuucuguucucaccauuuucacgaacuuaucaugaaagacgguaggaagcugguaguuccaugccgcccccaggacgagcuaauugggagagcccggauaagucaaggagcaggcuggucccugaaagaaaccgcgugucucggcaaggccuaugcucagauguggagcuugauguacuuccacaggcgugaucugcgacuugccucaaacgcaaucugcuccgcugugccuguccauugggugccaacuucucgcacaaccuggagcauucacgcccaucaccaguggaugacuacagaggacaugcugaccguuuggaauagaguguggaucgaggauaaccccuggauggaagacaagacgccugucacaaccugggaggaugugccguaucucgggaaacgggaagaccaaugguguggaaguuuaauuggucugacuuccagggcaaccugggcccagaauaucuugacagcgauacagcagguacgcagccugaucggcgaugaggaguuucucgacuacaugccaucuaugaagagauuccggaaagaagaggaaucagagggggcuauuugguga

SEQ ID NO: 15232 - RNA, 9873 nt, Artificial Sequence
  derived and/or modified CDS sequence (opt3) from DENV-3__FJ639722__SS-prME
accagccugugccucaugaugaugcuucccgccacacuggcuuuccacuugacuuccagagacggcgagccuaggaugaucguggggaagaacgaacggggaaaaucuuuacuguuuaagacggcaaccgguauuaauauguguacacuaauagccauggaucucggcgagaugugcgacgauacugucaccuacaaauguccacugaucgcggaaguugagccggaagacauugauugcugguguaaccuuacaucaaccugggugacuuaugggacaugcaaucaggcuggagagcaucgccgagacaagcguaguguagcccuggcaccccacgugggcauggguuuggauaccagaacgcaaacuuggaugagcgccgagggggcuuggaggcaggucgaaaaaguggagaccugggcacuccggcauccuggauucacaauccuggcccuguuucucgcucacuacauuggcacuuccuuaauccagaagguugugauauucauccugcuuauguuggucaccccaucuaugacaaugcgcugugugggcguagggaacagagacuuuguugaaggacugucgggugccaccuggguggaugucgugcuagagcauggcgggugcgugacgacuauggcgaagaauaaacccacacucgacauugagcugcagaagaccgaagcaacucaacuugccacacugaggaaauuguguaucgagggaaagauuaccaacaucacgaccgauucacggugcccuacacagggcgaagcuauacucccagaggaacaggaccagaauuaugucuguaaacacacuuacguugaucgcgguugggggaacggaugcggccuguucggcaaggggagcuuagugaccugcgccaaguuucaaugucuggagcccauugagggaaaaguagugcaguaugaaaaucucaaguacacagucaucauuacugugcacaccggugaccagcaucagguuggcaacgacacacaaggggugaccgucgagaucacuccucaggcaaguacgguggaagcuguacuuccagaguauggaacacugggcuuggaaugcuccccgcgaaccggucuagauuucaaugagaugauccugcucacuaugaaaaacaaggccuggaugguucacagacagugguuuuucgaccugccccuuccuuggaccucuggggcgacaaccgagacuccaacauggaauaggaaagaacuguuggugacguuuaagaacgcccaugcaaaaaagcaagaggucgugguccucggcagccaggaaggagcuaugcacaccgcccugacuggcgcuacagagauucagaauuccgggggaaccucaauauucgccggucacuuaaagugucggcugaaaauggauaagcuagaacucaaaggcaugaguuacgcaaugugccugaacacauuugugcuuaagaaagagguuagcgagacucagcaugggaccaucuugauuaagguggaauacaagggagaggacgcccccuguaaaaucccuuucucuacggaagauggccaagguaaggcucacaacgggcgucugauaaccgcgaauccaguagucacaaaaaaggaggagcccgugaacauugaagcagagccgccuuucggcgaauccaauaucguuaucggaauuggcgagaaagcccucaagaucaacugguauaagaaagggucaagcauuggaaagauguuugaagcuacugcccgcggugcaagaaggauggccauacugggcgacaccgcuugggauuucgggagugugggaggcguccuuaauucucuggguaaaauggugcaucagaucuuuggguccgccuacacagcauuguucagcggcguaucguggauuaugaagaucggaaucggcgugcuccugacuuggauuggguuaaacucuaaaaauaccuccaugucauuuaguugcauaguuaucggaauuaucacgcuguaucuaggcgcggucgugcaggcugacauggguugugugauuaacuggaaggggaaggagcucaaaugcggaagcggcaucuucgucacaaaugagguucacaccuggacugaacaguacaaguuucaagccgauucccccaaacggcuggcaacagccauagcuggugccugggagaacggcgugugugggauccgaucuaccacucgcauggaaaaucuuuuguggaagcagauugcaaacgagcugaauuauauccucugggaaaacaauauuaaacugaccgugguagucggagacaucauaggcguguuagagcaggggaagagaacacugacgccacagccuauggagcuuaaauacagcuggaagaccuggggaaaggcuaaaauuguuacugccgaaacacaaaacucaaguuucaucauugauggccccaacaccccagagugccccuccgcgagcagggccuggaaugugugggaagucgaggacuaugguuuugggguguucacaacuaacaucugguugaagcuccgggaaguuuacacccagucuugugaccaucgccugaugucagcugcaauaaaagaugagagagccgugcacgcugacaugggauacuggaucgagagucagaagaauggcagcuggaaacuagaaaaggccuccuuuauugagguaaagacgugcacauggccuaaaucucacacccuguggucgaacgguguccucgaaagcgauaugaucauuccaaagucccuggcaggcccgaucucacagcauaaucacaggcccggguaucauacucaaaccgcgggaccuuggcaccuuggcaaauuggagcuggacuucaacuacugcgaggggacaacuguggugauaaccgaaaauuguggaacacguggcccaaguuuacggacgaccacugucucugguaagcucauucacgaguggugcugucgaagcugcacacugcccccucuuagauauaugggggaagauggauguugguacggcauggagaucaggccaaucaacgaaaaagaggagaauaugguuaagucccuggugucagccgguagcggcaagguagacaacuuuaccauggggguguugugccucgcuauucuguucgaagaggucaugcgcggaaaauucggcaagaaacauaugaucgccggggugcuauuuacuuucguucugcuccugucuggacagauuacauggcgggauauggcacacacccuuauaaugaucggcuccaaugcuagugacagaauggguaugggggugacguauuuggcccugauugcaacuuuuaagauccagcccuucuuagcccucggauuuuuccugaggaaacuuaccagccgcgaaaaccugcuacucggcgucggccuggcuauggcgacaaccuugcaacugccggaggauauugaacagauggccaaugggaucgcauuaggacucaugacucugaagcuuauaacacaguuugagaccuaccagcuguggacagcuuuggugucucucacuuguuccaacaccaucuucacgcugacaguugccuggcgaaccgccacucuaauucuggcuggugugucacuucucccucugugccaaaguagcucgaugcggaagaccgacugguugccaaugacagucgcagccaugggcguacccccucugcccuuauuuaucuucucccucaaagaugcgccaaagcguagaucuuggccucugaaugagggggugauggcuguuggacuugugagcauucuggccucaaguuugcucaggaacgacguccccauggcaggcccacugguggccggugggcuacugaucgcuuguuauguaauaacuggaaccuccgcagaucuuacgguggaaaaagccgcggacgucacaugggaggaagaggcugaacagaccggcguuucucauaaccucaugauuacuguggacgaugacggcacaaugcgcaucaaggaugacgagaccgagaauauccugacuguguuguuaaaaacagcccugcucauugucagcgggauauuuccguacuccaucccugcaacccugcuuguguggcacacguggcagaagcagacucaacggucaggaguucugugggauguacccagcccacccgaaacccagaaagccgaguuggaagaggguguguacagaauuaagcagcagggcaucuucgggaagacacaagucggagugggcguucagaaagaggguguguuucauaccauguggcacgucacaaggggggcugugcuaacucacaacggaaagcgacuggaaccuaauugggccaguguaaaaaaggaccucauuucuuauggcggcggguggcgccuguccacccaguggcaaaaaggagaggaaguccaggugaucgcaguugagccagguaagaaccccaagaauuuccagacgaugccuggcauauuccagacaacuaccggggaaaucggagcuauugcccuugauuuuaaaccgggcacaagcgguucgccaaucauuaaccgggaggggaagguggucggauuauacggcaauggcgugguuaccaaaaacgggggauaugugucagguaucgcgcaaacuaaugccgagcccgacggcccuaccccagaacuggaggaagagauguucaagaaaagaaaccucacaauaauggauuugcaucccgggucuggaaagacgaggaaguaccugccugcaauuguccgugaagcuaucaaacgccggcucagaacucugauccuugccccgaccagggugguagcugcagagauggaggaagcccugaagggcuugcccauucgauaucagacaaccgccacuaaaagugagcacacaggucgggaaaucguggaccuaaugugccaugcuaccuuuacgaugcgccugcucuccccaguuagagucccuaauuacaacuuaauaauuauggaugaggcgcacuucacugaccccgcaagcaucgccgcuaggggguauauuucuacacgggugggaaugggcgaagccgcagccaucuuuaugaccgcuaccccaccuggcacugcggaggccuucccccagagcaaugcaccaauacaggaugaggaacgagacauuccggagagauccuggaacucagggaaugaauggaucacagacuuugugggaaagaccgucugguucguaccuaguaucaaagcugguaacgauauugccaacugucugcgcaagaauggcaagaaagugauccaacuuagcaggaagacauuugacacugaguaccagaaaacgcgucugaacgauugggacuucguugugaccacagauauuucugagaugggggcaaauuuuaaggccgaccgggucauagaucccagaaggugccucaaaccagugaucuugacugacggacccgaacgcguuauucuggcuggcccuaugccagugaccgccgcguccgcagcccagcgaagaggucgggucgggaggaacccccagaaggagaaugaucaauacaucuucacaggccagccucucaacaaugacgaagaucaugcucacuggaccgaggccaagaugcugcuugacaacaucaauacuccggaaggaauuauaccagcucuauucgagcccgagcgcgaaaaaucagcagccaucgacggcgaguaucgucugaagggggaaaguagaaaaacguuuguggaguugaugcggaggggagauuuaccuguauggcuggcucacaagguggccagcgaagguauuaaauacaccgaccgcaaguggugcuucgauggcgagcgaaacaaucagauccucgaggaaaacauggacguugagauuuggacaaaagaaggggagagaaagaagcugcggcccagguggcuugaugcacgcacuuauuccgacccacuggcgcucaaagaauuuaaggauuucgccgcuggaagaaaaucuaucgccuuggaccuggucaccgagauaggcagggugccuucgcaucuagcacaccggacacguaaugcucuggauaaccucgugaugcuucauaccagcgagcacggugggcgcgccuaccgacacgcagucgaagagcugcccgaaacuauggagacauuauugcugcucggccugaugauccuucugacgggaggcgccaugcucuuuuugguuucagggaagggaauugguaaaaccacuaucggccugauuugugugaucguauccagugggauguuauggauggcugacauaccacuacaguggauugcgucugccaucgugcuggaguucuuuaugaugguccuccuuauuccugaaccggagaagcaaagaacaccccaggauaaucagcuggcauaugugguuaucggaauauugacccuggcugccaucguggccgcaaacgaaaugggccuccuggagaccacaaagagggaccuugguaugagcaaagaaccaggggucguauccccuacuucauaccucgauguggaccugcaucccgcuucugccuggacguuguaugcgguugcuaccacagugauuacuccaaugcugcggcacaccaucgagaauagcacagccaacgucaguuuagcagccauugcuaaccaagcagugguccuaaugggccuggacaagggauggccuaucuccaaaauggaucucggcgugccccuucuggccuuggggugcuacagccagguuaauccgcugacccucacugcggcugugcugcuuuuaguaacgcauuacgccauaauuggaccaggccugcaggcaaaggccacacgcgaggcucagaaaagaaccgccgcagguaucaugaagaacccuacuguggacgggaucaugaccauugaucucgaccccgucaucuaugauucuaaguucgaaaaacaauugggacagguuaugcugcuagugcugugugcuguccagcuccuucugaugaggacaucaugggccuugugcgaggcgcugacucucgccaccggcccaauaacaacgcugugggaagguucccccggcaaguuuuggaauaccacuauugcagugaguauggcuaacaucuuccgggggagcuacuuagccggagcaggccuugcuuuuucgauuaugaaaucuguagggacaggacgaagaggcaccgguucccagggggagacucugggagaaaaguggaaaaagaagcucaaucaacuaagccgcaaagaguucgaccuguauaagaaaucaggcaucacagagguggauaggaccgaagccaaggaggguuugaaacggggcgaaacgacccaccaugccguuagucgugggucugcgaagcugcagugguuuguggagagaaacauggucauaccugaaggaagggugaucgaccucggcugugggcgcggaggcugguccuacuauugcgcuggucuuaaaaaggucacagaggugcggggguacacuaagggaggcccgggccacgaggaacccguuccaaugagcaccuauggguggaauauuguaaaacugaugucaggaaaggauguguucuacuugccucccgagaaaugugacacacugcucugcgauaucggugaaaguagcccuuccccaacugucgaggagucucgaaccauuagaguguuaaagaugguugaacccuggcugaaaaacaaucaguucuguaucaaggugcuuaacccuuacaugccaacagucauugagcaccuggaaaggcuacagcgcaaguauggcgggaugcucgugcggaauccccugagcagaaacuccacccaugagauguacuggaucucaaauggaacuggcaacauaguaucuagugugaauaugguuucgcguuugcugcucaacagguuuacgaugacacaccggcgcccgaccauugaaaaagacgucgaucuuggugcagggacucgacaugugaacgccgagccugagaccccaaauauggacgugaucggagaaagaaucaagaggauuaaagaggaacacagcuccacauggcacuaugacgaugagaaccccuacaagacgugggcuuaucauggcucuuacgaagucaaagccaccggcucagcaagcuccaugauaaaugggguugugaagcuguuaacuaagccuugggacguagugccaauggucacacaaauggccaugaccgauacuacacccuucggacagcagcggguguuuaaagagaagguugacacccgcacaccgagaccuaugcccgguacuaggaaagugauggagaucaccgcugaauggcuguggcgaacguugggccggaacaagaaaccacgucucugcaccagagaggaauucacaaagaagguccgcacuaaugcggccaugggggcaguguuuaccgaggaaaaccaaugggauagugcuagggccgcaguagaggacgaggaauucuggaaacugguugaucgggagagagaacuacacaagcuuggaaaauguggcucuugcguguauaauaugauggguaagcgcgagaaaaagcugggggaguuuggaaaagccaagggcagcagggcuauuugguacauguggcucggcgcccgauuccuggaauuugaggcguugggguuccugaacgaagaccauugguuuucacgggagaauuccuacaguggagucgaaggugagggccuccacaagcuuggguauauccugagagauauuagcaaaaucccuggaggcgcaauguacgccgacgauacagcugguugggacacuaggauaaccgaggacgauuuacauaacgaagagaagaucacgcagcagauggaccccgaacaccgccagcuggccaaugcaauuuucaaauugacauaucaaaacaagguggugaaaguccagcguccaacccccaaggggacuguuauggauaucauuucucggaaggaccagagaggauccggccaggugggcacauacgggcucaauaccuuuacuaacauggaggcucaacugguaaggcagauggaaggagagggugugcuaucaaaaaccgaucuugagaauccucaccugcucgaaaagaaaaucacacaguggcuggagaacaagggcgucgaacgcuugaaacgaauggccauaagcggggacgauugcgugguuaagccaauugacgaucgguucgcuaacgccuuacuggcacucaaugacaugggaaaggugagaaaagauaucccgcaguggcaacccucgaagggcuggcaugacuggcagcaggucccuuucuguucucaccauuuucacgagcuuaucaugaaagaugguaggaagcuggugguaccaugccgcccccaggacgaacuaauugggagagcgcggauaagucaaggagccggcuggucccugaaagagacggcuugucucggcaaggccuaugcacagauguggagcuugauguacuuccacaggcgugaccugcgacuugcuucaaacgccaucugcuccgcaguuccugugcauugggucccaaccucucgcacuacauggagcauucacgcccaucaccaguggaugaccacugaggauaugcugacaguguggaauagaguuuggaucgaagacaaccccuggauggaggauaagaccccugugacgacaugggaagacgucccguaucucgggaaacgggaggaucaaugguguggaaguuuaauuggucugaccuccagggcgacuugggcucagaauaucuugaccgccauacagcaggugcgcagccugaucggcgacgaggaauuucucgauuacaugccaucuaugaagagauuccggaaagaggaagagucagaaggggcaauuugguga

SEQ ID NO: 15233 - RNA, 9873 nt, Artificial Sequence
  derived and/or modified CDS sequence (opt3) from DENV-3__FJ639723__SS-prME
accagccugugccucaugaugaugcuucccgccacacuggcuuuccacuugacuuccagagacggcgagccuaggaugaucguggggaagaacgaacggggaaaaucuuuacuguuuaagacggcaaccgguauuaauauguguacacuaauagccauggaucucggcgagaugugcgacgauacugucaccuacaaauguccacugaucgcggaaguugagccggaagacauugauugcugguguaaccuuacaucagcuugggugaccuaugggacuugcaaucaggccggagagcaucgccgagacaagcguaguguagcacuggccccccacgugggcauggguuuggauacaagaacccaaacguggaugagcgcugagggggcauggaggcaggucgaaaaaguggagacuugggcccuccggcauccuggauucaccauccuggcucuguuucucgcccacuacauuggcacauccuuaauccagaagguugugauauucauccugcuuauguuggucacuccaucuaugaccaugcgcugugugggcguagggaacagagacuuuguugaaggacugucgggugcgacauggguggaugucgugcuagagcauggcgggugcgugaccacgauggcaaagaauaaacccacucucgacauugagcugcagaagacagaagccacccaacuugcuacucugaggaaauuguguaucgagggaaagauuacaaacaucaccacggauucacggugcccuacccagggcgaagccauacucccagaggaacaggaccagaauuaugucuguaaacacacauacguugaucgcgguugggggaacggaugcggccuguucggcaaggggagcuuagugacuugcgcaaaguuucaaugucuggagcccauugagggaaaaguagugcaguaugaaaaucucaaguacaccgucaucauuacagugcacacuggugaccagcaucagguuggcaacgacacccaaggggugacagucgagaucaccccucaggcuaguacuguggaagccguacuuccagaguauggaacgcugggcuuggaaugcuccccgcgaacaggucuagauuucaaugagaugauccugcucaccaugaaaaacaaggcguggaugguucacagacagugguuuuucgaccugccccuuccuuggacuucuggggccaccacagagaccccaacuuggaauaggaaagaacuguuggugacauuuaagaacgcacaugcuaaaaagcaagaggucgugguccucggcagccaggaaggagccaugcacacggcucugaccggcgccacugagauucagaauuccgggggaacaucaauauucgcaggucacuuaaagugucggcugaaaauggauaagcuagaacucaaaggcaugaguuacgccaugugccugaacaccuuugugcuucguaaggagguuagcgagacacagcaugggacuaucuugauuaaaguggaauacaagggagaggacgcucccuguaagaucccuuucucuaccgaagauggccaagguaaagcgcacaacgggcgccugauaacggcaaauccaguagucaccaagaaagaggagcccgugaacauugaagccgagccgccuuucggcgaauccaauaucguuaucggaauuggcgacaaggcucucaaaaucaacugguauaagaaggggucaagcauuggaaaaauguuugaggccacagcaagaggugccaggcggauggcuauacugggcgauacugccugggacuucgggagugugggaggcguccuuaauucucuggguaagauggugcaucagaucuuuggguccgcauacaccgcguuguucagcggcguaucguggauuaugaaaaucggaaucggcgugcuccugacauggauuggguuaaacucuaagaauacuuccaugucauuuaguugcauaguuaucggaauuaucacccuguaucuaggcgcugucgugcaggccgauauggguugugugauuaacuggaaagggaaggaacucaagugcggaagcggcaucuucgucacgaaugagguucacacauggaccgagcaguacaaauuucaagcagacucccccaagcgacuggccacugcuauagccggugcaugggaaaacggcgugugugggauccgcucuacaaccagaauggagaaucuuuuguggaaacagauugcuaacgaacugaauuauauccucugggagaacaauauuaagcugacugugguagucggagauaucauaggcguguuagaacaggggaaaaggacccugacaccacagccuauggagcuuaaguacagcuggaaaacguggggaaaggccaagauuguuaccgcggagacucaaaacucaaguuucaucauugacggccccaacacaccagaaugccccuccgccagccgggcuuggaaugugugggaggucgaagacuaugguuuugggguguucaccacaaacaucugguugaaacuccgcgagguuuacacucagucuugugaucauagacugaugucagcagccauaaaggacgaaagggcugugcacgccgauaugggauacuggaucgagagucagaaaaauggcagcuggaagcuagagaaagcauccuuuauugaaguaaagaccugcacguggccuaagucucacacacuguggucgaacgguguccucgagagcgacaugaucauuccaaaaucccuggcgggcccgaucucacagcauaaucaccgucccggguaucauacccaaacugccggaccuuggcaccuuggcaaguuggaacuggauuucaacuacugcgaggggaccacaguggugauaacugagaauuguggaacccggggcccaaguuuacgaacaacgaccgucucugguaaacucauucacgaauggugcuguagaagcugcacucugcccccucuuagguauaugggggaggacggauguugguacggcauggaaauccgcccaacaaacgagaaggaagagaauaugguuaaaucccuggugucagcugguagcggcaagguagauaacuuuaccauggggguguugugccucgccauccuguucgaggaagucaugcggggaaaguucggcaaaaagcauaugauugcaggggugcuauuuacuuucguucugcuccugucuggacagaucacauggagagacauggcucacacccuuauuaugauaggcuccaaugccagugauaggauggguaugggggugacguauuuggcacugaucgccacuuuuaaaauucagcccuucuuagcucucggauuuuuccugcgcaagcuuaccagccgagagaaccugcuacucggcgucggccuggcgauggccacaaccuugcaacugccggaagacaucgagcagauggcaaaugggauugcuuuaggacucaugacucugaaacuuaucacacaguuugaaaccuaccagcuguggacagccuuggugucucucacuuguuccaacaccauauucacgcugacaguugccuggcggaccgcuacucuaauccuggcaggugugucacuucucccucugugccaaaguagcucgaugcguaagaccgauugguugccaaugacagucgccgcgaugggcguacccccucugcccuuauuuauuuucucccucaaggacacuccaaaaagaaggucuuggccucugaaugagggggugauggcuguuggacuugugagcauccuggccucaaguuugcuccgcaacgauguccccauggcaggcccacugguggccggugggcuacugauugcuuguuauguaaucaccggaacguccgcagaccuuacaguggagaaggccgcggacgucaccugggaagaggaagcugagcagacuggcguuucucauaaccucaugauaacaguggaugacgauggcaccaugcggauuaaagacgaugaaacugagaauauccugacaguguuguuaaagaccgcccugcucaucgucagcgggauuuuuccguacuccauaccugcaacgcugcuuguguggcacacuuggcagaaacagacccaaagaucaggaguucugugggacguacccagcccacccgagacacagaaggccgaauuggaggaagguguguacaggaucaaacagcagggcauuuucgggaagacccaagucggagugggcguucagaaggaggguguguuucauacaauguggcacgucacucgaggggcugugcuaacccacaacggaaaacgccuggagccuaauugggccaguguaaagaaagaucucaucucuuauggcggcggguggcggcuguccacgcaguggcaaaagggagaagagguccaggugauugcaguugaaccagguaaaaaccccaagaauuuccagacaaugccuggcaucuuccagacuaccacaggggagauaggagcuaucgcccuugacuuuaagccgggcaccagcgguucgccaauuaucaacagagaagggaaaguggucggauuauacggcaauggcgugguuacuaagaacgggggauaugugucagguauugcgcaaaccaaugccgagcccgauggcccuacaccagagcuggaagaggaaauguucaaaaagaggaaccucacgaucauggacuugcaucccgggucuggaaaaacucguaaguaccugccugcaauaguccgcgaggcuauuaagcggagacucaggacccugauccuugccccgacacgagugguagcugcagaaauggaggaggcccugaaaggcuugcccauccgguaucagaccacugccacaaagagugaacacaccggucgcgagauuguggaucuaaugugccaugcuacguuuacuaugagacugcucuccccaguuagggucccuaauuacaacuuaaucauaauggacgaagcgcacuucacagaucccgcaagcauugccgcucggggguauaucucuacccgagugggaaugggcgaggccgcagccauuuuuaugaccgcuacuccaccuggcacagcggaagccuucccccagagcaaugcaccaauccaggacgaggagagagacauaccggaacgcuccuggaacucagggaaugaguggauuaccgauuuugugggaaaaacagucugguucguaccuaguaucaaggcugguaacgacaucgccaacugucugaggaaaaauggcaagaaggugauucaacuuagccguaaaacuuuugauacggaauaccagaagacccggcugaacgacugggauuucguugugacaacugacaucucugagaugggggcaaauuuuaaagccgauagagucauugaccccaggcgcugccucaagccagugauauugaccgauggacccgagcgaguuauccuggcuggcccuaugccagugacagccgcguccgcagcccagagacgggguagggucgggcgcaacccccagaaagaaaaugaccaauacauuuucaccggccagccucucaacaaugaugaggaccaugcucacuggacugaagccaagaugcugcuugacaacaucaauacgccggagggaaucauuccagcucuauucgaacccgagcgugagaagucagcagccauagauggcgaauauagacugaaaggggagagucggaagaccuuuguggaauugaugaggcgcggagacuuaccuguauggcuggcuuacaaaguggccagcgaggguaucaaguauacagaucgaaaauggugcuucgacggcgaaagaaacaaucagauucucgaggagaacauggauguugaaaucuggacuaaggagggggaacggaaaaagcugaggccccgcuggcuugacgcaagaaccuacuccgauccacuggcgcucaaggaguuuaaagacuucgccgcuggaaggaagucuauugccuuggaucuggucacagaaaucggccgggugccuucgcaccuagcacaucguacccgcaaugcucuggacaaccucgugaugcuucacacuagcgagcauggugggcgagccuauagacacgcagucgaggaacugcccgagacaauggaaacguuauugcugcucggccugaugauacuucugaccggaggcgccaugcucuuuuugaucucagggaaaggaauugguaagacuacaaucggccugauuuguguuaucguguccagugggauguuauggauggcugauauaccacuacaguggauugcgucugccaucguacuggaguucuuuaugauggugcuccuuauuccugagccggaaaaacaaaggaccccccaggacaaucagcuggcauacgucgugaucggaauauugacccuggcugccaucguugccgcaaacgagaugggccuccuggaaacaacuaagcgggaucuugguaugagcaaggagccagggguggucuccccuacgucauaucucgacguagaccugcaccccgcuucugccuggaccuuguacgcgguggcuacaacuguuauuaccccaaugcugcgccauacaaucgaaaauagcaccgccaacgugaguuuagcagccauugcuaaccaagcagucgugcuaaugggccuggauaaaggauggccuaucuccaagauggaccucggcgucccccuucuggccuuggggugcuacagccaggugaauccgcugacucucacggcggcuguucugcuuuuagugacacacuaugccauaauuggaccaggccugcaggcaaaagccaccagagaggcucagaagaggacugccgcagguaucaugaaaaacccuaccguagaugggaucaugacaauugaccucgaucccgugaucuacgacucuaaguucgagaagcaauugggacaggucaugcugcuaguucugugugcugugcagcuccuucugaugcggacuucaugggccuugugcgaagcgcugacccucgccacaggcccaauaacgacccugugggaggguucccccggcaaauuuuggaauacuacaauugcagucaguauggcuaacaucuuccgagggagcuauuuagccggagcaggccuugcuuuuucgauuaugaagucuguggggaccggaagacgcggcacugguucccagggggaaacacugggagagaaauggaagaaaaagcucaaucaacuaagcaggaaggaauucgaucuguacaaaaagucaggcaucaccgagguagaccggacggaggccaaagaagguuugaagcguggcgagaccacacaucacgccgugaguagagggucugcgaaacugcagugguuuguugaaaggaacauggugauaccugagggacgcgucaucgaucucggcugugggcggggaggcugguccuauuacugcgcuggucuuaagaaagugacugaaguccgaggguauaccaagggaggcccgggccaugaggagcccgugccaaugagcacauacggguggaauauuguuaagcugaugucaggaaaagacguauucuacuugccucccgaaaagugugauacucugcucugcgacaucggugagaguagcccuuccccaaccguggaagagucuagaacaauuagggucuuaaaaaugguggagcccuggcugaagaacaaucaguucuguaucaaaguucuuaacccuuauaugccaaccgugauugaacaccuggagcgccuacagcggaaguacggcgggaugcucgucagaaauccccugagccguaacuccacucacgaaauguauuggaucucaaauggaacgggcaacauagugucuaguguaaauauggugucgagguugcugcucaaccgguuuacaaugacccaucgccgaccgacuauugagaaggauguugaccuuggugcagggaccagacacgucaacgccgaaccugagacaccaaauauggacgugaucggagagaggaucaaacggauuaaggaagagcauagcuccacguggcacuacgaugacgaaaaccccuauaaaaccugggcuuaccacggcucuuaugaggugaaggccacuggcucagcaagcuccaugauaaauggggucguuaaacuguuaacaaagccuugggaugugguaccaauggugacccaaauggccaugacugacacaacccccuucggacagcagcgcgucuuuaaggaaaaaguggauacaagaacuccgaggccuaugcccgguacccgaaagguuauggagaucacggcugaguggcuguggcggaccuugggccguaacaaaaagccaagacucugcacacgcgaagaguucacuaaaaaggugaggaccaaugcggccaugggggcagucuuuacagaagagaaccaaugggacagugcucgggccgcaguggaagaugaggaguucuggaagcugguagacagagaacgcgagcuacauaaacuuggaaaguguggcucuugcguuuacaauaugauggguaaaagggaaaagaaacugggggaguuuggaaaggccaaaggcagccgagcuauuugguacauguggcucggcgcccgguuccuggaguuugaagcguugggguuccugaacgaggaucacugguuuucaagagaaaauuccuauaguggaguggagggugaaggccuccauaagcuuggguacauccugagggacauuagcaagaucccuggaggcgcaauguaugccgaugacacugcugguugggacacccgcauaacggaggaugacuuacacaacgaggaaaaaaucacacagcagauggaucccgagcaucgucagcuggccaaugcaauuuucaaguugaccuaccaaaacaaagucgugaaggugcagcggccaacucccaaagggacagucauggacaucauuucuagaaaggaucagaggggauccggccagguuggcaccuaugggcucaauacuuuuaccaacauggaagcucaacuggugcgccagauggagggagaagguguacuaucaaaggccgaccuugagaauccucaccugcucgagaaaaagaucacacaguggcuggaaaacaaaggcguggagcgauugaagcggauggcuauaagcggggaugacugcgucgugaaaccaauugaugacagauucgccaacgcauuacuggcgcucaaugauaugggaaagguuaggaaggacaucccgcaguggcaacccucgaaaggcuggcacgauuggcagcaggugccuuucuguucucaucacuuucaugaacuuaucaugaaggacggucgcaaacuggucgugccaugcagaccccaggacgagcuaauugggcgggccaggauaagucaaggagcuggcuggucccugaaggaaacggccugucucggcaaagcauacgcucagauguggagcuugauguauuuccaccgucgagaucugcgccuugccucaaacgcaaucugcuccgccguaccuguucacugggugccaaccucuagaacuacauggagcauucaugcgcaccaucaguggaugaccacugaggacaugcuggcugucuggaaucggguguggaucgaggauaaccccuggauggaagacaagacaccuguuaccacgugggaggaugugccguaccucgggaagagggaagaccaaugguguggaaguuuaauuggucugacaucccgcgccaccugggcacagaauaucuugacugccauacagcaggucagaagccugaucggcgaugaggaguuucucgacuacaugccaucuaugaaacgguucaggaaggaagaggaaucagagggggcuauuugguga

SEQ ID NO: 15234 - RNA, 9873 nt, Artificial Sequence
  derived and/or modified CDS sequence (opt3) from DENV-3__FJ639724__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaacggguggagacuugggcacuccgccauccuggauucaccauccuggcccuguuucucgcucacuacauuggcacaucuuuaacucagaaaguugugaucuucauacugcuuauguuggucaccccaucgaugacaaugagaugugugggcguagggaacagggacuuuguugaaggacugucaggugccaccuggguggaugucgugcuagagcauggcgggugcgugacgacuauggcgaagagcaagcccacacucgacaucgagcugcagaaaaccgaagcaacucaacuugccacacugcggaaguuguguauugagggaaaaaucaccaauauuacgaccgauagucgcugcccuacacagggcgaagcuacucucccagaggaacaggaccagaacuaugucuguaagcacaccuacguugaucgagguugggggaauggaugcggccuguucggcaaaggguccuuagugacaugcgccaaguuucaaugucuggagcccaucgagggaaagguagugcaguaugaaaaccucaaauacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgagaacuggucuagauuucaacgagaugauucugcucaccaugaagaauaaagccuggaugguucacaggcagugguuuuucgaccugccccuuccuuggacauccggggcgaccacugagacaccaacguggaaccggaaggaacuguuggugaccuuuaaaaaugcccaugcaaagaaacaagaggucgugguccucggcucacaggaaggagcuaugcacacugcccugacaggcgcuaccgagauccagaacagugggggaacaagcaucuucgccggucacuuaaagugucgucugaagauggauaaacuagaacucaagggcaugucuuacgcaaugugccugaauacuuuugugcuuaaaaaggagguuuccgagacccagcaugggacgauuuugauaaaaguggaauacaagggagaggacgcccccuguaagaucccuuucucaaccgaagauggccaagguaaagcucacaacgggcgccugauuacagcgaacccaguagucacuaagaaagaggagcccgugaauaucgaagcagagccgccuuucggcgaaagcaacauaguuauuggaaucggcgacaaggcccucaaaaucaauugguauaagaaggggaguucuauuggaaaaauguuugaggcuaccgccagaggugcaaggcggauggccauccugggcgauacagcuugggacuucggguccgugggaggcguccuuaacagccuggguaagauggugcaucagauuuuugggucggccuacacugcauuguucucuggcguauccuggauaaugaaaaucggaauuggcgugcuccugaccuggaucggguuaaauucaaagaacacgaguaugagcuuuuccugcaucguuauuggaauaaucacacuguaucuaggcgcggucgugcaggcugauauggguugugugauuaauuggaaagggaaggaacucaagugcggaucuggcaucuucgucaccaacgagguucacacuuggacagagcaguacaaauuucaagccgacagccccaagcgacuggcaaccgccauugcuggugccugggaaaauggcgugugugggauccgcucaacuaccagaauggagaaccuuuuguggaaacagauagcaaaugaacugaacuauauccucugggagaauaacauuaagcugacagugguagucggagauaucauuggcguguuagaacaggggaaaaggacgcugaccccacagccuauggagcuuaaguacaguuggaaaacuuggggaaaggcuaagaucguuacagccgagacccaaaauuccagcuucauaauugacggccccaacacaccagaaugccccucugcgucacgggccuggaacgugugggaggucgaagacuaugguuuugggguguucacuaccaauaucugguugaaacuccgcgagguuuacacgcagaguugugaucauagacugaugagcgcugcaauuaaggacgaaagggccgugcacgcugauaugggauacuggaucgagucccagaaaaacggcucuuggaagcuagagaaagccucguuuauagaaguaaagacaugcaccuggccuaagagccacacucugugguccaaugguguccucgagucagacaugaucauuccaaaaagucuggcaggcccgaucucucagcauaaccaccgucccggguaucauacccaaacaacuggaccuuggcaccuuggcaaguuggaacuggauuucaauuacugcgaggggaccacaguggugauuacggagaacuguggaacccggggcccaagcuuacgaacuacaaccgucuccgguaaacucauccacgaauggugcuguagaucaugcacucugcccccucuuagguauaugggggaggacggauguugguacggcauggaaauacgcccaauuaaugagaaggaagagaacaugguuaaaagccuggugucugcggguuccggcaagguagauaauuuuacaauggggguguugugccucgccauccuguucgaggaagucaugcggggaaaguucggcaaaaagcauaugaucgcuggggugcuauuuaccuucguucugcuccugaguggacagauuacguggagagacauggcccacacucuuaucaugauuggcagcaacgcaucugauaggauggguaugggggugaccuauuuggcucugauagccacauuuaaaauccagcccuucuuagcacucggauuuuuccugcgcaagcuuaccucccgagagaaucugcuacucggcgucggccuggccauggcuacuacauugcaacugccggaagacauugagcagauggcgaacgggaucgccuuaggacucaugacccugaaacuuauuacacaguuugaaacuuaccagcuguggaccgcauuggugucacucacguguaguaauacaaucuucacccugacuguugcuuggcggaccgccacacuaauacuggccggugugagccuucucccucugugccaaucguccucuaugcguaagacugauugguugccaaugaccgucgcugcaaugggcguacccccucugcccuuauuuaucuucagccucaaggacacgccaaaaagaaggucauggccucugaacgagggggugauggccguuggacuugugaguauucuggcguccucuuugcuccgcaaugauguccccauggcuggcccacugguggccggugggcuacugaucgcauguuauguaauuacaggaaccagcgccgaccuuacuguggagaaggcugcagacgucacaugggaagaggaagccgagcagaccggcguuucccauaaccucaugaucacuguggaugacgauggcacaaugcggauaaaagacgaugaaaccgagaacauucugacgguguuguuaaagacugcgcugcucaucgucucagggaucuuuccguacagcauuccugcuacccugcuuguguggcacacauggcagaaacagacccaaagaaguggaguucugugggacguacccucuccacccgagacacagaaggccgaauuggaggaagguguguacaggauaaaacagcagggcaucuucgggaagacucaagucggagugggcguucagaaggaggguguguuucauaccauguggcacgucacgcgaggggcagugcuaacacacaauggaaaacgccuggagccuaacugggccuccguaaagaaagaucucauuagcuauggcggcggguggcggcugucggcucaguggcaaaagggagaagagguccaggugaucgccguugaaccagguaaaaaucccaagaacuuccagacuaugccuggcauuuuccagaccacaaccggggagaucggagcaauagcucuugacuuuaagccgggcacuucagguucuccaaucauuaauagagaagggaaaguggucggauuauacggcaacggcgugguuaccaagaaugggggauaugugagugguaucgcccaaacaaacgcggagcccgauggcccuacgccagagcuggaagaggaaauguucaaaaagaggaaucucacuauuauggacuugcaucccggguccggaaaaacccguaaguaccugccugccaucguccgcgaggcaauaaagcggagacucaggacacugauucuugcuccgacccgagugguagccgcugaaauggaggaggcacugaaaggcuugcccauccgguaucagacuacagccaccaagagcgaacacacgggucgcgagaucguggaucuaaugugccaugccacuuuuacaaugagacugcucucuccaguuagggucccuaacuacaauuuagugauuauggacgaagcucacuucaccgaucccgcgagcaucgcagcccggggguauauauccacccgagugggaaugggcgaggcugccgcaauuuuuaugacugccacaccaccuggcaccgcugaagcguucccccagucaaacgccccaauccaggacgaggagagagacauuccggaacgcaguuggaauagcgggaacgaguggaucacagauuuugucggaaaaacuguaugguucgugccuucuauaaaggcagguaaugacauugcuaacugucugaggaaaaacggcaagaagguuauccaacuuucccguaaaacguuugauaccgaauaccagaagacacggcugaaugacugggauuucguggucacuaccgacaucucagagaugggggccaacuuuaaagcagauagagugauugaccccaggcgcugccucaagccaguuaucuugacagauggacccgagcgagugauucuggccggcccuaugccagucaccgcugccagugcggcacagagacgggguaggguggggcgcaauccccagaaagaaaacgaccaauacauauucacuggccagccucucaauaacgaugaggaccaugcccacuggacggaagcuaagaugcugcuugacaauaucaacaccccggagggaauuaucccagcccuauucgaacccgagcgugagaagagcgcugcaaucgauggcgaauauagacugaaaggggagucccggaagacauuuguagaauugaugaggcgcggagacuuaccuguguggcuggcccacaaaguugcuucugaggguauuaaguacacugaucgaaaauggugcuucgacggcgaaagaaauaaccagauacucgaggagaauauggaugucgaaaucuggaccaaggagggggaacggaaaaagcugaggccccgcuggcuugacgccagaacauauucggauccacuggcacucaaggaguuuaaagacuucgcggccggaaggaagagcauugcuuuggaucuggugaccgaaaucggccgggugccuucacaucuagcccaccguacucgcaacgcacuggacaaucucgucaugcuucauacauccgagcacggugggcgagcuuacagacacgccguugaggaacugcccgagacgauggaaaccuuauugcugcucggccugaugauucuucugacuggaggcgcaaugcucuuuuugaucagugggaaaggaauagguaagacaucuaucggccugauuugugugaucguaagcuccgggauguuauggauggccgaugugccacuacaguggauugcuucagcgaucguccuggaguucuuuaugauggugcuccuuauaccugagccggaaaaacaaaggaccccccaggacaaccagcuggccuauguugugauuggaaucuugacccuggcagcuauugucgccgccaaugagaugggccuccuggaaacaacuaagcgggaucuugguaugucuaaggagccagggguagugagcccuacgaguuaccucgacguugaccugcaucccgcauccgcuuggaccuuguaugccguggcgacaacugucaucaccccaaugcugcgccacacaauagaaaacagcaccgcuaaugugucuuuagccgcaaucgccaaccaagcugucgugcuaaugggccuggauaaaggauggccuauuucaaagauggaccucggcguuccccuucuggcauuggggugcuacucccaggugaacccgcugacucucacggccgcgguacugcuuuuagugacacauuacgcuaucauuggaccaggccugcaggccaaagcaaccagagaggcccagaagaggacugcugccgguaucaugaaaaauccuaccgucgaugggauaaugacaauugaccucgaucccguuaucuaugacaguaaguucgagaagcaauugggacaggugaugcugcuaguccugugugcagugcagcuccuucugaugcggacuagcugggcuuugugcgaagcccugacccucgcgacaggcccaaucacgacccugugggaggguucgcccggcaaauuuuggaacacuacaauugccguaucuauggcaaauaucuuccgaggguccuacuuagcuggagccggccuugcauuuagcauaaugaagucaguggggaccggaagacgcggcacugguagucagggggaaacacugggagagaaauggaagaaaaagcucaaccaacuaucuaggaaggaauucgaucuguauaaaaaguccggcauuaccgagguugaccggacggaggcuaaagaagguuugaagcguggcgagaccacacaccaugccgugagcagagggucagccaaacugcagugguuugucgaaaggaauauggugaucccugagggacgcgucauugaucucggcugugggcggggaggcuggaguuacuauugcgcgggucuuaagaaagugacugaaguucgaggguacaccaagggaggcccgggccacgaggagcccguaccaaugagcacauauggguggaacaucgugaagcugauguccggaaaagacgucuucuacuugccucccgaaaagugugauacucugcucugcgacauaggugagucuagcccuuccccaaccguggaagagucaagaacaaucaggguuuuaaaaaugguggagcccuggcugcgcaauaaccaguucuguauuaagguccuuaauccuuacaugccaaccgugaucgaacaccuggagcggcuacagagaaaauauggcgggaugcucguacguaacccccugucuaggaauaguacucaugaaauguacuggauuucgaacggaacgggcaauaucgugagcuccguuaacauggucucucgguugcugcucaaucgcuuuacaaugacccaccgaagaccgacuauugagaaggauguggaccuuggugcugggaccaggcaugugaacgcagaaccugagacaccaaacauggacgucaucggagagcggauaaagcgcauuaaagaagagcacucaagcacguggcacuaugaugacgaaaaucccuacaagaccugggccuaucauggcuccuacgagguuaaagcuacuggcagugccucuagcaugaucaacggggugguaaagcuguuaacaaaaccuugggauguggucccaauggugacccaaauggcaaugacugacacaacccccuucggacagcagagaguuuuuaaggaaaagguggauacaaggacuccgcgaccuaugcccgguacccggaaagucauggagaucacggccgaguggcuguggcguaccuugggcagaaauaagaaaccacgccucugcacaagggaagaguucacuaagaaagugcggaccaacgcugcgaugggggccguauuuacagaagagaaucaaugggacucagcaagagcugccguugaagaugaggaguucuggaagcugguggaccgcgaaagggagcuacacaagcuuggaaaauguggcuccugcgucuauaacaugauggguaagcgagaaaaaaagcugggggaguuuggaaaagcaaagggcagucgggccauuugguacauguggcucggcgcuagauaccuggaguucgaagccuugggguuucugaaugaggaucauugguucagcagggaaaacucuuauuccggaguggagggugaaggccuccacaaacuuggguacauacugcgcgacaucucaaagauuccuggaggcgcgauguaugcagaugacacugccgguugggacacccguaucacggaggaugacuuacauaaugaggaaaagauuacacagcagauggaucccgagcaccggcagcuggcuaacgccaucuuuaaauugaccuaccaaaauaagguggucaaaguucagagaccaacucccaaggggacagugauggacauaaucagcaggaaagaucagcgcggaucgggccagguaggcaccuaugggcucaacacuuucaccaauauggaagcacaacuggugcgacagauggagggagaagguguccuaucuaaggcugaccuugagaacccucaccugcucgagaagaaaauuacacaguggcuggaaacgaagggcguggagcgguugaaaagaauggccaucaguggggaugacugcguugugaagccaauugaugacagguuugcuaaugccuuacuggcacucaacgauaugggaaaaguccgcaaggacaucccgcaguggcaacccuccaagggcuggcaugauuggcagcaggugccuuucuguagccaccauuuccacgaacuuauaaugaaagacgguagaaagcugguaguuccaugccggccccaggacgagcuaauugggagggcgcguaucucacaaggagccggcuggucccugaaagaaaccgcuugucucggcaaggccuacgcacagauguggucuuugauguauuuucaccgacgcgaucugagacuugcuagcaacgccaucugcagugcagugccuguccauuggauuccaacuucccggacaaccuggagcauacacgcccaucaccaguggaugacuacagaggacaugcugaccguguggaauaggguuuggaucgaggauaaccccuggauggaagacaaaacgccugugacaaccugggaggaugucccguaccucgggaagcgcgaagaccaaugguguggaucuuuaauuggucugacuucaagagcgaccugggcucagaauaucuugacagccauucagcaggugcggagucugaucggcgaugaggaguuccucgacuacaugccauccaugaagagguuucgaaaagaagaggaaagcgagggggcaauaugguga

SEQ ID NO: 15235 - RNA, 9873 nt, Artificial Sequence
  derived and/or modified CDS sequence (opt3) from DENV-3__FJ639725__SS-prME
accagccugugccucaugaugaugcuuccagcaacacuggcuuuccacuugacuuccagagacggcgaaccuaggaugaucguggggaagaacgaacggggaaaaucuuuacuguuuaagacggcaucagguauuaauauguguacccuaauagccauggaucucggcgagaugugcgacgauacaguaacuuacaaauguccacugaucgcggaaguugagccggaagacauugauugcugguguaaccuuaccaguacaugggugaccuaugggacuugcaaucaggcuggagagcaccgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaaaagcaaacccacacucgacaucgagcugcagaagaccgaagcaacucaacuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugccaagaagcaagaggucgugguccucggcucacaggaaggagcuaugcacacugcccugacaggcgcuaccgagauccagaacagugggggaacaagcaucuucgccggucacuuaaagugucggcugaaaauggauaagcuagaacucaaaggcaugucuuacgcaaugugccugaauacuuuugugcuuaagaaagagguuuccgagacccagcaugggacgauuuugauaaagguggaauacaagggagaggacgcccccuguaaaaucccuuucucaaccgaagauggccaagguaaggcucacaacgggcgucugauuacagcgaacccaguagucacuaaaaaggaggagcccgugaauaucgaagcagagccgccuuucggcgaaagcaacauaguuauuggaaucggcgacaaagcccucaagaucaauugguauaagaaagggaguucuauuggaaagauguuugaggcuaccgcccgcggugcaagaaggauggccauccugggcgauacagcuugggacuucggguccgugggaggcguccuuaacagccuggguaaaauggugcaucagauuuuugggucggccuacacugcauuguucucuggcguauccuggauaaugaagaucggaauuggcgugcuccugaccuggaucggguuaaauucaaagaacacgaguaugagcuuuuccugcaucguuauuggaauaaucacacuguaucuaggcgcggucgugcaggcugauauggguugugugauuaauuggaaggggaaggaacucaaaugcggaucuggcaucuucgucaccaacgagguucacacuuggacagagcaguacaaguuucaagccgacagccccaaacggcuggcaaccgccauugcuggugccugggaaaauggcgugugugggauccgaucaacuacccgcauggagaaccuuuuguggaagcagauagcaaaugaacugaacuauauccucugggagaauaacauuaaacugacagugguagucggagauaucauuggcguguuagaacaggggaagagaacgcugaccccacagccuauggagcuuaaauacaguuggaagacuuggggaaaggcuaaaaucguuacagccgagacccaaaauuccagcuucauaauugacggccccaacacaccagaaugccccucugcgucaagggccuggaacgugugggaggucgaagacuaugguuuugggguguucacuaccaauaucugguugaagcuccgggagguuuacacgcagaguugugaucaucgccugaugagcgcugcaauuaaagacgaaagagccgugcacgcugauaugggauacuggaucgagucccagaagaacggcucuuggaaacuagagaaggccucguuuauagaaguaaagacaugcaccuggccuaaaagccacacucugugguccaaugguguccucgagucagacaugaucauuccaaagagucuggcaggcccgaucucucagcauaaccacaggcccggguaucauacccaaacagcgggaccuuggcaccuuggcaaauuggaacuggauuucaauuacugcgaggggacuaccguggugauuacagagaacuguggaacgcguggccccagcuuacggaccacuacagucuccgguaagcucauccacgaauggugcugucgaucaugcacccugcccccucuuagauauaugggggaggacggauguugguacggcauggaaauaaggccaauuaaugagaaagaagagaacaugguuaagagccuggugucugccgguuccggcaagguagauaauuuuacuauggggguguugugccucgcuauccuguucgaggaagucaugcgcggaaaauucggcaagaaacauaugaucgccggggugcuauuuacauucguucugcuccugaguggacagauuaccuggcgggacauggcacacacgcuuaucaugauuggcagcaacgcuucugauagaauggguaugggggugacuuauuuggcccugauagcaaccuuuaagauccagcccuucuuagcccucggauuuuuccugaggaaacuuacaucccgcgagaaucugcuacucggcgucggccuggcuauggcgaccacuuugcaacugccggaagacauugagcagauggccaacgggaucgcauuaggacucaugacacugaaacuuauuacccaguuugaaacauaccagcuguggacugcuuuggugucacucaccuguaguaauacgaucuucacacugaccguugccuggcgaacugccacccuaauacuggcuggugugagccuucucccucugugccaaucguccucuaugcggaagacagauugguugccaaugacugucgcagccaugggcguacccccucugcccuuauuuaucuucagccucaaagacaccccaaagcguagaucauggccucugaacgagggggugauggcgguuggacuugugaguauucuggcuuccucuuugcucaggaaugauguccccauggccggcccacugguggccggugggcuacugaucgccuguuauguaauuacgggaacaagcgcugaccuuaccguggagaaagcagccgacgucacuugggaagaggaagcggagcagacaggcguuucccauaaccucaugaucaccguggaugacgauggcacuaugcgcauaaaggacgaugaaacagagaacauucugaccguguuguuaaaaacggcucugcucaucgucucagggaucuuuccguacagcauuccugccacucugcuuguguggcacaccuggcagaagcagacacaacggaguggaguucugugggacguacccucuccacccgagacccagaaagcagaauuggaggaagguguguacagaauaaagcagcagggcaucuucgggaagacacaagucggagugggcguucagaaagaggguguguuucauacuauguggcacgucacccgaggggcagugcuaacgcacaauggaaagaggcuggagccuaacugggcuuccgucaaaaaggaucucauuagcuauggcggcggguggcgccugucggcccaguggcaaaaaggagaagagguccaggugaucgcaguugaaccagguaagaaucccaagaacuuccagacaaugccuggcauuuuccagacuaccacaggggagaucggagcuauagcccuugacuuuaaaccgggcaccucagguucuccaaucauuaaucgggaagggaagguggucggauuauacggcaacggcgugguuacuaaaaaugggggauaugugagugguaucgcgcaaaccaacgccgagcccgauggcccuacaccagagcuggaagaggaaauguucaagaaaagaaaucucacgauuauggacuugcaucccggguccggaaagacuaggaaguaccugccugcaaucguccgugaggcuauaaaacgccggcucagaacccugauucuugccccgacaagggugguagcugcagaaauggaggaggcccugaagggcuugcccauccgauaucagaccacugccacaaaaagcgaacacaccggucgggagaucguggaucuaaugugccaugcuacguuuacuaugcgccugcucucuccaguuagagucccuaacuacaauuuagugauuauggacgaagcgcacuucacagaucccgcaagcaucgccgcuaggggguauauauccacccgggugggaaugggcgaggccgcagccauuuuuaugaccgcuacuccaccuggcacagcggaagccuucccccagucaaacgcaccaauccaggacgaggagcgagacauuccggaaagaaguuggaauagcgggaacgaguggaucaccgauuuugucggaaagacaguaugguucgugccuucuauaaaagcugguaaugacauugccaacugucugcgcaagaacggcaagaaaguuauccaacuuuccaggaagacuuuugauacggaauaccagaaaacccgucugaaugacugggauuucguggucacaacugacaucucagagaugggggcaaacuuuaaggccgaucgggugauugaccccagaaggugccucaaaccaguuaucuugaccgauggacccgagcgcgugauucuggcuggcccuaugccagucacagccgcgagugcagcccagcgaagaggucggguggggaggaauccccagaaggaaaacgaccaauacauauucaccggccagccucucaauaacgaugaggaccaugcucacuggacugaagccaagaugcugcuugacaauaucaacacgccggagggaauuaucccagcucuauucgaacccgagcgcgagaaaagcgcagccaucgauggcgaauaucgucugaagggggaguccagaaaaaccuuuguagaauugaugcggaggggagacuuaccuguguggcuggcucacaagguugccucugaggguauuaaauacacagaucgcaaguggugcuucgacggcgaacgaaauaaccagauacucgaggagaauauggaugucgaaaucuggacuaaagagggggaaagaaagaagcugcggcccagguggcuugacgcacgcaccuauucggauccacuggcgcucaaagaguuuaaggacuucgccgcuggaagaaaaagcauugccuuggaucuggugacagaaaucggcagggugccuucacaucuagcacaccggacccguaacgcucuggacaaucucgucaugcuucauacuuccgagcacggugggcgcgccuaccgacacgcaguugaggaacugcccgagacaauggaaacguuauugcugcucggccugaugauucuucugaccggaggcgccaugcucuuuuugaucagugggaagggaauagguaaaacuucuaucggccugauuugugugaucgcuagcuccgggauguuauggauggcggauguaccacuacaguggauugccucagcaaucgugcuggaguucuuuaugaugguccuccuuauaccugagccggaaaagcaaagaacaccccaggacaaccagcuggcuuaugugguuauuggaaucuugacccuggccgccauuguggcagcuaaugagaugggccuccuggaaaccacaaagagggaucuugguaugucuaaagagccaggggucguaagcccuacaaguuaccucgacguggaccugcaucccgccuccgcguggacguuguaugcuguugccaccacagugaucacuccaaugcugcggcacaccauagaaaacagcacagcaaaugucucuuuagccgcuaucgcaaaccaagccgugguccuaaugggccuggauaagggauggccuauuucaaaaauggaccucggcgugccccuucuggcguuggggugcuacucccagguuaacccgcugacccucacugcugccgugcugcuuuuaguaacgcauuacgcaaucauuggaccaggccugcaggccaaggcuacacgcgaggcccagaaaagaaccgcagcugguaucaugaagaauccuacuguggaugggauaaugaccauugaccucgaucccgucaucuaugacaguaaguucgagaaacaauugggacagguuaugcugcuagugcugugugccguccagcuccuucugaugaggacaagcugggcguugugcgaagcccugacucucgcaaccggcccaaucacaacgcugugggaggguucgcccggcaaguuuuggaacaccacuauugcugugucuauggccaauaucuuccggggguccuacuuagcaggagcuggccuugccuuuagcauaaugaaaucaguagggacaggacgaagaggcaccgguagucagggggaaacucugggagagaaguggaaaaagaagcucaaccaacuaucucgcaaagaguucgaucuguauaagaaauccggcauuacagagguggacaggaccgaggccaaggaagguuugaaacggggcgagacgacccaccaugcgguuagccgugggucagcuaagcugcagugguuuguggaaagaaauauggucaucccugagggaagggugauugaucucggcugugggcgcggaggcuggaguuacuauugcgcaggucuuaaaaaggucacagaagugcggggguacacuaagggaggcccgggccacgaggagcccguuccaaugagcaccuauggguggaacaucguaaaacugauguccggaaaggacguguucuacuugccucccgaaaaaugugauacacugcucugcgacauaggugagucuagcccuuccccaacugucgaagagucacgaaccaucagaguguuaaagaugguugagcccuggcugaggaauaaccaguucuguauuaaagugcuuaauccuuacaugccaacagucaucgaacaccuggagcgccuacagcggaaguauggcgggaugcucgugagaaacccccugucucguaauaguacccaugaaauguacuggauuucgaacggaacuggcaauaucguaagcuccgugaacaugguuucuagguugcugcucaaucgguuuacgaugacacaccgccgaccgaccauugagaaggaugucgaccuuggugccgggacuagacaugugaacgcugaaccugagaccccaaacauggacgugaucggagagaggauaaaacggauuaaggaagaacacucaagcacauggcacuaugaugacgaaaaucccuacaaaacgugggccuaucauggcuccuacgaggucaaggcaaccggcagugccucuagcaugaucaacgggguugugaaacuguuaacuaagccuugggauguagugccaauggucacacaaauggcuaugaccgacacuacacccuucggacagcagcgcguguuuaaggaaaaaguugauaccagaacaccgaggccuaugcccgguacucgaaaggugauggagaucaccgcggaguggcuguggcggacguugggccguaauaaaaagccaagacucugcacccgcgaagaguucacuaaaaaggucaggacuaacgccgcaaugggggcuguguuuaccgaagagaaucaaugggacucagcccgggcagccguagaagaugaggaguucuggaagcugguugacagagaacgcgagcuacacaaacuuggaaaguguggcuccugcguguauaacaugauggguaaaagggaaaagaaacugggggaguuuggaaaggcuaaaggcagucgagccauuugguacauguggcucggcgcgcgguaccuggaguucgaagcauugggguuucugaaugaggaucauugguucagcagagaaaacucuuauuccggagucgagggugaaggccuccacaaacuuggguacauacugagggacaucucaaagauuccuggaggcgccauguaugcugaugacacagccgguugggacacucgcaucaccgaggaugacuuacauaaugaggagaaaauuacgcagcagauggaucccgagcaccgucagcuggcaaacgcuaucuuuaaguugacauaccaaaauaaaguggugaagguccagcggccaacccccaaagggacuguuauggacauaaucagcagaaaggaucagaggggaucgggccaggugggcacauaugggcucaacaccuucacuaauauggaagcccaacugguacgccagauggagggagaaggugugcuaucuaaggcugaccuugagaacccucaucugcucggcaaaaagauuacccaguggcuggagacaaaaggggucgaacgauugaagcggauggccaucaguggagaugacugcgugguuaaaccaauugaugacagauuugcaaaugcguuacuggcccucaacgauaugggcaaggugaggaaggacaucccgcaguggcaacccuccaaagguuggcaugauuggcagcaggucccuuucuguagccaccauuuccacgagcuuauaaugaaggacgggcgcaaacuggugguaccaugcagaccccaggacgaacuaauuggacgggcuaggaucucacaaggcgccggcuggucccugaaggagacggcaugucucgggaaggcuuacgcccagauguggucuuugauguauuuucaccgucgagaucugcgccuugcaagcaacgccaucugcagugcgguuccugugcauuggauuccaaccuccagaacuacauggagcauacacgcucaucaccaguggaugaccacugaagacaugcugacagucuggaaucggguguggaucgaggauaaccccuggauggaggacaagaccccuguuacgacaugggaagaugugccguaccucggaaagagggaggaccaauggugugguucuuuaauuggccugaccucacgcgccacuugggcacagaauaucuugaccgccauucagcaggucagaagucugaucggggaugaagaguuccucgacuacaugccauccaugaaacgguuuaggaaggaggaagagagcgaaggagcuauaugguga

SEQ ID NO: 15236 - RNA, 9873 nt, Artificial Sequence
  derived and/or modified CDS sequence (opt3) from DENV-3__FJ639726__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaacggguggagacuugggcacuccgccauccuggauucaccauccuggcccuguuucucgcucacuacauuggcacaucuuuaacucagaaaguugugaucuucauacugcuuauguuggucaccccaucgaugacaaugagaugugugggcguagggaacagggacuuuguugaaggacugucaggugccaccuggguggaugucgugcuagagcauggcgggugcgugacgacuauggcgaagagcaagcccacacucgacaucgagcugcagaaaaccgaagcaacucaacuugccacacugcggaaguuguguauugagggaaaaaucaccaauauuacgaccgauagucgcugcccuacacagggcgaagcuacucucccagaggaacaggaccagaacuaugucuguaagcacaccuacguugaucgagguugggggaauggaugcggccuguucggcaaaggguccuuagugacaugcgccaaguuucaaugucuggagcccaucgagggaaagguagugcaguaugaaaaccucaaauacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgagaacuggucuagauuucaacgagaugauucugcucaccaugaagaauaaagccuggaugguucacaggcagugguuuuucgaccugccccuuccuuggacauccggggcgaccacugagacaccaacguggaaccggaaggaacuguuggugaccuuuaaaaaugcccaugcaaagaaacaagaggucgugguccucggcucacaggaaggagcuaugcacacugcccugacaggcgcuaccgagauccagaacagugggggaacaagcaucuucgccggucacuuaaagugucgucugaagauggauaaacuagaacucaagggcaugucuuacgcaaugugccugaauacuuuugugcuuaaaaaggagguuuccgagacccagcaugggacgauuuugauaaaaguggaauacaagggagaggacgcccccuguaagaucccuuucucaaccgaagauggccaagguaaagcucacaacgggcgccugauuacagcgaacccaguagucacuaagaaagaggagcccgugaauaucgaagcagagccgccuuucggcgaaagcaacauaguuauuggaaucggcgacaaggcccucaaaaucaauugguauaagaaggggaguucuauuggaaaaauguuugaggcuaccgccagaggugcaaggcggauggccauccugggcgauacagcuugggacuucggguccgugggaggcguccuuaacagccuggguaagauggugcaucagauuuuugggucggccuacacugcauuguucucuggcguauccuggauaaugaaaaucggaauuggcgugcuccugaccuggaucggguuaaauucaaagaacacgaguaugagcuuuuccugcaucguuauuggaauaaucacacuguaucuaggcgcggucgugcaggcugauauggguugugugauuaauuggaaagggaaggaacucaagugcggaucuggcaucuucgucaccaacgagguucacacuuggacagagcaguacaaauuucaagccgacagccccaagcgacuggcaaccgccauugcuggugccugggaaaauggcgugugugggauccgcucaacuaccagaauggagaaccuuuuguggaaacagauagcaaaugaacugaacuauauccucugggagaauaacauuaagcugacagugguagucggagauaucauuggcguguuagaacaggggaaaaggacgcugaccccacagccuauggagcuuaaguacaguuggaaaacuuggggaaaggcuaagaucguuacagccgagacccaaaauuccagcuucauaauugacggccccaacacaccagaaugccccucugcgucacgggccuggaacgugugggaggucgaagacuaugguuuugggguguucacuaccaauaucugguugaaacuccgcgagguuuacacgcagaguugugaucauagacugaugagcgcugcaauuaaggacgaaagggccgugcacgcugauaugggauacuggaucgagucccagaaaaacggcucuuggaagcuagagaaagccucguuuauagaaguaaagacaugcaccuggccuaagagccacacucugugguccaaugguguccucgagucagacaugaucauuccaaaaagucuggcaggcccgaucucucagcauaaccaccgucccggguaucauacccaaacagcgggaccuuggcaccuuggcaaguuggaacuggauuucaauuacugcgaggggacuaccguggugauuacagagaacuguggaacgcggggcccaagcuuacgaaccacuacagucuccgguaaacucauccacgaauggugcuguagaucaugcacccugcccccucuuagguauaugggggaggacggauguugguacggcauggaaauacgcccaauuaaugagaaggaagagaacaugguuaaaagccuggugucugccgguuccggcaagguagauaauuuuacuauggggguguugugccucgcuauccuguucgaggaagucaugcggggaaaguucggcaaaaagcauaugaucgccggggugcuauuuacauucguucugcuccugaguggacagauuaccuggagagacauggcacacacgcuuaucaugauuggcagcaacgcuucugauaggauggguaugggggugacuuauuuggcccugauagcaaccuuuaaaauccagcccuucuuagcccucggauuuuuccugcgcaagcuuacaucccgagagaaucugcuacucggcgucggccuggcuauggcgaccacuuugcaacugccggaagacauugagcagauggccaacgggaucgcauuaggacucaugacacugaaacuuauuacccaguuugaaacauaccagcuguggacugcuuuggugucacucaccuguaguaauacgaucuucacacugaccguugccuggcggacugccacccuaauacuggcuggugugagccuucucccucugugccaaucguccucuaugcguaagacagauugguugccaaugacugucgcagccaugggcguacccccucugcccuuauuuaucuucagccucaaggacaccccaaaaagaaggucauggccucugaacgagggggugauggcgguuggacuugugaguauucuggcuuccucuuugcuccgcaaugauguccccauggccggcccacugguggcaggugggcuacugaucgccuguuauguaauuacgggaacaagcgcugaccuuaccguggagaaggcagccgacgucacuugggaagaggaagcggagcagacaggcguuucccauaaccucaugaucaccguggaugacgauggcacuaugcggauaaaagacgaugaaacagagaacauucugaccguguuguuaaagacggcucugcucaucgucucagggaucuuuccguacagcauuccugccacucugcuuguguggcacaccuggcagaaacagacacaaagaaguggaguucugugggacguacccucuccacccgagacccagaaggcagaauuggaggaagguguguacaggauaaaacagcagggcaucuucgggaagacacaagucggagugggcguucagaaggaggguguguuucauacuauguggcacgucacccgaggggccgugcuaacgcacaauggaaaacgccuggagccuaacugggcuuccguaaagaaagaucucauuagcuauggcggcggguggcggcugucggcccaguggcaaaagggagaagagguccaggugaucgcaguugaaccagguaaaaaucccaagaacuuccagacaaugccuggcauuuuccagacuaccacaggggagaucggagcuauagcccuugacuuuaagccgggcaccucagguucuccaaucauuaauagagaagggaaaguggucggauuauacggcaacggcgugguuacuaagaaugggggauaugugagugguaucgcgcaaaccaacgccgagcccgauggcccuacaccagagcuggaagaggaaauguucaaaaagaggaaucucacgauuauggacuugcaucccggguccggaaaaacucguaaguaccugccugcaaucguccgcgaggcuauaaagcggagacucaggacccugauucuugccccgacacgagugguagcugcagaaauggaggaggcccugaaaggcuugcccauccgguaucagaccacugccacaaagagcgaacacaccggucgcgagaucguggaucuaaugugccaugcuacguuuacuaugagacugcucucuccaguuagggucccuaacuacaauuuagugauuauggacgaagcgcacuucacagaucccgcaagcaucgccgcucggggguauauauccacccgagugggaaugggcgaggccgcagccauuuuuaugaccgcuacuccaccuggcacagcggaagccuucccccagucaaacgcaccaauccaggacgaggagagagacauuccggaacgcaguuggaauagcgggaacgaguggaucaccgauuuugucggaaaaacaguaugguucgugccuucuauaaaggcugguaaugacauugccaacugucugaggaaaaacggcaagaagguuauccaacuuucccguaaaacuuuugauacggaauaccagaagacccggcugaaugacugggauuucguggucacaacugacaucucagagaugggggcaaacuuuaaagccgauagagugauugaccccaggcgcugccucaagccaguuaucuugaccgauggacccgagcgagugauucuggcuggcccuaugccagucacagccgcgagugcagcccagagacgggguaggguggggcgcaauccccagaaagaaaacgaccaauacauauucaccggccagccucucaauaacgaugaggaccaugcucacuggacugaagccaagaugcugcuugacaauaucaacacgccggagggaauuaucccagcucuauucgaacccgagcgugagaagagcgcagccaucgauggcgaauauagacugaaaggggagucccggaagaccuuuguagaauugaugaggcgcggagacuuaccuguguggcuggcucacaaaguugccucugaggguauuaaguacacagaucgaaaauggugcuucgacggcgaaagaaauaaccagauacucgaggagaauauggaugucgaaaucuggacuaaggagggggaacggaaaaagcugaggccccgcuggcuugacgcaagaaccuauucggauccacuggcgcucaaggaguuuaaagacuucgccgcuggaaggaagagcauugccuuggaucuggugacagaaaucggccgggugccuucacaucuagcacaccguacccgcaacgcucuggacaaucucgucaugcuucauacuuccgagcacggugggcgagccuacagacacgcaguugaggaacugcccgagacaauggaaacguuauugcugcucggccugaugauucuucugaccggaggcgccaugcucuuuuugaucagugggaaaggaauagguaagacuucuaucggccugauuugugugaucguaagcuccgggauguuauggauggcugaugugccacuacaguggauugcgucagccaucguccuggaguucuuuaugauggugcuccuuauaccugagccggaaaaacaaaggacaccccaggacaaccagcuggcauauguugugauuggaaucuugacccuggcugccauugucgccgcaaaugagaugggccuccuggaaaccacaaagcgggaucuugguaugucuaaggagccagggguagugagcccuacuaguuaccucgacguugaccugcaucccgcuuccgccuggacguuguaugcgguggcuaccacagucaucacuccaaugcugcgccacaccauagaaaacagcacagccaaugugucuuuagcagccaucgcuaaccaagcagucgugcuaaugggccuggauaaaggauggccuauuucaaagauggaccucggcguuccccuucuggccuuggggugcuacucccaggugaacccgcugacccucacugcggcuguacugcuuuuagugacgcauuacgccaucauuggaccaggccugcaggcaaaagccacaagagaggcucagaagaggaccgccgcagguaucaugaaaaauccuacugucgaugggauaaugaccauugaccucgaucccguuaucuaugacaguaaguucgagaagcaauugggacaggugaugcugcuaguccugugugcugugcagcuccuucugaugcggacaagcugggccuugugcgaagcgcugacucucgccaccggcccaaucacaacgcugugggaggguucgcccggcaaauuuuggaacaccacuauugcaguaucuauggcuaauaucuuccgaggguccuacuuagccggagcaggccuugcuuuuagcauaaugaagucaguggggacaggaagacgcggcaccgguagucagggggaaacucugggagagaaauggaagaaaaagcucaaccaacuaucuaggaaggaauucgaucuguauaaaaaguccggcauuacagagguugaccggaccgaggccaaagaagguuugaagcguggcgagacgacccaccaugccgugagcagagggucagcgaaacugcagugguuugucgaaaggaauauggugaucccugagggacgcgucauugaucucggcugugggcggggaggcuggaguuacuauugcgcuggucuuaagaaagugacagaaguucgaggguacacuaagggaggcccgggccacgaggagcccguaccaaugagcaccuauggguggaacaucgugaagcugauguccggaaaagacgucuucuacuugucuccugaaaagugugauacacugcucugcgacauaggugagagcucccccucaccuacuguggaagagucuagaaccaucaggguuuuaaaaaugguggagccauggcugcgcaauaaccaguucuguauuaagguccuuaaucccuacaugccuacagugaucgaacaccuggagcggcuacagagaaaauauggcgggaugcucguacguaacccacugaguaggaauucgacccaugaaauguacuggauuagcaacggaacuggcaauaucguguccucuguuaacauggucucacgguugcugcucaaucgcuuuacgaugacacaccgaagacccaccauugagaaggauguggaccuuggugcagggacuaggcaugugaacgccgaaccggagaccccuaacauggacgucaucggagagcggauaaagcgcauuaaagaagagcacagcuccacauggcacuaugaugacgaaaauccauacaagacgugggcuuaucauggcaguuacgagguuaaagccaccggcucugcaagcucaaugaucaacggggugguaaagcuguuaacuaaacccugggauguggucccuauggugacacaaauggccaugaccgacacuacaccauucggacagcagagaguuuuuaaggaaaagguggauaccaggacaccccgaccgaugccugguacucggaaagucauggagaucaccgcugaguggcuguggcguacguugggcagaaauaagaaaccccgccucugcaccagggaagaguucacaaagaaagugcggacuaacgcggccaugggggcaguauuuaccgaagagaaucaaugggacuccgcuagagccgcaguugaagaugaggaguucuggaagcugguggaccgcgaaagggagcuacacaagcuuggaaaauguggcaguugcgucuauaacaugauggguaagcgagaaaaaaagcugggggaguuuggaaaagccaagggcagccgggcuauuugguacauguggcucggcgccagauaccuggaguucgaagcguugggguuucugaaugaggaucauugguucucuagggaaaacuccuauucaggaguggagggugaaggccuccacaaacuuggguacauacugcgcgacaucagcaagauuccaggaggcgcaauguaugccgaugacacagcugguugggacacucguaucaccgaggaugacuuacauaaugaggaaaagauuacgcagcagauggauccugagcaccggcagcuggccaacgcaaucuuuaaauugacauaccaaaauaagguggucaaaguucagagacccaccccaaaggggacugugauggacauaaucucgaggaaagaucagcgcggaucuggccagguaggcacauaugggcucaacaccuucacuaauauggaagcucaacuggugcgacagauggagggagaagguguccuaaguaaggccgaccuugagaacccccaccugcucgagaagaaaauuacccaguggcuggaaacaaagggcguggagcgguugaaaagaauggcuaucuccggggaugacugcguugugaagccuauugaugacagguuugccaaugcauuacuggcgcucaacgauaugggaaaaguccgcaaggacaucccacaguggcaaccgagcaagggcuggcaugauuggcagcaggugcccuucuguucacaccauuuccacgaacuuauaaugaaagacgguagaaagcugguaguuccuugccggccacaggacgagcuaauugggagggcccguaucucccaaggagcuggcuggucucugaaagaaacggccugucucggcaaggcauacgcucagauguggagcuugauguauuuucaccgacgcgaucugagacuugccaguaacgcaaucugcuccgccgugcccguccauuggauuccuaccagccggacuacauggucuauacacgcgcaucaccaguggaugaccacugaggacaugcugacaguguggaauaggguuuggaucgaggauaacccauggauggaagacaaaacccccgugacgacaugggaggaugucccuuaccucgggaagcgcgaagaccaaugguguggaucauuaauuggucugaccaguagagcuacuugggcccagaauaucuugaccgcaauucagcaggugcggucccugaucggcgaugaggaguuccucgacuacaugccgagcaugaagagguuucgaaaagaagaggaaucugagggggccauaugguga

SEQ ID NO: 15237 - RNA, 9873 nt, Artificial Sequence
  derived and/or modified CDS sequence (opt3) from DENV-3__KF955333__SS-prME
accagccugugccucaugaugaugcuucccgcaacccuggcuuuccacuugacuuccagggacggagaaccuaggaugaucguggggaagaacgaacggggaaaaucuuuacuguuuaagacggcgucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaccgccgagacaagcguagcguggcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcaaagagcaaacccacacucgacaucgagcugcagaagaccgaagcaacucaacuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugccaagaagcaagaggucgugguccucggcucacaggaaggagcuaugcacacugcccugacaggcgcuaccgagauccagaacagugggggaacaagcaucuucgccggucacuuaaagugucggcugaaaauggauaagcuagaacucaaaggcaugucuuacgcaaugugccugaauacuuuugugcuuaagaaagagguuuccgagacccagcaugggacgauuuugauaaagguggaauacaagggagaggacgcccccuguaaaaucccuuucucaaccgaagauggccaagguaaggcucacaacgggcgucugauuacagcgaacccaguagucacuaaaaaggaggagcccgugaauaucgaagcagagccgccuuucggcgaaagcaacauaguuauuggaaucggcgacaaagcccucaagaucaauugguauaagaaagggaguucuauuggaaagauguuugaggcuaccgcccgcggugcaagaaggauggccauccugggcgauacagcuugggacuucggguccgugggaggcguccuuaacagccuggguaaaauggugcaucagauuuuugggucggccuacacugcauuguucucuggcguauccuggauaaugaagaucggaauuggcgugcuccugaccuggaucggguuaaauucaaagaacacgaguaugagcuuuuccugcaucguuauuggaauaaucacacuguaucuaggcgcggucgugcaggcugauauggguugugccauuaauuggaaggggaaggaacucaaaugcggaucuggcaucuucgugaccaacgagguccacacuuggacagagcaguacaaguuucaagcagacagccccaaacggcuggccaccgcuauugccggugcaugggaaaauggcguuugugggauccgaucaacuacccgcauggagaaccuuuuguggaagcagauagcuaaugaacugaacuauauccucugggagaauaacauuaaacugacaguggugguaggagauaucauuggcgucuuagaacaggggaagagaacgcugaccccacagccuauggagcuuaaauacaguuggaagacuuggggaaaggccaaaaucgugacagcggagacccaaaauuccagcuucauaauugacggccccaacacaccagaaugccccucugccucaagggcuuggaacguuugggagguggaagacuaugguuuuggggucuucacuaccaauaucugguugaagcuccgggagguguacacgcagaguugugaucaucgccugaugagcgcagccauuaaagacgaaagagcugcccacgcagauaugggauacuggaucgagucccagaagaacggcucuuggaaacuagagaaggcgucguuuauagaaguuaagacaugcaccuggccuaaaagccacacucugugguccaauggugugcucgagucagacaugaucauuccaaagagucuggccggcccgaucucucagcauaaccacaggcccggguaucauacccaaacagcuggaccuuggcaccuuggcaaauuggaacuggauuucaauuacugcgaggggacuaccguagucauuacagagaacuguggaacgcguggccccagcuuacggaccacuacaguguccgguaagcucauccacgaauggugcugucgaucaugcacccugcccccucuuagauauaugggggaggacggauguugguacggcauggaaauaaggccaauuaaugagaaagaagagaacaugguaaagagccuggucucugccgguuccggcaagguugauaauuuuacuauggggguguugugccucgcaauccuguucgaggaaguaaugcgcggaaaauucggcaagaaacauaugaucgcuggggugcuauuuacauucguccugcuccugaguggacagauuaccuggcgggacauggcccacacgcuuaucaugauuggcagcaacgcaucugauagaauggguaugggggugacuuauuuggcccugauagcuaccuuuaagauccagcccuucuuagcgcucggauuuuuccugaggaaacuuacaucccgcgagaaucugcuacucggcguuggccuggccauggcaaccacuuugcaacugccggaagacauugagcagauggcuaacgggaucgccuuaggacucaugacacugaaacuuauuacccaguuugaaacauaccagcuguggacugccuuggugucacucaccuguaguaauacgaucuucacacugaccgucgcuuggcgaacugcaacccuaauacuggccggugugagccuucucccucugugccaaucguccucuaugcggaagacagauugguugccaaugacuguugcggcuaugggcgugcccccucugcccuuauuuaucuucagccucaaagacaccccaaagcguagaucauggccucugaacgagggggucauggccguaggacuugugaguauucuggcauccucuuugcucaggaaugauguucccauggccggcccacugguggcuggugggcuacugaucgcauguuaugucauuacgggaacaagcgccgaccuuaccguggagaaaccggcggacguaccuugggaagaggaagcugagcagacuggcgugucccauaaccucaugaucacagucgaugacgauggccccaugcgcauaaaggacgaugaaaccgagaacauucugacuguuuuguuaaaaacagcccugcucaucgugucagggaucuuuccauacagcauucccgcaacccugcuuguguggcacacguggcagaagcagacucaacggaguggaguccugugggacgugccuucuccacccgagacccagaaagccgaauuggaggaagguguuuacagaauaaagcagcagggcaucuucgggaagacacaaguaggagugggcguccagaaagaggguguguuucauaccauguggcacguuacaagaggggcugugcuaacucacaauggaaagcgacuggagccuaacugggccuccgucaaaaaggaucucauuagcuauggcggcggguggcgccugaaugcacaguggcaaaaaggagaagaggugcagguaaucgcugucgaaccggguaagaacccaaagaauuuccagaccaugcccggcauuuuccagacgacaacuggggagaucggagccauagcgcuugacuuuaaaccuggcaccucggguucaccaaucauuaaccgggaagggaaggugguuggauuauacggcaauggcguggucacuaaaaacgggggauaugugucugguaucgcccaaaccaaugcagagcccgauggcccuacuccggagcuggaagaggaaauguucaagaaaagaaaccucaccauuauggacuugcaucccgggaguggaaagacaaggaaguaccugccagcuaucguucgugaggccauaaaacgccggcucagaacgcugauucuugcuccuacuaggguggucgcagccgaaauggaggaggcccugaagggcuugcccauccgauaucagaccacagcuaccaaauccgaacacacuggucgggagaucguggaucuaaugugccaugcgacauuuaccaugcgccugcucagcccaguaagagugccuaauuacaacuuaguuauuauggacgaagcacacuucacggaucccgccucuaucgcugccaggggguauauaagcacucgggucggaaugggcgaggcagccgcuauuuuuaugacagcgaccccaccgggcaccgccgaagcauucccucaguccaaugcucccauccaggacgaggagcgagacauuccagaaagaucauggaacagugggaaugaguggaucacugauuuugugggaaagacagugugguucguccccagcauaaaagccgguaacgacauugcaaacugucugcgcaagaauggcaagaaaguaauccaacuuucuaggaagaccuuugauacagaauaccagaaaacucgucugaacgacugggauuucgugguuacgaccgacaucuccgagaugggggccaauuuuaaggcugaucgggugauugacccuagaaggugccucaaaccagucaucuugacagauggacccgagcgcgugauucuggccggcccuaugccgguuacugcggcaucagccgcucagcgaagaggucggguggggaggaacccacagaaggaaaaugaccaauacauauucaccggccagccccucaacaaugaugaggaccaugcccacuggacagaagcuaagaugcugcuugacaacaucaauaccccugagggaauuauccccgcacuauucgaaccagagcgcgagaaaagugccgcuaucgauggcgaauaucgucugaagggggagagcagaaaaacuuuugucgaauugaugcggaggggagacuuaccuguguggcuggcccacaagguagcauccgaggguauuaaauacacggaucgcaaguggugcuucgacggcgaacgaaacaaucagauacucgaggagaacauggauguggaaaucuggaccaaagagggggaaagaaagaagcugcggcccagguggcuugacgcgcgcacauauucugauccacuggcccucaaagaguuuaaggacuucgcugccggaagaaaaucgauugcauuggaucugguuacugaaaucggcagggucccuagccaucuagcucaccggacccguaaugcccuggacaaccucgugaugcuucauacaucagagcacggugggcgcgcauaccgacacgccguggaggaacugccggagaccauggaaacuuuauugcugcucggccugaugauucuucugacaggaggcgcuaugcucuuuuugaucuccgggaagggaauagguaaaacgaguaucggccugauuugugucaucguuucuagcgggauguuauggauggcggaugugccccuacaguggauugccuccgcaaucguacuggaguucuuuaugauggugcuccuuauaccagagccugaaaagcaaagaacaccacaggacaaucagcuggcuuaugucgugauuggaaucuugacucuggccgccauuguugcagcuaacgagaugggccuccuggaaacaaccaagagggaucuugguaugucaaaagagccagggguggucucuccuaccagcuaccucgacguagaccugcaucccgccagugcguggacauuguaugcuguggccacuacgguuaucaccccgaugcugcggcacacaauagaaaauuccacugcaaacgugagcuuagccgcuaucgcaaaccaagccgucgugcuaaugggccuggauaagggauggccaauuucuaaaauggaccucggcgucccucuucuggcguuggggugcuacucacaggugaauccccugacccucacagcugccguucugcuuuuagugacccauuacgcaaucauuggaccaggccugcaggccaaggcuacucgcgaggcccagaaaagaacggcagcugguaucaugaagaaccccacaguagaugggauaaugaccauugaccucgauccugugaucuaugacuccaaguucgagaaacaauugggacaggucaugcugcuaguucugugugccgugcagcuccuucugaugaggacaaguugggcguugugcgaagcccugacccucgcaacaggcccgaucacuacccugugggaggguagccccggcaaguuuuggaauacaacgauugcugucucgauggccaacaucuuccgggggucuuacuuagcaggagcuggccuugccuuuuccauaaugaaaagcguggggaccggacgaagaggcacugguucacagggggaaacacugggagagaaguggaaaaagaagcucaaucaacuaagucgcaaagaguucgaucuguauaagaaaucuggcauuaccgagguagacaggacugaggccaaggaagguuugaaacggggcgagacaacccaccaugcggugucccgugggagcgcuaagcugcagugguuuguugaaagaaacauggugaucccagagggaagggucauugaucucggcugugggcgcggaggcuggucauacuauugcgcaggucuuaaaaaggugacggaaguccggggguacaccaagggaggcccuggccacgaggagcccgugccuaugaguacauauggguggaauaucguuaaacugaugagcggaaaggacguauucuacuugccacccgaaaaaugugauacucugcucugcgacauaggugaguccucuccuagcccaaccguggaagagucccgaacaaucagagucuuaaagaugguggagcccuggcugaggaacaaucaguucuguauuaaaguucuuaacccguacaugccuacugugaucgaacaccuggagcgccuacagcggaaguauggcgggaugcucgucagaaauccacugucacguaacucuacccaugaaauguacuggauuaguaauggaacaggcaacaucgugucgagcguaaauaugguguccagguugcugcucaaccgguuuaccaugacucaccgccgacccacgauugagaaggauguugaccuuggugccgggacaagacaugucaacgcugaaccugagaccccaaauauggacgugaucggagagaggauaaaacggauuaaggaagaacacucuucaacuuggcacuaugaugacgaaaaccccuacaaaaccugggccuaucauggcagcuacgaggugaaggcaacaggcuccgccaguucuaugaucaauggggucguuaaacuguuaacgaagccgugggaugugguaccuauggugacccaaauggcuaugacugacacaacccccuucggacagcagcgcgucuuuaaggaaaaaguggauacuagaacaccaaggccuaugcccgguacccgaaagguuauggagaucacagcggaguggcuguggcggacuuugggccguaacaaaaagccaagacucugcacccgcgaagaguucacgaaaaaggugaggaccaaugccgcaaugggggcugucuuuacagaagagaaccaaugggacagcgcccgggcagccguggaagaugaggaguucuggaagcugguagacagagaacgcgagcuacacaaacuuggaaaguguggcucaugcguuuauaauaugauggguaaaagggaaaagaaacugggggaguuuggaaaggcuaaaggcucccgagccauuugguacauguggcucggcgcgcgguaccuggaguucgaagcauugggguuucugaacgaggaucauugguucaguagagaaaauagcuauucuggaguggagggugaaggccuccacaaacuuggguacauacugagggacaucuccaagauucccggaggcgccauguaugcugaugacacugccgguugggacacccgcaucacagaggaugacuuacauaacgaggagaaaauuacugcacagauggauccugagcaccgucagcuggcuaaugccaucuuuaaguugaccuaccagaacaaagucgugaaggugcaacggccaacgccgaaagggacagucauggacauaaucucaagaaaggaucagaggggaagcggccagguuggcaccuaugggcucaauacuuucacaaacauggaagcucagcuggugcgccaaauggagggagaagguguacuaucgaaggccgaccuugagaauccccaucugcucgagaaaaagauuacccaguggcuggaaacuaaaggcguggagcgauugaagcggauggcaaucucuggggaugacugcgucgugaaaccuauugaugacagauuugcgaacgccuuacuggcucucaacgauaugggaaagguuaggaaggacaucccacaguggcagcccaguaaaggcuggcaugauuggcaacaggugccuuucuguucccaccauuuccacgaacuuauaaugaaggacggucgcaaacuggucgugccaugcagaccccaggacgagcuaauugggcgggccaggaucagccagggagcaggcuggucacugaaggaaaccgcuugucucggcaaagccuacgcacaaaugugguccuugauguauuuucaccgucgagaucugcgccuugccucuaaugcgaucugcagcgcuguaccuguucauuggauuccgacaaguagaacgaccugguccauacacgcccaucaccaguggaugacuacagaggacaugcugaccguguggaaccgggucuggaucgaggauaauccauggauggaagacaagacucccgugacaaccugggaggauguuccuuaccucgggaagagggaagaccagugguguggcagcuuaauuggucugacgucucgcgcaacaugggcccaaaacaucuugaccgcuauucaacaggugagaucacugaucggcgaugaggaguuccucgacuacaugcccaguaugaaacgguuuaggaaggaagaggaauccgagggggccauaugguga

SEQ ID NO: 15238 - RNA, 9873 nt, Artificial Sequence
  derived and/or modified CDS sequence (opt3) from DENV-3__GQ868628__SS-prME
accagccugugccucaugaugaugcuuccagcaacacuggcuuuccacuugacuuccagggacggcgaaccuaggaugaucguggggaagaacgaacggggaaaaucuuuacuguuuaagacggcaucagguauuaauauguguacccuaauagcaauggaucucggcgagaugugcgacgauacaguaacuuacaaauguccacugaucgcggaaguugagccggaagacauugauugcugguguaaccuuaccaguacaugggugaccuaugggacuugcaaucaggcuggagagcaccgccgagacaagcguagcguagcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaaaagcaaacccacacucgacaucgagcugcagaagaccgaagcaacucagcuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugccaagaagcaagaggucgugguccucggcucacaggaaggagcuaugcacacugcccugacaggcgcuaccgagauccagaacagugggggaacaagcaucuucgccggucacuuaaagugucggcugaaaauggauaagcuagaacucaaaggcaugucuuacgcaaugugccugaauacuuuugugcuuaagaaagagguuuccgagacccagcaugggacgauuuugauaaagguggaauacaagggagaggacgcccccuguaaaaucccuuucucaaccgaagauggccaagguaaggcucacaacgggcgucugauuacagcgaacccaguagucacuaaaaaggaggagcccgugaauaucgaagcagagccgccuuucggcgaaagcaacauaguuauuggaaucggcgacaaagcccucaagaucaauugguauaagaaagggaguucuauuggaaagauguuugaggcuaccgcccgcggugcaagaaggauggccauccugggcgauacagcuugggacuucggguccgugggaggcguccuuaacagccuggguaaaauggugcaucagauuuuugggucggccuacacugcauuguucucuggcguauccuggauaaugaagaucggaauuggcgugcuccugaccuggaucggguuaaauucaaagaacacgaguaugagcuuuuccugcaucguuauuggaauaaucacacuguaucuaggcgcggucgugcaggcugauauggguugugugauuaauuggaaggggaaggaacucaaaugcggaucuggcaucuucgucaccaacgagguucacacuuggacagagcaguacaaguuucaagccgacagccccaaacggcuggcaaccgccauugcuggugccugggaaaauggcgugugugggauccgaucaacuacccgcauggagaaccuuuuguggaagcagauagcaaaugaacugaacuauauccucugggagaauaacauuaaacugacagugguagucggagauaucauuggcguguuagaacaggggaagagaacgcugaccccacagccuauggagcuuaaauacaguuggaagacuuggggaaaggcuaaaaucguuacagccgagacccaaaauuccagcuucauaauugacggccccaacacaccagaaugccccucugcgucaagggccuggaacgugugggaggucgaagacuaugguuuugggguguucacuaccaauaucugguugaagcuccgggagguuuacacgcagaguugugaucaucgccugaugagcgcugcaauuaaagacgaaagagccgugcacgcugauaugggauacuggaucgagucccagaagaacggcucuuggaaacuagagaaggccucguuuauagaaguaaagacaugcgcauggccuaaaagccacacccugugguccaaugguguccucgagucagacaugaucauuccaaagagucuggcgggcccgaucucucagcauaaccacaggcccggguaucauacucaaaccgccggaccuuggcaccuuggcaaauuggaacuggauuucaauuacugcgaggggacaacuguggugauuaccgagaacuguggaacacguggccccagcuuacggacgaccacugucuccgguaagcucauccacgaauggugcugucgaucaugcacacugcccccucuuagauauaugggggaggacggauguugguacggcauggaaauaaggccaauuaaugagaaagaagagaacaugguuaagagccuggugucugcugguuccggcaagguagauaauuuuaccauggggguguugugccucgccauccuguucgaggaagucaugcgcggaaaauucggcaagaaacauaugaucgcaggggugcuauuuacuuucguucugcuccugaguggacagauuacauggcgggacauggcucacacccuuaucaugauuggcagcaacgccucugauagaauggguaugggggugacguauuuggcacugauagccacuuuuaagauccagcccuucuuagcucucggauuuuuccugaggaaacuuaccucccgcgagaaucugcuacucggcgucggccuggcgauggccacaaccuugcaacugccggaagacauugagcagauggcaaacgggaucgcuuuaggacucaugacucugaaacuuauuacacaguuugaaaccuaccagcuguggacagccuuggugucacucacuuguaguaauaccaucuucacgcugacaguugccuggcgaaccgcuacucuaauacuggccggugugagccuucucccucugugccaaucguccucuaugcggaagaccgauugguugccaaugacagucgccgcgaugggcguacccccucugcccuuauuuaucuucagccucaaagacacuccaaagcguagaucauggccucugaacgagggggugauggcuguuggacuugugaguauucuggccuccucuuugcucaggaaugauguccccauggcaggcccacugguggccggugggcuacugaucgcuuguuauguaauuaccggaacgagcgcagaccuuacaguggagaaagccgcggacgucaccugggaagaggaagcugagcagacuggcguuucccauaaccucaugaucacaguggaugacgauggcaccaugcgcauaaaggacgaugaaacugagaacauucugacaguguuguuaaaaaccgcccugcucaucgucucagggaucuuuccguacagcauuccugcaacgcugcuuguguggcacacuuggcagaagcagacccaacggaguggaguucugugggacguacccucuccacccgagacacagaaagccgaauuggaggaagguguguacagaauaaagcagcagggcaucuucgggaagacccaagucggagugggcguucagaaagaggguguguuucauacaauguggcacgucacuagaggggcugugcuaacccacaauggaaagcgacuggagccuaacugggccuccgucaaaaaggaucucauuagcuauggcggcggguggcgccugucggcacaguggcaaaaaggagaagagguccaggugaucgcuguugaaccagguaagaaucccaagaacuuccagacgaugccuggcauuuuccagacaacuaccggggagaucggagccauagcgcuugacuuuaaaccgggcacaucagguucuccaaucauuaaucgggaagggaagguggucggauuauacggcaacggcgugguuaccaaaaaugggggauaugugagugguaucgcccaaacuaacgcagagcccgauggcccuaccccagagcuggaagaggaaauguucaagaaaagaaaucucacaauuauggacuugcaucccggguccggaaagacgaggaaguaccugccugcuaucguccgugaggccauaaaacgccggcucagaacucugauucuugcuccgaccagggugguagcagccgaaauggaggaggcccugaagggcuugcccauccgauaucagacaaccgcuacuaaaagcgaacacacaggucgggagaucguggaucuaaugugccaugcgaccuuuacgaugcgccugcucucuccaguuagagucccuaacuacaauuuagugauuauggacgaagcacacuucacugaucccgccagcaucgcugccaggggguauauauccacacgggugggaaugggcgaggcagccgcuauuuuuaugaccgcgaccccaccuggcacugccgaagcauucccccagucaaacgcuccaauccaggacgaggagcgagacauuccggaaagaaguuggaauagcgggaacgaguggaucacagauuuugucggaaagaccguaugguucgugccuucuauaaaagccgguaaugacauugcaaacugucugcgcaagaacggcaagaaaguuauccaacuuuccaggaagacauuugauacugaauaccagaaaacgcgucugaaugacugggauuucguggucaccacagacaucucagagaugggggccaacuuuaaggcugaucgggugauugaccccagaaggugccucaaaccaguuaucuugacugauggacccgagcgcgugauucuggccggcccuaugccagucaccgcggcaagugccgcucagcgaagaggucggguggggaggaauccccagaaggaaaacgaccaauacauauucacaggccagccucucaauaacgaugaggaccaugcccacuggaccgaagcuaagaugcugcuugacaauaucaacacuccggagggaauuaucccagcacuauucgaacccgagcgcgagaaaagcgccgcuaucgauggcgaauaucgucugaagggggaguccagaaaaacguuuguagaauugaugcggaggggagacuuaccuguguggcuggcccacaagguugcaucugaggguauuaaauacaccgaucgcaaguggugcuucgacggcgaacgaaauaaccagauacucgaggagaauauggaugucgaaaucuggacaaaagagggggaaagaaagaagcugcggcccagguggcuugacgcgcgcacuuauucggauccacuggcccucaaagaguuuaaggacuucgcugccggaagaaaaagcauugcauuggaucuggugaccgaaaucggcagggugccuucacaucuagcucaccggacacguaacgcccuggacaaucucgucaugcuucauaccuccgagcacggugggcgcgcauaccgacacgccguugaggaacugcccgagacuauggaaacauuauugcugcucggccugaugauucuucugacgggaggcgcuaugcucuuuuugaucagugggaagggaauagguaaaaccucuaucggccugauuugugugaucguaagcuccgggauguuauggauggcggaugugccacuacaguggauugccucagcaaucguccuggaguucuuuaugauggugcuccuuauaccugagccggaaaagcaaagaacuccccaggacaaccagcuggcuuauguugugauuggaaucuugacacuggccgccauugucgcagcuaaugagaugggccuccuggaaaccaccaagagggaucuugguaugucuaaagagccagggguagugagcccuacaaguuaccucgacguugaccugcaucccgccuccgcguggacuuuguaugcuguggccacgaccgucaucacaccaaugcugcggcacacuauagaaaacagcaccgcaaaugugucuuuagccgcuaucgcaaaccaagccgucgugcuaaugggccuggauaagggauggccuauuucaaaaauggaccucggcguuccccuucuggcguuggggugcuacucccaggugaacccgcugacacucaccgcugccguacugcuuuuagugacucauuacgcaaucauuggaccaggccugcaggccaaggcuacgcgcgaggcccagaaaagaacagcagcugguaucaugaagaauccuaccgucgaugggauaaugacuauugaccucgaucccguuaucuaugacaguaaguucgagaaacaauugggacaggugaugcugcuaguccugugugccgugcagcuccuucugaugaggaccagcugggcguugugcgaagcccugacacucgcaacuggcccaaucaccacacugugggaggguucgcccggcaaguuuuggaacacgaccauugcuguaucuauggccaauaucuuccggggguccuacuuagcaggagcuggccuugccuuuagcauaaugaaaucaguggggacuggacgaagaggcacagguagucagggggaaacccugggagagaaguggaaaaagaagcucaaccaacuaucucgcaaagaguucgaucuguauaagaaauccggcauuacugagguugacaggacagaggccaaggaagguuugaaacggggcgagaccacgcaccaugcggugagccgugggucagcuaagcugcagugguuugucgaaagaaauauggugaucccugagggaagggucauugaucucggcugugggcgcggaggcuggaguuacuauugcgcaggucuuaaaaaggugaccgaaguucggggguacacaaagggaggcccgggccacgaggagcccguaccaaugagcacuuauggguggaacaucgugaaacugauguccggaaaggacgucuucuacuugccucccgaaaaaugugauacccugcucugcgacauaggugagucuagcccuuccccaacaguggaagagucacgaacuaucagaguuuuaaagaugguggagcccuggcugaggaauaaccaguucuguauuaaaguccuuaauccuuacaugccaaccgugaucgaacaccuggagcgccuacagcggaaguauggcgggaugcucguaagaaacccccugucucguaauaguacacaugaaauguacuggauuucgaacggaaccggcaauaucgugagcuccguuaacauggucucuagguugcugcucaaucgguuuacuaugacgcaccgccgaccgacaauugagaaggauguggaccuuggugccgggaccagacaugugaacgcugaaccugagacuccaaacauggacgucaucggagagaggauaaaacggauuaaggaagaacacucaagcaccuggcacuaugaugacgaaaaucccuacaaaacaugggccuaucauggcuccuacgagguuaaggcaacgggcagugccucuagcaugaucaacggggugguaaaacuguuaaccaagccuugggauguggucccaauggugacucaaauggcuaugacagacaccacucccuucggacagcagcgcguuuuuaaggaaaaaguggauacaagaaccccgaggccuaugcccgguacacgaaaggucauggagaucacugcggaguggcuguggcggaccuugggccguaauaaaaagccaagacucugcacgcgcgaagaguucaccaaaaaggugaggacaaacgccgcaaugggggcuguauuuacugaagagaaucaaugggacucagcccgggcagccguugaagaugaggaguucuggaagcugguggacagagaacgcgagcuacacaaacuuggaaaguguggcuccugcgucuauaacaugauggguaaaagggaaaagaaacugggggaguuuggaaaggcuaaaggcagucgagccauuugguacauguggcucggcgcgcgguaccuggaguucgaagcauugggguuucugaaugaggaucauugguucagcagagaaaacucuuauuccggaguggagggugaaggccuccacaaacuuggguacauacugagggacaucucaaagauuccuggaggcgccauguaugcugaugacaccgccgguugggacacacgcaucacugaggaugacuuacauaaugaggagaaaauuacccagcagauggaucccgagcaccgucagcuggcaaacgcuaucuuuaaguugacguaccaaaauaaaguggucaagguucagcggccaacacccaaagggaccgugauggacauaaucagcagaaaggaucagaggggaucgggccagguaggcacuuaugggcucaacacauucaccaauauggaagcccaacuggugcgccagauggagggagaagguguccuaucuaaggcugaccuugagaacccucaucugcucgagaaaaagauuacucaguggcuggaaaccaaaggcguggagcgauugaagcggauggccaucaguggggaugacugcguugugaaaccaauugaugacagauuugcaaaugcguuacuggcccucaacgauaugggaaaggucaggaaggacaucccgcaguggcaacccuccaaaggcuggcaugauuggcaacaggugccuuucuguagccaccauuuccacgaacuuauaaugaaggacggucgcaaacugguaguuccaugcagaccccaggacgagcuaauugggcgggcuaggaucucacaaggagccggcuggucccugaaggaaacagcaugucucggcaaggcuuacgcccagauguggucuuugauguauuuucaccgucgagaucugcgccuugcaagcaacgccaucugcagugcggugccuguccauuggauuccaacguccagaaccacuuggagcauacacgcucaucaccaguggaugacaaccgaggacaugcugacuguguggaaucggguuuggaucgaggauaaccccuggauggaagacaagacaccugugaccacgugggaggaugucccguaccucgggaagagggaagaccaaugguguggaucuuuaauuggucugacaucacgcgccaccugggcacagaauaucuugacugccauucaacaggugagaagucugaucggcgaugaggaguuccucgacuacaugccauccaugaaacgguuuaggaaggaagaggaaagcgagggggcuauaugguga

SEQ ID NO: 15239 - RNA, 9873 nt, Artificial Sequence
  derived and/or modified CDS sequence (opt3) from DENV-3__FJ639727__SS-prME
accagccugugccucaugaugaugcuucccgccacucuggcuuuccacuugacuuccagggacggcgaaccuaggaugaucguggggaagaaugaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcgucgcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcaaagagcaaacccacacucgacaucgagcugcagaagaccgaagcaacucagcuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugccaagaagcaagaggucgugguccucggcucacaggaaggagcuaugcacacugcccugacaggcgcuaccgagauccagaacagugggggaacaagcaucuucgccggucacuuaaagugucggcugaaaauggauaagcuagaacucaaaggcaugucuuacgcaaugugccugaauacuuuugugcuuaagaaagagguuuccgagacccagcaugggacgauuuugauaaagguggaauacaagggagaggacgcccccuguaaaaucccuuucucaaccgaagauggccaagguaagagccacaacgggcgucugauuacagcuaacccaguagucacuaaaaaggaggagcccgugaauaucgaagcggagccgccuuucggcgaaaguaacauaguuauuggaaucggcgacaaagcacucaagaucaauugguauaagaaagggucuuccauuggaaagauguuugaggccaccgcucgcggugccagaaggauggcaauccugggcgauacagccugggacuucgggagcgugggaggcguccuuaacucgcuggguaaaauggugcaucagauuuuugggucugcuuacacugccuuguucuccggcguaucauggauaaugaagaucggaauuggcgugcuccugaccuggaucggguuaaauaguaaaaacacgagcauguccuuuucuugcaucguuauuggaauaaucacacuguaucuaggcgcagucgugcaggcggauauggguugugugauuaauuggaaggggaaggaacucaaaugcggaagcggcaucuucgucaccaacgagguucacacuuggacagagcaguacaaguuucaagcugacucacccaaacggcuggccaccgcaauugccggugcuugggaaaauggcgugugugggauccgaaguacuacccgcauggagaaccuuuuguggaagcagauagccaaugaacugaacuauauccucugggagaauaacauuaaacugacagugguagucggagauaucauuggcguguuagaacaggggaagagaacgcugaccccacagccuauggagcuuaaauacuccuggaagacuuggggaaaggcaaaaaucguuacagcugagacccaaaauagcucuuucauaauugacggccccaacacaccagaaugccccucagccaguagggcguggaacgugugggaggucgaagacuaugguuuugggguguucacuaccaauaucugguugaagcuccgggagguuuacacgcagagcugugaucaucgccugauguccgccgcuauuaaagacgaaagagcagugcacgccgauaugggauacuggaucgagucucagaagaacggcucguggaaacuagagaaggcuagcuuuauagaaguaaagacaugcaccuggccuaaaucccacacucuguggucaaaugguguccucgagagugacaugaucauuccaaagucucuggccggcccgaucagccagcauaaccacaggcccggguauuacacccaaacagcaggaccuuggcaucuuggcaaauuggaacuggauuucaauuauugcgaggggacuaccguggugauuacagagaacuguggaacgcguggcccauccuuacggaccacuacagucucagguaagcucauccacgaauggugcugucgaagcugcacccugcccccucuuagauacaugggggaggacggauguugguauggcauggaaauaaggccaauuaaugagaaagaagagaacaugguuaagucucugguguccgcggguaguggcaagguagauaauuuuacuauggggguguugugccucgccauccuguucgaggaagucaugcgcggaaaauucggcaagaaacacaugaucgcuggggcccuauuuacauucgugcugcuccugagcggacagauuaccuggcgggacauggcacauacgcuuaucaugauuggcucuaacgcuuccgauagaauggguauggggguuacuuacuuggcccugauagcaaccuuuaagauccagcccuucuuagcccucggauuuuuccugaggaaacuuacaucacgcgagaaucugcuacucggcgugggccuggcuauggcgaccacuuugcaacugccggaagacauugagcagauggccaacgggaucgcauuaggacucaugacacugaaacuuauuacccaguuugaaacauaucagcuguggacugcuuuggucagucucaccuguagcaauacgaucuucacacugaccguggccuggcgaacugccacccuaauacuggcugguguuucgcuucucccucugugccaauccucuagcaugcggaagacagauugguugccaaugacuguggcagccaugggcguacccccucugcccuuauuuaucuucucacucaaagacaccccaaagcguagaaguuggccucugaacgaggggguaauggcggugggacuuguuuccauucuggcuucuagcuugcucaggaaugaugugcccauggccggcccacuggucgcgggugggcuacugaucgccuguuacgugauuacgggaacauccgcugaccuuaccguagagaaagcagccgacgugacuugggaagaggaagcggagcagacaggcgucucacacaaccucaugaucaccguugaugacgauggcacuaugcgcauaaaggacgaugaaacagagaacauucugaccguguuguuaaaaacggcucugcucaucgugagcgggaucuuuccguacaguauuccugccacucugcuugucuggcauaccuggcagaagcagacacaacggucuggagugcugugggacguucccuccccacccgagacccagaaagcagaauuggaggaagguguauauagaauaaagcagcagggcaucuucgggaagacacaagugggagucggcgugcagaaagaggguguuuuucacacuauguggcaugugacccgaggggcaguccuaacgcacaauggaaagaggcuggagccuaacugggcuagcgugaaaaaggaucucauuucguacggcggcggguggcgccugucagcccaguggcaaaaaggagaagagguacaggucaucgcaguggaaccagguaagaaucccaagaacuuccagacaaugccuggcauuuuccagacuaccacaggggagaucggagcuauagcccuugacuuuaaaccgggcaccucugguaguccaaucauuaaucgggaagggaagguugugggauuauauggcaacggcgucgugacuaaaaaugggggauacguuuccgguaucgcgcaaaccaacgccgagcccgauggcccuacaccagagcuggaagaggaaauguucaagaaaagaaaucucacgauuauggacuugcaccccgggagcggaaagacuaggaaguaucugccugcaaucgugcgugaggcuauaaaacgccggcucagaacccugauucuugccccgacaagggucguggcugcagaaauggaggaggcccugaagggcuugcccauccgauaccagaccacugccacaaaaucugaacauaccggucgggagaucguagaucuaaugugccacgcuacguuuacuaugcgccugcucagcccagugagaguuccuaacuauaauuuagucgugauggacgaagcgcauuucacagaucccgcauccauugccgcuaggggguacaucucaacccgggugggaaugggcgaggccgcagccauauuuaugaccgcuacuccaccuggcacagcggaagccuucccccagaguaacgcaccaauucaggacgaggagcgagacaucccggaaagaagcuggaacucugggaacgaguggauuaccgauuuugucggaaagacaguaugguucgugccuuccaucaaagcugguaaugacauagccaacugucugcgcaagaacggcaagaaaguuauucaacuuucaaggaagacuuuugauacggaauaccagaaaacccgucugaaugacugggauuucguggucacaacugacaucagugagaugggggcaaacuuucgggccgauagagugaucgaccccaggcgcugccucaagccaguuauuuugaccgauggacccgagcgagugauccuggcuggcccuaugccagucacagccgcgagcgcagcccagagacgggguaggguggggcgcaauccccagaaagaaaacgaccaauauauuuucaccggccagccucucaauaacgaugaggaccacgcucauuggacugaagccaagaugcugcuugacaauauaaacacgccggagggaaucauuccagcucuauucgaacccgagcgugagaaguccgcagccaucgauggcgaauacagacugaaaggggagucucggaagaccuuuguagaauugaugaggcgcggagacuuaccuguguggcuggcucacaaaguugccucggaggguaucaaguauacagaucgaaaauggugcuucgacggcgaaagaaauaaccagauucucgaggagaauauggaugucgaaauauggacuaaggagggggaacggaaaaagcugaggccccgcuggcuugacgcaagaaccuacagcgauccacuggcgcucaaggaguuuaaagacuucgccgcuggaaggaagucaaucgccuuggaucuggugacagaaauuggccgggugccuucccaccuagcacaucguacccgcaacgcucuggacaaucucgucaugcuucacacaagugagcauggugggcgagccuauagacacgcaguugaggaacugcccgagacaauggaaacguuauugcugcucggccugaugauccuucugaccggaggcgccaugcucuuuuugauuucugggaaaggaaucgguaagacuagcauaggccugaucugugugauuguauccucagggauguuauggauggcugaugugccacuacaguggaucgcgucugccauuguccuggaguucuuuaugauggugcuccuuaucccugagccggaaaaacaaaggacaccccaggacaaccagcuggcauacguugugauaggaauuuugacccuggcugccaucgucgccgcaaaugagaugggccuccuggaaaccacaaagcgggaucuugguaugagcaaggagccagggguagugaguccuacuuccuaucucgacguugaccugcaccccgcuagcgccuggacguuguacgcgguggcuaccacagucauuacuccaaugcugcgccauaccaucgaaaacucuacagccaaugugucauuagcagccauagcuaaccaagcagucgugcuaaugggccuggauaaaggauggccuaucuccaagauggaccucggcguuccccuucuggccuuggggugcuacagucaggugaacccgcugacccucacugcggcuguacugcuuuuagugacgcacuaugccauuaucggaccaggccugcaggcaaaagccacaagagaggcucagaagaggaccgccgcagguauuaugaaaaauccuacugucgaugggaucaugaccauagaccucgaucccguuauuuacgacagcaaguucgagaagcaauugggacaggugaugcugcuaguccugugugcugugcagcuccuucugaugcggacaucgugggccuugugcgaagcgcugacucucgccaccggcccaaucacaacgcugugggaggguucucccggcaaauuuuggaacaccacuaucgcaguauccauggcuaauauuuuccgagggagcuauuuagccggagcaggccuugcuuuuucaaucaugaagaguguggggacaggaagacgcggcaccgguucucagggggaaacucugggagagaaauggaagaaaaagcucaaccaacuauccaggaaggaguucgaucuguacaaaaagagcggcauaacagagguugaccggaccgaggccaaagaagguuugaagcguggcgagacgacccaucacgccgugucaagagggagugcgaaacugcagugguuugucgaaaggaauauggugauuccugagggacgcgucaucgaucucggcugugggcggggaggcuggagcuauuacugcgcuggucuuaagaaagugacagaaguucgaggguauacuaagggaggcccgggccaugaggagcccguaccaauguccaccuacggguggaacauugugaagcugaugucuggaaaagacgucuucuacuugccucccgaaaagugugauacacugcucugcgacaucggugagagcuccccuucaccaacuguggaagagucuagaaccauaaggguuuuaaaaaugguggagcccuggcugcgcaauaaccaguucuguaucaagguccuuaauccuuauaugccaacagugauugaacaccuggagcggcuacagagaaaauacggcgggaugcucguacguaacccccugaguagaaauucgacccacgaaauguauuggaucagcaacggaacuggcaauauuguguccucuguuaacauggucucacgguugcugcucaaucgcuuuacgaugacacaucgaagaccgaccaucgagaaggauguggaccuuggugcagggacuaggcacgugaacgccgaaccugagaccccaaacauggacgucauuggagagcggaucaagcgcauaaaagaagaacacagcuccacauggcacuacgaugacgaaaaucccuauaagacgugggcuuaccacggcaguuaugagguuaaagccaccggcucugcaagcucaaugauuaacggggugguaaagcuguuaacuaaaccuugggauguggucccaauggugacacaaauggccaugaccgacacuacacccuucggacagcagagaguuuuuaaggaaaagguggauaccaggacaccgcgaccuaugcccgguacucggaaagucauggagaucaccgcugaguggcuguggcguacguugggcagaaauaagaaaccacgccucugcaccagggaagaguucacaaagaaagugcggacuaacgcggccaugggggcaguauuuaccgaagagaaucaaugggacuccgcuagagccgcaguugaagaugaggaguucuggaagcugguggaccgcgaaagggagcuacauaaacuuggaaaauguggcaguugcgucuacaacaugauggguaagcgagagaagaagcugggggaguuuggaaaagccaagggcagccgggcuaucugguacauguggcucggcgccagauaucuggaguucgaagcguugggguuucugaaugaggaucacugguucucuagggaaaacuccuacucaggaguggagggugaaggccuccauaaacuuggguauauucugcgcgacauaagcaagaucccuggaggcgcaauguacgccgaugacacagcugguugggacacucguauuaccgaggaugacuuacacaaugaggaaaagaucacgcagcagauggaucccgagcaucggcagcuggccaacgcaauuuuuaaauugacauaucaaaauaagguggucaaaguucagagaccaacccccaaggggacugugauggacaucauaucgaggaaagaucagcgcggaucuggccagguaggcacauacgggcucaacaccuucacuaauauggaagcucaacuggugcgacagauggagggagaagguguccuaaguaaggccgaccuugagaacccucaucugcucgagaagaaaaucacccaguggcuggaaacaaagggcguggagcgguugaaaagaauggcuauuuccggggaugacugcguugugaagccaaucgaugacagguuugccaaugcauuacuggcgcucaacgauaugggaaaaguccgcaaggacauuccgcaguggcaacccagcaagggcuggcacgauuggcaacaggugccuuucuguucacaucacuuccaugaacuuaucaugaaagacgguagaaagcugguaguuccaugccggccccaggacgagcuaauagggagggcccguauuucccaaggagcuggcuggucucugaaagaaacggccugucucggcaaggcauaugcucagauguggagcuugauguacuuucaccgacgcgaucugagacuugccaguaacgcaaucugcuccgccgugccuguccacuggaucccaaccagccggacuacauggucuauucaugcgcaccaucaguggaugaccacugaggacaugcugacaguguggaauaggguuuggauagaggauaaccccuggauggaagacaaaaccccugugacgacaugggaggaugucccguaccucgggaagcgcgaagaccaaugguguggaucauuaaucggucugaccaguagagcuacuugggcccagaauauuuugaccgcaauccaacaggugcggucccugauuggcgaugaggaguuccucgacuauaugccaagcaugaagagguuucgaaaagaagaggaaucugagggggccaucugguga

SEQ ID NO: 15240 - RNA, 9873 nt, Artificial Sequence
  derived and/or modified CDS sequence (opt3) from DENV-3__GQ868629__SS-prME
acaagccugugccucaugaugaugcuuccagccacacuggcuuuccacuugacuuccagagacggcgaaccuaggaugaucguggggaagaacgaacggggaaaaucuuuacuguuuaagacggcaucagguauuaauauguguacccuaauagccauggaucucggcgagaugugcgacgauacaguaacuuacaaauguccacugaucgcggaaguugagccggaagacauugauugcugguguaaccuuaccaguacaugggugaccuaugggacuugcaaucaggcuggagagcaccgccgagacaagcguagcguagcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcaaagagcaaacccacacucgacaucgagcugcagaagaccgaagcaacucagcuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaucaccgagacuccaacauggaacaggaaagaacuguuggugacguuuaagaaugcccaugccaagaagcaagaggucgugguccucggcucacaggaaggagcuaugcacaccgcccugacuggcgcuacagagauccagaacagugggggaaccagcauuuucgccggucacuuaaagugucggcugaaaauggauaagcuagaacucaaaggcaugucuuacgcaaugugccugaauacauuugugcuuaagaaagagguuuccgagacucagcaugggaccauauugaucaagguggaauacaagggagaggacgcccccuguaaaauuccuuucucaacggaagauggccaagguaaggcucacaacgggcgucugaucaccgcgaacccaguagucaccaaaaaggaggagcccgugaauauagaagcagagccgccuuucggcgaaagcaacauuguuaucggaaucggcgacaaagcccucaagauuaauugguauaagaaagggaguucuaucggaaagauguuugaggcuacugcccgcggugcaagaaggauggccauucugggcgauaccgcuugggacuucggguccgugggaggcguccuuaacagccuggguaaaauggugcaucagauauuugggucggccuacacagcauuguucucuggcguauccuggaucaugaagauuggaaucggcgugcuccugacuuggaucggguuaaauucaaagaacaccaguaugagcuuuuccugcauuguuauaggaaucauuacgcuguaucuaggcgcggucgugcaggcugauauggguugugugaucaauuggaaggggaaggaacucaaaugcggaucuggcauuuucgucacaaacgagguucacaccuggacugagcaguacaaguuucaagccgacagccccaaacggcuggcaacagccaucgcuggugccugggaaaauggcgugugugggauacgaucaaccacucgcauggagaaccuuuuguggaagcagaucgcaaaugaacugaacuauauucucugggagaauaacaucaaacugaccgugguagucggagauauuaucggcguguuagaacaggggaagagaacacugacgccacagccuauggagcuuaaauacaguuggaagaccuggggaaaggcuaaaauaguuacugccgagacacaaaauuccagcuucauuaucgacggccccaacaccccagaaugccccucugcgucaagggccuggaacgugugggaggucgaagacuaugguuuugggguguucacaacuaauauuugguugaagcuccgggagguuuacacccagaguugugaucaucgccugaugagcgcugcaaucaaagacgaaagagccgugcacgcugauaugggauacuggauagagucccagaagaacggcucuuggaaacuagagaaggccucguuuaucgaaguaaagacgugcacauggccuaaaagccacacccugugguccaaugguguccucgagucagacaugauuaucccaaagagucuggcaggcccgauuucucagcauaaccacaggcccggguaucauacucaaaccgcgggaccuuggcaccuuggcaaauuggaacuggauuucaauuacugcgaggggacaacuguggugaucaccgagaacuguggaacacguggccccagcuuacggacgaccacugucuccgguaagcucauacacgaauggugcugucgaucaugcacacugcccccucuuagauauaugggggaggacggauguugguacggcauggaaauuaggccaaucaaugagaaagaagagaacaugguuaagagccuggugucugccgguuccggcaagguagauaauuuuaccauggggguguugugccucgcuauccuguucgaggaagucaugcgcggaaaauucggcaagaaacauaugauugccggggugcuauuuacuuucguucugcuccugaguggacagaucacauggcgggacauggcacacacccuuauuaugauaggcagcaacgcuucugauagaauggguaugggggugacguauuuggcccugaucgcaacuuuuaagauucagcccuucuuagcccucggauuuuuccugaggaaacuuaccucccgcgagaaucugcuacucggcgucggccuggcuauggcgacaaccuugcaacugccggaagacaucgagcagauggccaacgggauugcauuaggacucaugacucugaaacuuaucacacaguuugaaaccuaccagcuguggacagcuuuggugucacucacuuguaguaauaccauauucacgcugacaguugccuggcgaaccgccacucuaauccuggcuggugugagccuucucccucugugccaaucguccucuaugcggaagaccgauugguugccaaugacagucgcagccaugggcguacccccucugcccuuauuuauuuucagccucaaagacacuccaaagcguagaucauggccucugaacgagggggugauggcgguuggacuugugaguauccuggcuuccucuuugcucaggaaugauguccccauggccggcccacugguggcgggugggcuacugauugccuguuauguaaucaccggaacgagcgcugaccuuacaguggagaaagcagccgacgucaccugggaagaggaagcggagcagacuggcguuucccauaaccucaugauaacaguggaugacgauggcaccaugcgcauuaaggacgaugaaacugagaacauccugacaguguuguuaaaaaccgcucugcucaucgucucagggauuuuuccguacagcauaccugccacgcugcuuguguggcacacuuggcagaagcagacccaacggaguggaguucugugggacguacccucuccacccgagacacagaaagcagaauuggaggaagguguguacagaaucaagcagcagggcauuuucgggaagacccaagucggagugggcguucagaaagaggguguguuucauacaauguggcacgucacucgaggggcagugcuaacccacaauggaaagaggcuggagccuaacugggcuuccgucaaaaaggaucucaucagcuauggcggcggguggcgccugucggcccaguggcaaaaaggagaagagguccaggugauugcaguugaaccagguaagaaucccaagaacuuccagacgaugccuggcaucuuccagacaacuaccggggagauaggagcuaucgcccuugacuuuaaaccgggcacaucagguucuccaauuaucaaucgggaagggaagguggucggauuauacggcaacggcgugguuaccaaaaaugggggauaugugagugguauugcgcaaacuaacgccgagcccgauggcccuaccccagagcuggaagaggaaauguucaagaaaagaaaucucacaaucauggacuugcaucccggguccggaaagacgaggaaguaccugccugcaauaguccgugaggcuauuaaacgccggcucagaacucugauccuugccccgaccagggugguagcugcagaaauggaggaggcccugaagggcuugcccauccgauaucagacaaccgccacuaaaagcgaacacacaggucgggagauuguggaucuaaugugccaugcuaccuuuacgaugcgccugcucucuccaguuagagucccuaacuacaauuuagugaucauggacgaagcgcacuucacugaucccgcaagcauagccgcuaggggguauauuuccacacgggugggaaugggcgaggccgcagccaucuuuaugaccgcuaccccaccuggcacugcggaagccuucccccagucaaacgcaccaauucaggacgaggagcgagacaucccggaaagaaguuggaauagcgggaacgaguggauaacagauuuugucggaaagaccguaugguucgugccuucuauuaaagcugguaaugacaucgccaacugucugcgcaagaacggcaagaaaguuauccaacuuuccaggaagacauuugauacugaauaccagaaaacgcgucugaaugacugggauuucguggucaccacagacauuucagagaugggggcaaacuuuaaggccgaucgggugaucgaccccagaaggugccucaaaccaguuauuuugacugauggacccgagcgcgugauacuggcuggcccuaugccagucaccgccgcgagugcagcccagcgaagaggucggguggggaggaauccccagaaggaaaacgaccaauacaucuucacaggccagccucucaauaacgaugaggaccaugcucacuggaccgaagccaagaugcugcuugacaauauuaacacuccggagggaaucaucccagcucuauucgaacccgagcgcgagaaaagcgcagccauugauggcgaauaucgucugaagggggaguccagaaaaacguuuguagaauugaugcggaggggagacuuaccuguguggcuggcucacaagguugccucugaggguauaaaauacaccgaucgcaaguggugcuucgacggcgaacgaaauaaccagauccucgaggagaauauggaugucgaaauuuggacaaaagagggggaaagaaagaagcugcggcccagguggcuugacgcacgcacuuauucggauccacuggcgcucaaagaguuuaaggacuucgccgcuggaagaaaaagcaucgccuuggaucuggugaccgaaauuggcagggugccuucacaucuagcacaccggacacguaacgcucuggacaaucucgucaugcuucauaccuccgagcacggugggcgcgccuaccgacacgcaguugaggaacugcccgagacuauggaaacauuauugcugcucggccugaugauccuucugacgggaggcgccaugcucuuuuugauaagugggaagggaaucgguaaaaccucuauuggccugaucugugugauuguaagcuccgggauguuauggauggcugaugugccacuacaguggaucgcgucagccauaguccuggaguucuuuaugauggugcuccuuauuccugagccggaaaagcaaagaacuccccaggacaaccagcuggcauauguugugaucggaauuuugacacuggcugccaucgucgccgcaaaugagaugggccuccuggaaaccaccaagagggaucuugguaugucuaaagagccagggguagugagcccuacaaguuaccucgacguugaccugcaucccgcuuccgccuggacuuuguaugcgguggcuacgaccgucauaacaccaaugcugcggcacacuaucgaaaacagcaccgccaaugugucuuuagcagccauugcuaaccaagcagucgugcuaaugggccuggauaagggauggccuaucucaaaaauggaccucggcguuccccuucuggccuuggggugcuacucccaggugaacccgcugacacucaccgcggcuguacugcuuuuagugacucauuacgccauuaucggaccaggccugcaggcaaaggccacgcgcgaggcucagaaaagaacagccgcagguauaaugaagaauccuaccgucgaugggauuaugacuaucgaccucgaucccguuaucuaugacaguaaguucgagaaacaauugggacaggugaugcugcuaguccugugugcugugcagcuccuucugaugaggaccagcugggccuugugcgaagcgcugacacucgccacuggcccaauuaccacacugugggaggguucgcccggcaaguuuuggaacacgaccaucgcaguaucuauggcuaauauauuccggggguccuacuuagccggagcaggccuugcuuuuagcauuaugaaaucaguggggacuggacgaagaggcacagguagucagggggaaacccugggagagaaguggaaaaagaagcucaaccaacuaucucgcaaagaguucgaucuguauaagaaauccggcaucacugagguugacaggacagaggccaaggaagguuugaaacggggcgagaccacgcaccaugccgugagccgugggucagcgaagcugcagugguuugucgaaagaaauauggugauuccugagggaagggucaucgaucucggcugugggcgcggaggcuggaguuacuauugcgcuggucuuaaaaaggugaccgaaguucggggguacacaaagggaggcccgggccacgaggagcccguaccaaugagcacuuauggguggaacauagugaaacugauguccggaaaggacgucuucuacuugccucccgaaaaaugugauacccugcucugcgacaucggugagucuagcccuuccccaacaguggaagagucacgaacuauuagaguuuuaaagaugguggagcccuggcugaggaauaaccaguucuguaucaaaguccuuaauccuuacaugccaaccgugauugaacaccuggagcgccuacagcggaaguauggcgggaugcucguaagaaacccccugucucguaauaguacacaugaaauguacuggaucucgaacggaaccggcaauauugugagcuccguuaacauggucucuagguugcugcucaaucgguuuacuaugacgcaccgccgaccgacaaucgagaaggauguggaccuuggugcagggaccagacaugugaacgccgaaccugagacuccaaacauggacgucauaggagagaggauuaaacggaucaaggaagaacacucaagcaccuggcacuaugaugacgaaaaucccuacaaaacaugggcuuaucauggcuccuacgagguuaaggccacgggcagugcaucuagcaugaucaacggggugguaaaacuguuaaccaagccuugggauguggucccaauggugacucaaauggccaugacagacaccacucccuucggacagcagcgcguuuuuaaggaaaaaguggauacaagaaccccgaggccuaugcccgguacacgaaaggucauggagauuacugcugaguggcuguggcggaccuugggccguaauaaaaagccaagacucugcacgcgcgaagaguucaccaaaaaggugaggacaaacgcggccaugggggcaguauuuacugaagagaaucaaugggacucagcucgggccgcaguugaagaugaggaguucuggaagcugguggacagagaacgcgagcuacacaaacuuggaaaguguggcuccugcgucuauaacaugauggguaaaagggaaaagaaacugggggaguuuggaaaggccaaaggcagucgagcuauaugguacauguggcucggcgcccgguaccuggaguucgaagcguugggguuucugaaugaggaucauugguucagcagagaaaacucuuauuccggaguggagggugaaggccuccacaaacuuggguacauccugagggacauuucaaagaucccuggaggcgcaauguaugccgaugacaccgcugguugggacacacgcauuacugaggaugacuuacauaaugaggagaaaaucacccagcagauggaucccgagcaccgucagcuggccaacgcaauauuuaaguugacguaccaaaauaaaguggucaagguucagcggccaacacccaaagggaccgugauggacaucauuagcagaaaggaucagaggggaucgggccagguaggcacuuaugggcucaacacauucaccaauauggaagcucaacuggugcgccagauggagggagaagguguccuaucuaaggccgaccuugagaacccucaucugcucgagaaaaagaucacucaguggcuggaaaccaaaggcguggagcgauugaagcggauggcuauuaguggggaugacugcguugugaaaccaaucgaugacagauuugccaaugcauuacuggcgcucaacgauaugggaaaggucaggaaggacauaccgcaguggcaacccuccaaaggcuggcaugauuggcaacaggugccuuucuguagccaccauuuccacgaacuuauuaugaaggacggucgcaaacugguaguuccaugcagaccccaggacgagcuaaucgggcgggccaggaucucacaaggagcuggcuggucccugaaggaaacagccugucucggcaaagcauacgcucagauguggucuuugauguauuuucaccgucgagaucugcgccuugccagcaacgcaauuugcagugccgugccuguccauuggauaccaacguccagaaccacuuggagcauccacgcgcaucaccaguggaugacaaccgaggacaugcugacuguguggaaucggguuuggauugaggauaaccccuggauggaagacaagacaccugugaccacgugggaggaugucccguaccucgggaagagggaagaccaaugguguggaucuuuaaucggucugacaucacgcgcuaccugggcccagaauauuuugacugcaauccaacaggugagaagucugauaggcgaugaggaguuccucgacuacaugccauccaugaaacgguuuaggaaggaagaggaaagcgagggggccaucugguga

SEQ ID NO: 15241 - RNA, 9873 nt, Artificial Sequence
  derived and/or modified CDS sequence (opt3) from DENV-3__FJ639728__SS-prME
accagccugugccucaugaugaugcuucccgcaacacuggcuuuccacuugacuuccagagacggcgaaccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaaaagcaaacccacacucgacaucgagcugcagaagaccgaagcaacucaacuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugccaagaagcaagaggucgugguccucggcucacaggaaggagcuaugcacacugcccugacaggcgcuaccgagauccagaacagugggggaacaagcaucuucgccggucacuuaaagugucggcugaaaauggauaagcuagaacucaaaggcaugucuuacgcaaugugccugaauacuuuugugcuuaagaaagagguuuccgagacccagcaugggacgauuuugauaaagguggaauacaagggagaggacgcccccuguaaaaucccuuucucaaccgaagauggccaagguaaggcucacaacgggcgucugauuacagcgaacccaguagucacuaaaaaggaggagcccgugaauaucgaagcagagccgccuuucggcgaaagcaacauaguuauuggaaucggcgacaaagcccucaagaucaauugguauaagaaagggaguucuauuggaaagauguuugaggcuaccgcccgcggugcaagaaggauggccauccugggcgauacagcuugggacuucggguccgugggaggcguccuuaacagccuggguaaaauggugcaucagauuuuugggucggccuacacugcauuguucucuggcguauccuggauaaugaagaucggaauuggcgugcuccugaccuggaucggguuaaauaguaaaaacacgucaaugagcuuuuccugcaucguuauuggaauaaucacacuguaucuaggcgcggucgugcaggcugauauggguugugugauuaauuggaaggggaaggaacucaaaugcggaucuggcaucuucgucaccaacgagguucacacuuggacagagcaguacaaguuucaagccgacagccccaaacggcuggcaaccgccauugcuggugccugggaaaauggcgugugugggauccgaucaacuacccgcauggagaaccuuuuguggaagcagauagcaaaugaacugaacuauauccucugggagaauaacauuaaacugacagugguagucggagauaucauuggcguguuagaacaggggaagagaacgcugaccccacagccuauggagcuuaaauacaguuggaagacuuggggaaaggcuaaaaucguuacagccgagacccaaaauuccagcuucauaauugacggccccaacacaccagaaugccccucugcguugagggccuggaacgugugggaggucgaagacuaugguuuugggguguucacuaccaauaucuggcucaagcugcgggagguuuacacgcagucaugugaucaucgccuaaugagugcugcaauuaaagacgaaagagccgugcacgcugauaugggauacuggaucgagagccagaagaacggcuccuggaaacuggagaaggccucuuuuauagaaguaaagacaugcaccuggccuaaaucgcacacucucuggagcaaugguguccuggaguccgacaugaucauuccaaagucacuugcaggcccgaucagucagcauaaccacaggcccggguaucauacccaaacagcgggaccuuggcacuugggcaaacuggaauuagauuucaauuacugcgaggggacuaccguggugauuacagagaacuguggaacgcguggcccaucucuccggaccacuacagucagcgguaagcugauccacgaauggugcugucgauccugcacccuucccccucugagauauaugggggaggacggauguugguacggcauggaaauaaggccaauuaaugagaaagaagagaacaugguuaagucauuggugagcgccgguucuggcaagguagauaauuuuacuaugggggugcucugccuggcuauccuauucgaggaagucaugcgcggaaaauucggcaagaaacauaugaucgccggggugcuguuuacauucguucuccugcuuuccggacagauuaccuggcgggacauggcacacacguugaucaugauuggcaguaacgcuagcgauagaauggguaugggggugacuuaucuggccuuaauagcaaccuuuaagauccagcccuuccucgcccugggauuuuuccuuaggaaacugacaucucgcgagaaucuacuccugggcgucggcuuggcuauggcgaccacucugcaauuaccggaagacauugagcagauggccaacgggaucgcacucggacugaugacacuuaagcugauuacccaguuugaaacauaccaguuguggacugcucucgugucccugaccuguucaaauacgaucuucacacuaaccguugccuggcgaacugccacccugauacuugcuggugugagucuccugccuuugugccaaagcucguccaugcggaagacagauuggcugccaaugacugucgcagccaugggcguacccccuuuaccccucuuuaucuucucucugaaagacaccccaaagcguagaagcuggccucuuaacgagggggugauggcgguuggacuggugucaauuuuggcuaguucccuccugaggaaugauguccccauggccggcccgcuaguagccggugggcugcuuaucgccuguuauguaauuacgggaacaucugcugaccucaccguggagaaagcagccgacgucacuugggaagaggaagcggagcagacaggcguuagccauaaccugaugaucaccguggaugacgauggcacuaugcgcauaaaggacgaugaaacagagaacauuuugaccguguuacugaaaacggcucuccugaucgucuccgggaucuuuccauacucaauuccugccacucuucugguguggcacaccuggcagaagcagacacaacggagcggaguuuugugggacguacccaguccacccgagacccagaaagcagaacuagaggaagguguguacagaauaaagcagcagggcaucuucgggaagacacaagucggagugggcguucagaaagaggguguguuucauacuauguggcacgucacccgaggggcagugcugacgcacaauggaaagaggcucgagccuaacugggcuucugugaaaaaggaucugauuuccuauggcggcggguggcgccuuagcgcccaguggcaaaaaggagaagagguccaggugaucgcaguugaaccagguaagaaucccaagaacuuccagacaaugccuggcauuuuccagacuaccacaggggagaucggagcuauagccuuagacuuuaaaccgggcaccucggguucaccaaucauuaaucgggaagggaagguggucggacuguacggcaacggcgugguuacuaaaaaugggggauaugugucugguaucgcgcaaaccaacgccgagcccgauggcccuacaccagagcucgaagaggaaauguucaagaaaagaaauuugacgauuauggaccugcaucccgggaguggaaagacuaggaaguaccucccugcaaucguccgugaggcuauaaaacgccggcugagaacccuuauucuggccccgacaagggugguagcugcagaaauggaggaggccuugaagggccuacccauccgauaucagaccacugccacaaaauccgaacacaccggucgggagaucguggaucugaugugccaugcuacguuuacuaugcgccucuuaagcccaguuagagucccuaacuacaaucuggugauuauggacgaagcgcacuucacagaucccgcaucuaucgccgcuaggggguauauaagcacccgggugggaaugggcgaggccgcagccauuuuuaugaccgcuacuccaccuggcacagcggaagccuucccccaguccaacgcaccaauccaggacgaggagcgagacauuccggaaagaucauggaauagugggaacgaguggaucaccgauuuugucggaaagacaguaugguucgugccuagcauaaaagcugguaaugacauugccaacugucuucgcaagaacggcaagaaaguuauccaacugucuaggaagacuuuugauacggaauaccagaaaacccgucucaaugacugggauuucguggucacaacugacaucuccgagaugggggcaaacuuuaaggccgaucgggugauugaccccagaaggugcuugaaaccaguuauccugaccgauggacccgagcgcgugauucucgcuggcccuaugccagucacagccgcgucagcagcccagcgaagaggucggguggggaggaauccccagaaggaaaacgaccaauacauauucaccggccagccucugaauaacgaugaggaccaugcucacuggacugaagccaagaugcuucuagacaauaucaacacgccggagggaauuaucccagcucuguucgaacccgagcgcgagaaaagugcagccaucgauggcgaauaucguuugaagggggagagcagaaaaaccuuuguagaauuaaugcggaggggagaccugccuguguggcucgcucacaagguugccuccgaggguauuaaauacacagaucgcaaguggugcuucgacggcgaacgaaauaaccagauacuggaggagaauauggaugucgaaaucuggacuaaagagggggaaagaaagaaacuucggcccagguggcuggacgcacgcaccuauucugauccacucgcguugaaagaguuuaaggacuucgccgcuggaagaaaaucgauugcccuggaucuagugacagaaaucggcagggugccuagccaucuggcacaccggacccguaacgcucucgacaaucuugucaugcugcauacuucagagcacggugggcgcgccuaccgacacgcaguugaggaauuacccgagacaauggaaacguugcugcuccugggccuuaugauucugcucaccggaggcgccauguuguuucugaucuccgggaagggaauagguaaaacaaguaucggcuuaauuugugugaucguaucuagcgggaugcuauggauggcugaugugccacugcaguggauugcguccgccaucguccucgaguucuuuaugauggugcuucugauaccugagccggaaaagcaaagaacaccccaggacaaccaguuggcauauguugugauuggaauccugacccucgcugccauugucgccgcaaaugagaugggccugcuugaaaccacaaagagggaucucgguaugucaaaagagccagggguagugucuccuacuagcuaccuggacguugacuugcaucccgcuagugccuggacgcuguaugcgguggcuaccacagucaucacuccaauguuacggcacaccauagaaaacuccacagccaaugugagccuagcagccaucgcuaaccaagcagucgugcugaugggccucgauaagggauggccuauuucuaaaauggaccuuggcguuccccuguuggcccuggggugcuacucacaggugaacccgcucacccugacugcggcuguacuuuuacuggugacgcauuacgccaucauuggaccaggccuccaggcaaaggccacacgcgaggcucagaaaagaaccgccgcagguaucaugaagaauccuacugucgaugggauaaugaccauugacuuggaucccguuaucuaugacuccaaguucgagaaacaacugggacaggugaugcuacugguccucugugcugugcagcuucuguugaugaggacaaguugggcccugugcgaagcgcucacucuggccaccggcccaaucacaacguuaugggaggguagccccggcaaguuuuggaacaccacuauugcaguaucgauggcuaauaucuuccgggggucuuaccuugccggagcaggccuggcuuuuuccauaaugaaaagcguggggacaggacgaagaggcaccgguucacagggggaaacucucggagagaaguggaaaaagaagcuaaaccaacugagucgcaaagaguucgauuuguauaagaaaucuggcauuacagagguugacaggaccgaggccaaggaaggucugaaacggggcgagacgacccaccaugccgugucccgugggagcgcgaagcuccagugguuugucgaaagaaauauggugaucccugagggaagggucauugaucuuggcugugggcgcggaggcuggucauacuauugcgcuggucugaaaaaggugacagaaguucggggguacacuaagggaggcccgggccacgaggagcccguaccaaugaguaccuauggguggaacaucgugaaauugaugagcggaaaggacgucuucuaccugccucccgaaaaaugugauacacucuuaugcgacauaggugaguccucuccuagcccaacuguggaagagucccgaaccaucagaguucugaagaugguggagcccuggcuuaggaauaaccaguucuguauuaaaguccugaauccuuacaugccaacagugaucgaacaccuagagcgccuccagcggaaguauggcgggaugcugguaagaaaccccuugucacguaauucuacccaugaaauguacuggauuaguaacggaacuggcaauaucgugucgagcguuaacauggucuccaggcugcuccuuaaucgguuuacgaugacacaccgccgaccgaccauugagaaggauguggaccugggugcagggacuagacaugugaacgccgaaccugagaccccaaacauggacgucaucggagagaggauaaaacggauuaaggaagaacacucuucaacauggcacuaugaugacgaaaaucccuacaaaacgugggcuuaucauggcagcuacgagguuaaggccaccggcuccgcaaguucuaugaucaacggggugguaaaauuacugacuaagccuugggauguggucccaauggugacacaaauggccaugaccgacacuacacccuucggacagcagcgcguuuuuaaggaaaaaguggauaccagaacaccgaggccuaugcccgguacucgaaaggucauggagaucaccgcugagugguuguggcggacgcucggccguaauaaaaagccaagacugugcacccgcgaagaguucacuaaaaaggugaggacuaacgcggccaugggggcaguauuuaccgaagagaaucaaugggacagcgcucgggccgcaguugaagaugaggaguucuggaagcuaguggacagagaacgcgagcuucacaaacugggaaaguguggcucaugcgucuauaacaugauggguaaaagggaaaagaaacucggggaguuuggaaaggccaaaggcucccgagcuauuugguacauguggcugggcgcccgguacuuggaguucgaagcgcugggguuucucaaugaggaucauugguucaguagagaaaacagcuauucuggaguggagggugaaggccuucacaagcugggguacauauuaagggacaucuccaagauuccuggaggcgcaauguaugccgaugacacagcugguugggacacucgcaucaccgaggaugaccugcauaaugaggagaaaauuacgcagcagauggaucccgagcaccgucaguuggccaacgcaaucuuuaagcucacauaccaaaauaaaguggucaagguucagcggccaacccccaaagggacugugauggacauaaucucaagaaaggaucagaggggaagcggccagguaggcacauaugggcugaacaccuucacuaauauggaagcucagcuagugcgccagauggagggagaagguguccuuucgaaggccgaccuggagaacccucaccuccuggagaaaaagauuacccagugguuggaaacaaaaggcguggagcgauuaaagcggauggcuaucucuggggaugacugcguugugaaaccaauugaugacagauuugccaaugcacugcucgcgcuuaacgauaugggaaaggucaggaaggacaucccgcaguggcaacccaguaaaggcuggcaugauuggcaacaggugccuuucuguucccaccauuuccacgaacugauaaugaaggacggucgcaagcuaguaguuccaugcagaccccaggacgagcugauugggcgggccaggaucagccaaggagcuggcuggucacucaaggaaacggccuguuugggcaaagcauacgcucagauguggucccugauguauuuucaccgucgagaucuucgccuggccucuaacgcaaucugcagcgccgugccuguccauuggauuccaaccaguagaacuacaugguccauacacgcgcaucaccaguggaugaccacugaggacaugcucacaguguggaaucggguuuggaucgaggauaaccccuggauggaagacaagaccccugugacgacaugggaggaugucccguacuuagggaagagggaagaccaaugguguggaagccugauugguuugaccucucgcgcuacuugggcccagaauauccugaccgcaauucaacaggugagaucacucaucggcgaugaggaguuccuugacuacaugccaaguaugaaacgguuuaggaaggaagaggaauccgagggggccauaugguga

SEQ ID NO: 15242 - RNA, 9873 nt, Artificial Sequence
  derived and/or modified CDS sequence (opt3) from DENV-3__FJ639729__SS-prME
acaagccugugccucaugaugaugcuuccagccacacuggcuuuccacuugacuuccagagacggagaaccuaggaugaucguggggaagaacgaacggggaaaaucuuuacuguuuaagacggcaucagguauuaauauguguacccuaauagccauggaucucggcgagaugugcgacgauacaguaacuuacaaauguccacugaucgcggaaguugagccggaagacauugauugcugguguaaccuuaccaguacaugggugaccuaugggacuugcaaucaggcuggagagcaccgccgagacaagcguagcguagcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcaaagagcaaacccacacucgacaucgagcugcagaagaccgaagcaacucagcuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaucaccgagacuccaacauggaacaggaaagaacuguuggugacguuuaagaaugcccaugccaagaagcaagaggucgugguccucggcucacaggaaggagcuaugcacaccgcccugacuggcgcuacagagauccagaacagugggggaaccagcauuuucgccggucacuuaaagugucggcugaaaauggauaagcuagaacucaaaggcaugucuuacgcaaugugccugaauacauuugugcuuaagaaagagguuuccgagacucagcaugggaccauauugaucaagguggaauacaagggagaggacgcccccuguaaaauuccuuucucaacggaagauggccaagguaaggcucacaacgggcgucugaucaccgcgaacccaguagucaccaaaaaggaggagcccgugaauauagaagcagagccgccuuucggcgaaagcaacauuguuaucggaaucggcgacaaagcccucaagauuaauugguauaagaaagggaguucuaucggaaagauguuugaggcuacugcccgcggugcaagaaggauggccauucugggcgauaccgcuugggacuucggguccgugggaggcguccuuaacagccuggguaaaauggugcaucagauauuugggucggccuacacagcauuguucucuggcguauccuggaucaugaagauuggaaucggcgugcuccugacuuggaucggguuaaauucaaagaacaccaguaugagcuuuuccugcauuguuauaggaaucauuacgcuguaucuaggcgcggucgugcaggcugauauggguugugugaucaauuggaaggggaaggaacucaaaugcggaucuggcauuuucgucacaaacgagguucacaccuggacugagcaguacaaguuucaagccgacagccccaaacggcuggcaacagccaucgcuggugccugggaaaauggcgugugugggauacgaucaaccacucgcauggagaaccuuuuguggaagcagaucgcaaaugaacugaacuauauucucugggagaauaacaucaaacugaccgugguagucggagauauuaucggcguguuagaacaggggaagagaacacugacgccacagccuauggagcuuaaauacaguuggaagaccuggggaaaggcuaaaauaguuacugccgagacacaaaauuccagcuucauuaucgacggccccaacaccccagaaugccccucugcgucaagggccuggaacgugugggaggucgaagacuaugguuuugggguguucacaacuaauauuugguugaagcuccgggagguuuacacccagaguugugaucaucgccugaugagcgcugcaaucaaagacgaaagagccgugcacgcugauaugggauacuggauagagucccagaagaacggcucuuggaaacuagagaaggccucguuuaucgaaguaaagacgugcacauggccuaaaagccacacccugugguccaaugguguccucgagucagacaugauuaucccaaagagucuggcaggcccgauuucucagcauaaccacaggcccggguaucauacucaaaccgcgggaccuuggcaccuuggcaaauuggaacuggauuucaauuacugcgaggggacaacuguggugaucaccgagaacuguggaacacguggccccagcuuacggacgaccacugucuccgguaagcucauacacgaauggugcugucgaucaugcacacugcccccucuuagauauaugggggaggacggauguugguacggcauggaaauuaggccaaucaaugagaaagaagagaacaugguuaagagccuggugucugccgguuccggcaagguagauaauuuuaccauggggguguugugccucgcuauccuguucgaggaagucaugcgcggaaaauucggcaagaaacauaugauugccggggugcuauuuacuuucguucugcuccugaguggacagaucacauggcgggacauggcacacacccuuauuaugauaggcagcaacgcuucugauagaauggguaugggggugacguauuuggcccugaucgcaacuuuuaagauucagcccuucuuagcccucggauuuuuccugaggaaacuuaccucccgcgagaaucugcuacucggcgucggccuggcuauggcgacaaccuugcaacugccggaagacaucgagcagauggccaacgggauugcauuaggacucaugacucugaaacuuaucacacaguuugaaaccuaccagcuguggacagcuuuggugucacucacuuguaguaauaccauauucacgcugacaguugccuggcgaaccgccacucuaauccuggcuggugugagccuucucccucugugccaaucguccucuaugcggaagaccgauugguugccaaugacagucgcagccaugggcguacccccucugcccuuauuuauuuucagccucaaagacacuccaaagcguagaucauggccucugaacgagggggugauggcgguuggacuugugaguauccuggcuuccucuuugcucaggaaugauguccccauggccggcccacugguggcgggugggcuacugauugccuguuauguaaucaccggaacgagcgcugaccuuacaguggagaaagcagccgacgucaccugggaagaggaagcggagcagacuggcguuucccauaaccucaugauaacaguggaugacgauggcaccaugcgcauuaaggacgaugaaacugagaacauccugacaguguuguuaaaaaccgcucugcucaucgucucagggauuuuuccguacagcauaccugccacgcugcuuguguggcacacuuggcagaagcagacccaacggaguggaguucugugggacguacccucuccacccgagacacagaaagcagaauuggaggaagguguguacagaaucaagcagcagggcauuuucgggaagacccaagucggagugggcguucagaaagaggguguguuucauacaauguggcacgucacucgaggggcagugcuaacccacaauggaaagaggcuggagccuaacugggcuuccgucaaaaaggaucucaucagcuauggcggcggguggcgccugucggcccaguggcaaaaaggagaagagguccaggugauugcaguugaaccagguaagaaucccaagaacuuccagacgaugccuggcaucuuccagacaacuaccggggagauaggagcuaucgcccuugacuuuaaaccgggcacaucagguucuccaauuaucaaucgggaagggaagguggucggauuauacggcaacggcgugguuaccaaaaaugggggauaugugagugguauugcgcaaacuaacgccgagcccgauggcccuaccccagagcuggaagaggaaauguucaagaaaagaaaucucacaaucauggacuugcaucccggguccggaaagacgaggaaguaccugccugcaauaguccgugaggcuauuaaacgccggcucagaacucugauccuugccccgaccagggugguagcugcagaaauggaggaggcccugaagggcuugcccauccgauaucagacaaccgccacuaaaagcgaacacacaggucgggagauuguggaucuaaugugccaugcuaccuuuacgaugcgccugcucucuccaguuagagucccuaacuacaauuuagugaucauggacgaagcgcacuucacugaucccgcaagcauagccgcuaggggguauauuuccacacgggugggaaugggcgaggccgcagccaucuuuaugaccgcuaccccaccuggcacugcggaagccuucccccagucaaacgcaccaauucaggacgaggagcgagacaucccggaaagaaguuggaauagcgggaacgaguggauaacagauuuugucggaaagaccguaugguucgugccuucuauuaaagcugguaaugacaucgccaacugucugcgcaagaacggcaagaaaguuauccaacuuuccaggaagacauuugauacugaauaccagaaaacgcgucugaaugacugggauuucguggucaccacagacauuucagagaugggggcaaacuuuaaggccgaucgggugaucgaccccagaaggugccucaaaccaguuauuuugacugauggacccgagcgcgugauacuggcuggcccuaugccagucaccgccgcgagugcagcccagcgaagaggucggguggggaggaauccccagaaggaaaacgaccaauacaucuucacaggccagccucucaauaacgaugaggaccaugcucacuggaccgaagccaagaugcugcuugacaauauuaacacuccggagggaaucaucccagcucuauucgaacccgagcgcgagaaaagcgcagccauugauggcgaauaucgucugaagggggaguccagaaaaacguuuguagaauugaugcggaggggagacuuaccuguguggcuggcucacaagguugccucugaggguauaaaauacaccgaucgcaaguggugcuucgacggcgaacgaaauaaccagauccucgaggagaauauggaugucgaaauuuggacaaaagagggggaaagaaagaagcugcggcccagguggcuugacgcacgcacuuauucggauccacuggcgcucaaagaguuuaaggacuucgccgcuggaagaaaaagcaucgccuuggaucuggugaccgaaauuggcagggugccuucacaucuagcacaccggacacguaacgcucuggacaaucucgucaugcuucauaccuccgagcacggugggcgcgccuaccgacacgcaguugaggaacugcccgagacuauggaaacauuauugcugcucggccugaugauccuucugacgggaggcgccaugcucuuuuugauaagugggaagggaaucgguaaaaccucuauuggccugaucugugugauuguaagcuccgggauguuauggauggcugaugugccacuacaguggaucgcgucagccauaguccuggaguucuuuaugauggugcuccuuauuccugagccggaaaagcaaagaacuccccaggacaaccagcuggcauauguugugaucggaauuuugacacuggcugccaucgucgccgcaaaugagaugggccuccuggaaaccaccaagagggaucuugguaugucuaaagagccagggguagugagcccuacaaguuaccucgacguugaccugcaucccgcuuccgccuggacuuuguaugcgguggcuacgaccgucauaacaccaaugcugcggcacacuaucgaaaacagcaccgccaaugugucuuuagcagccauugcuaaccaagcagucgugcuaaugggccuggauaagggauggccuaucucaaaaauggaccucggcguuccccuucuggccuuggggugcuacucccaggugaacccgcugacacucaccgcggcuguacugcuuuuagugacucauuacgccauuaucggaccaggccugcaggcaaaggccacgcgcgaggcucagaaaagaacagccgcagguauaaugaagaauccuaccgucgaugggauuaugacuaucgaccucgaucccguuaucuaugacaguaaguucgagaaacaauugggacaggugaugcugcuaguccugugugcugugcagcuccuucugaugaggaccagcugggccuugugcgaagcgcugacacucgccacuggcccaauuaccacacugugggaggguucgcccggcaaguuuuggaacacgaccaucgcaguaucuauggcuaauauauuccggggguccuacuuagccggagcaggccuugcuuuuagcauuaugaaaucaguggggacuggacgaagaggcacagguagucagggggaaacccugggagagaaguggaaaaagaagcucaaccaacuaucucgcaaagaguucgaucuguauaagaaauccggcaucacugagguugacaggacagaggccaaggaagguuugaaacggggcgagaccacgcaccaugccgugagccgugggucagcgaagcugcagugguuugucgaaagaaauauggugauuccugagggaagggucaucgaucucggcugugggcgcggaggcuggaguuacuauugcgcuggucuuaaaaaggugaccgaaguucggggguacacaaagggaggcccgggccacgaggagcccguaccaaugagcacuuauggguggaacauagugaaacugauguccggaaaggacgucuucuacuugccucccgaaaaaugugauacccugcucugcgacaucggugagucuagcccuuccccaacaguggaagagucacgaacuauuagaguuuuaaagaugguggagcccuggcugaggaauaaccaguucuguaucaaaguccuuaauccuuacaugccaaccgugauugaacaccuggagcgccuacagcggaaguauggcgggaugcucguaagaaacccccugucucguaauaguacacaugaaauguacuggaucucgaacggaaccggcaauauugugagcuccguuaacauggucucuagguugcugcucaaucgguuuacuaugacgcaccgccgaccgacaaucgagaaggauguggaccuuggugcagggaccagacaugugaacgccgaaccugagacuccaaacauggacgucauaggagagaggauuaaacggaucaaggaagaacacucaagcaccuggcacuaugaugacgaaaaucccuacaaaacaugggcuuaucauggcuccuacgagguuaaggccacgggcagugcaucuagcaugaucaacggggugguaaaacuguuaaccaagccuugggauguggucccaauggugacucaaauggccaugacagacaccacucccuucggacagcagcgcguuuuuaaggaaaaaguggauacaagaaccccgaggccuaugcccgguacacgaaaggucauggagauuacugcugaguggcuguggcggaccuugggccguaauaaaaagccaagacucugcacgcgcgaagaguucaccaaaaaggugaggacaaacgcggccaugggggcaguauuuacugaagagaaucaaugggacucagcucgggccgcaguugaagaugaggaguucuggaagcugguggacagagaacgcgagcuacacaaacuuggaaaguguggcuccugcgucuauaacaugauggguaaaagggaaaagaaacugggggaguuuggaaaggccaaaggcagucgagcuauaugguacauguggcucggcgcccgguaccuggaguucgaagcguugggguuucugaaugaggaucauugguucagcagagaaaacucuuauuccggaguggagggugaaggccuccacaaacuuggguacauccugagggacauuucaaagaucccuggaggcgcaauguaugccgaugacaccgcugguugggacacacgcauuacugaggaugacuuacauaaugaggagaaaaucacccagcagauggaucccgagcaccgucagcuggccaacgcaauauuuaaguugacguaccaaaauaaaguggucaagguucagcggccaacacccaaagggaccgugauggacaucauuagcagaaaggaucagaggggaucgggccagguaggcacuuaugggcucaacacauucaccaauauggaagcucaacuggugcgccagauggagggagaagguguccuaucuaaggccgaccuugagaacccucaucugcucgagaaaaagaucacucaguggcuggaaaccaaaggcguggagcgauugaagcggauggcuauuaguggggaugacugcguugugaaaccaaucgaugacagauuugccaaugcauuacuggcgcucaacgauaugggaaaggucaggaaggacauaccgcaguggcaacccuccaaaggcuggcaugauuggcaacaggugccuuucuguagccaccauuuccacgaacuuauuaugaaggacggucgcaaacugguaguuccaugcagaccccaggacgagcuaaucgggcgggccaggaucucacaaggagcuggcuggucccugaaggaaacagccugucucggcaaagcauacgcucagauguggaacuugauguauuuucaccgucgagaucugcgccuugccucuaaugcaauuugcagcgccgugccuguccauuggauaccaacgaguagaaccacuugguccauccacgcgcaucaccaguggaugacaaccgaggacaugcugacuguguggaaccggguuuggauugaggauaaucccuggauggaagacaagacaccugugaccacgugggaggaugucccguaccucgggaagagggaagaccaaugguguggcagcuuaaucggucugacaucucgcgcuaccugggcccagaacauuuugacugcaauccaacaggugagaucacugauaggcgaugaggaguuccucgacuacaugccaaguaugaaacgguuuaggaaggaagaggaauccgagggggccaucugguga

SEQ ID NO: 15243 - RNA, 9873 nt, Artificial Sequence
  derived and/or modified CDS sequence (opt3) from DENV-3__FJ639730__SS-prME
accagccugugccucaugaugaugcuucccgcaacacuggcuuuccacuugacuucccgagacggagaaccuaggaugaucguggggaagaacgaacggggaaaaucuuuacuguuuaagacggcaucagguauuaauauguguacccuaauagcaauggaucucggcgaaaugugcgacgauacagucacuuacaaauguccacugaucgcggaaguugaaccggaagacauugauugcugguguaaccuuaccaguacaugggugaccuaugggacuugcaaucaggcuggagaacaccgccgagacaagcguagcgucgcccuggcaccccacgugggcauggguuuggauacaagaacccaaacguggauguccgccgaaggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaaaagcaaacccacacucgacaucgagcugcagaagaccgaagcaacucaacuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugccaagaagcaagaggucgugguccucggcucacaggaaggagcuaugcacacugcccugacaggcgcuaccgagauccagaacagugggggaacaagcaucuucgccggucacuuaaagugucggcugaaaauggauaagcuagaacucaaaggcaugucuuacgcaaugugccugaauacuuuugugcuuaagaaagagguuuccgagacccagcaugggacgauuuugauaaagguggaauacaagggagaggacgcccccuguaaaaucccuuucucaaccgaagauggccaagguaaggcucacaacgggcgucugauuacagcgaacccaguagucacuaaaaaggaggagcccgugaauaucgaagcagagccgccuuucggcgaaagcaacauaguuauuggaaucggcgacaaagcccucaagaucaauugguauaagaaagggaguucuauuggaaagauguuugaggcuaccgcccgcggugcaagaaggauggccauccugggcgauacagcuugggacuucggguccgugggaggcguccuuaacagccuggguaaaauggugcaucagauuuuugggucggccuacacugcauuguucucuggcguauccuggauaaugaagaucggaauuggcgugcuccugaccuggaucggguuaaauucaaagaacacgaguaugagcuuuuccugcaucguuauuggaauaaucacacuguaucuaggcgcggucgugcaggcugauauggguugugccauuaauuggaaggggaaggaacucaaaugcggaucuggcaucuucgugaccaacgagguccacacuuggacagagcaguacaaguuucaagcagacagccccaaacggcuggccaccgcuauugccggugcaugggaaaauggcguuugugggauccgaucaacuacccgcauggagaaccuuuuguggaagcagauagcuaaugaacugaacuauauccucugggagaauaacauuaaacugacaguggugguaggagauaucauuggcgucuuagaacaggggaagagaacgcugaccccacagccuauggagcuuaaauacaguuggaagacuuggggaaaggccaaaaucgugacagcggagacccaaaauuccagcuucauaauugacggccccaacacaccagaaugccccucugccucaagggcuuggaacguuugggagguggaagacuaugguuuuggggucuucacuaccaauaucugguugaagcuccgggagguguacacgcagaguugugaucaucgccugaugagcgcagccauuaaagacgaaaaggcuguucacgccgauaugggauacuggaucgagucccagaaaaacggcucuuggaagcuagagaaggcaucguuuauagaagugaaaacaugcaccuggccuaagagccacacucugugguccaaugguguacucgagucagacaugaucauuccaaaaagucuggcgggcccgaucucucagcauaaccacagacccggguaucauacccaaacagccggaccuuggcaccuuggcaaguuggaacuggauuucaauuacugcgaggggacuaccgucgugauuacagagaacuguggaacgaggggccccagcuuacguaccacuacaguguccgguaaacucauccacgaauggugcugucggucaugcacccugcccccucuucgauauaugggggaggacggauguugguacggcauggaaauaagaccaauuaaugagaaggaagagaacauggucaagagccugguuucugcugguuccggcaaaguggauaauuuuacuauggggguauugugccucgccauccuguucgaggaagugaugaggggaaaguucggcaaaaagcauaugaucgcagggguccuauuuacauucgugcugcuccugaguggacagauuaccuggcgcgacauggcucacacgcuuaucaugauuggcagcaacgccucugaucggauggguauggggguuacuuauuuggcacugauagccaccuuuaaaauccagcccuucuuagcucucggauuuuuccugagaaaacuuacauccagggagaaucugcuacucggcgugggccuggcgauggccaccacuuugcaacugccggaagacauugagcagauggcaaacgggaucgcuuuaggacucaugacacugaaacuuauuacccaguuugaaacauaccagcuguggacugccuuggucucacucaccuguaguaauacgaucuucacacugaccguggccuggcgcacugcuacccuaauacuggccgguguuagccuucucccucugugccaaucguccucuaugcgaaaaacagauugguugccaaugacuguggccgcgaugggcguaccaccucugcccuuauuuaucuucagccucaaggacaccccaaaacggcguucauggccucugaacgaggggguaauggcugugggacuuguuaguauucuggccuccucuuugcucagaaaugaugugcccauggcaggcccacuggucgccggugggcuacugaucgcuuguuaugugauuacgggaacaagcgcagaccuuaccguagagaaggccgcggacgugacuugggaagaggaagcugagcagacaggcgucucccauaaccucaugaucaccguugaugacgauggcacuaugaggauaaaagacgaugaaacagagaacauucugaccguguuguuaaagacggcccugcucaucgugucagggaucuuuccguacagcauuccugcaacucugcuugucuggcacaccuggcagaaacagacacaacgcaguggagugcugugggacguucccucuccacccgagacccagaaggccgaauuggaggaagguguauaccggauaaagcagcagggcaucuucgggaaaacacaagugggagucggcgugcagaaggaggguguuuuucauacuauguggcacgugaccagaggggcuguccuaacgcacaauggaaaaaggcuggagccuaacugggccuccgugaagaaagaucucauuagcuauggcggcggguggcgacugaaugcacaguggcaaaagggagaagagguacaggucaucgcuguggaaccagguaagaaccccaaaaauuuccagacaaugccuggcauuuuccagacuaccacaggggagaucggagccauagcgcuugacuuuaagccgggcaccucggguucaccaaucauuaacaaagaagggaagguugugggauuauacggcaauggcgucgugacuaaaaacgggggauauguuucugguaucgcccaaaccaaugcagagcccgauggcccuacaccagagcuggaagaggaaauguucaagaagcgcaaccucacgauuauggacuugcaucccgggaguggaaaaacucggaaguaccugccugcuaucgugagagaggccauaaaaaggcgucuccgcacccugauucuugcuccgacacgggucguggcagccgaaauggaggaggcccugaagggcuugcccaucagauaucagaccacugcuacaaaauccgaacacaccgguagggagaucguagaucuaaugugccaugcgacguuuacuaugcgacugcucagcccagugcggguuccuaauuacaacuuagucauuauggacgaagcacacuucacagaucccgccucuaucgcugcccgcggguauauaagcaccagagugggaaugggcgaggcagccgcuauuuuuaugaccgcgacuccaccuggcacagccgaagcauucccccaguccaaugcuccaauccaggacgaggagagggacauuccggaacggucauggaacagugggaaugaguggaucaccgauuuugugggaaagacagucugguucguaccuagcauaaaggccgguaacgacauugcaaacugucugagaaagaauggcaagaaagugauccaacuuucuagaaagacuuuugauacggaauaccagaaaacccgccugaacgacugggauuucguugugacaacugacaucuccgagaugggggccaauuuuaaggcugauagggucauugacccccgucggugccucaagccagugaucuugaccgauggacccgagagaguuauucuggccggcccuaugccagugacagcggcaucagccgcucagaggcgcggucgagucgggagaaacccccagaaagaaaaugaccaauacauauucaccggccagccucucaacaaugaugaggaccaugcccacuggacugaagcuaagaugcugcuugacaacaucaauacgccggagggaauuaucccagcacuauucgaacccgagcgggagaaaagugccgcuaucgauggcgaauauaggcugaagggggagagccgcaaaaccuuuguggaauugaugcguagaggagacuuaccuguauggcuggcccacaagguggcauccgaggguauuaaauacacagaucggaaguggugcuucgacggcgaaaggaacaaucagauacucgaggagaacauggauguugaaaucuggacuaaggagggggaacgcaaaaagcugcgacccagauggcuugacgcgcggaccuauucugauccacuggcccucaaagaguuuaaggacuucgcugccggaaggaaaucgauugcauuggaucuggucacagaaaucggccgcgugccuagccaucuagcucacagaaccaggaaugcccuggacaaccucgugaugcuucauacuucagagcacggugggcgggcauaccgucacgccgucgaggaacugcccgagacaauggaaacguuauugcugcucggccugaugauucuucugaccggaggcgcuaugcucuuuuugaucuccgggaagggaauagguaagacaaguaucggccugauuuguguuaucgugucuagcgggauguuauggauggcggauguaccacuacaguggauugccuccgcaaucgugcuggaguucuuuaugaugguccuccuuauaccugagccggaaaaacaacgcacaccccaggacaaucagcuggcuuaugugguuauuggaaucuugacccuggccgccauuguggcagcuaacgagaugggccuccuggaaaccacaaagcgagaucuugguaugucaaaagagccaggggucguaucuccuacuagcuaccucgacguggaccugcaucccgccagugcguggacguuguaugcuguugccaccacagugaucacuccaaugcugagacacaccauagaaaauuccacagcaaacgucagcuuagccgcuaucgcaaaccaagccgugguccuaaugggccuggauaagggauggccuauuucuaaaauggaccucggcgugccccuucuggcguuggggugcuacucacagguuaauccgcugacccucacugcugccgugcugcuuuuaguaacgcauuacgcaaucauuggaccaggccugcaggccaaggcuacaagggaggcccagaagcggaccgcagcugguaucaugaaaaacccuacuguggaugggauaaugaccauugaccucgaucccgucaucuaugacuccaaguucgagaaacaauugggacagguuaugcugcuagugcugugugccguccagcuccuucugaugcgcacaaguugggcguugugcgaagcccugacucucgcaaccggcccaaucacaacgcugugggaggguagccccggcaaguuuuggaauaccacuauugcugugucgauggccaacaucuucagagggucuuacuuagcaggagcuggccuugccuuuuccauaaugaaaagcguagggacaggaaggcggggcaccgguucacagggggaaacucugggagagaaguggaagaaaaagcucaaucaacuaagucgaaaagaguucgagcuguauaagaaaucuggcauuacagagguggauagaaccgaagccaaggaggguuugaaacgcggcgaaacgacccaccaugcgguuuccagggggagcgcuaagcugcagugguuuguggagcggaacauggucaucccugaaggacgugugauugaccucggcugugggagaggaggcuggucauacuauugcgcaggucuuaagaaagucacagaggugaggggguacacuaagggaggcccgggccacgaggaacccguuccaaugaguaccuauggguggaauaucguaaaacugaugagcggaaaggauguguucuacuugccucccgagaaaugugacacacugcucugcgauauaggugaauccucuccuagcccaacugucgaggagucccgcaccauccggguguuaaagaugguugaacccuggcugcgaaacaaucaguucuguauuaaggugcuuaacccuuacaugccaacagucaucgagcaccuggaaaaacuacagagaaaguauggcgggaugcucgugaggaauccccugucacgcaacucuacccaugagauguacuggauuaguaauggaacuggcaacaucguaucgagcgugaauaugguuucccgguugcugcucaacagauuuacgaugacacaccguaggccgaccauugaaaaagacgucgaucuuggugccgggacucggcaugugaacgcugagccugagaccccaaauauggacgugaucggagaacgcauaaagcgaauuaaagaggaacacucuucaacauggcacuaugacgaugagaaccccuacaagacgugggccuaucauggcagcuacgaagucaaggcaaccggcuccgccaguucuaugaucaaugggguugugaaacuguuaacuaagccuugggacguagugccaauggucacacaaauggcuaugaccgauacuacacccuucggacagcagagaguguuuaaagagaagguugacaccaggacaccgcggccuaugcccgguacucgcaaagugauggagaucaccgcggaauggcuguggagaacguugggcaggaacaagaagccacgacucugcacccgggaggaguucacuaagaagguccguacuaaugccgcaaugggggcuguguuuaccgaggaaaaccaaugggauagcgccagagcagccguagaggacgaggaguucuggaaacugguugaucgcgagagggaacuacacaaacuuggaaaauguggcucaugcguguauaauaugauggguaagcgggagaaaaagcugggggaguuuggaaaggcuaaaggcuccagagccauuugguacauguggcucggcgcgcgcuaccuggaguucgaggcauugggguuucugaacgaagaccauugguucaguagggagaauagcuauucuggagucgaaggugagggccuccacaaacuuggguacauacugcgagauaucuccaaaauuccuggaggcgccauguaugcugacgauacagccgguugggacacucggaucaccgaggacgauuuacauaacgaagagaagauuacgcagcagauggaccccgaacacagacagcuggcaaaugcuaucuuuaaauugacauaccaaaacaagguggugaagguccagaggccaacccccaaagggacuguuauggauauaaucucacgcaaggaccagcguggaagcggccaggugggcacauaugggcucaauaccuucacuaacauggaggcccaacugguacggcagauggaaggagagggugugcuaucgaaagcugaucuugagaauccucaucugcucgaaaagaaaauuacccaguggcuggagacaaagggcgucgaaagauugaagaggauggccaucucuggggacgauugcgugguuaaaccaauugacgaucgcuuugcaaacgcguuacuggcccucaacgacaugggaaaggugcgaaaagauaucccgcaguggcaacccaguaagggcuggcaugacuggcagcaggucccuuucuguucccaccauuuccacgagcuuauaaugaaagauggucggaagcuggugguaccaugcagaccccaggacgaacuaauugggagggcucgcaucagccaaggagccggcuggucacugaaggagacggcaugucucggcaaggcuuacgcccagaugugguccuugauguauuuucacagacgggaccugaggcuugcaucuaaugccaucugcagcgcgguuccugugcauuggauuccaaccagucguacuacaugguccauacacgcucaucaccaguggaugaccacugaggauaugcugacagucuggaaccgaguguggaucgaagacaaucccuggauggaggauaagaccccuguuacgacaugggaagacgugccguaccucgggaaacgcgaggaucaaugguguggcagcuuaauuggucugaccucuagagccacuugggcacagaacaucuugaccgccauucagcagguccggucacugaucggcgacgaggaguuccucgauuacaugccaaguaugaagagguuucgcaaagaggaagaguccgaaggggcuauaugguga

SEQ ID NO: 15244 - RNA, 9873 nt, Artificial Sequence
  derived and/or modified CDS sequence (opt3) from DENV-3__KF955464__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagagcaaacccacacucgacaucgagcugcagaagaccgaagcaacucaacuugccauucugaggaaauuguguaucgagggaaagauuacaaauaucaccacggauagucggugcccuacccagggcgaagcuacacucccagaggaacaggaccagaacuaugucuguaaacacacuuacguugaucgcgguugggggaauggaugcggccuguucggcaagggguccuuagugaccugcgccaaguuucaaugucuggagcccauagagggaaaaguagugcaguaugaaaaccucaaguacacagucauuaucacugugcacaccggugaccagcaucagguuggcaaugacacacaaggggugaccgucgagauuacuccucaggcaucuacgguggaagcuguacuuccagaguauggaacacugggcuuggaaugcagcccgcgaaccggucuagauuucaacgagaugauccugcucacuaugaaaaauaaggccuggaugguucacagacagugguuuuucgaccugccccuuccuuggaccuccggggcgacaaccgagacuccaacauggaacaggaaagaacuguuggugacguuuaagaaugcccaugcaaaaaagcaagaggucgugguccucggcucacaggaaggagcuaugcacaccgcccugacuggcgcuacagagauccagaacagugggggaaccaauauuuucgccggucacuuaaagugucggcugaaaauggauaagcuagaacucaaaggcaugagcuacgcaaugugccugaacacauuugugcuuaagaaagagguuucugagacucagcaugggaccauauugaucaagguggaauacaagggagaggacgcccccuguaaaauuccuuucuccacggaagauggccaagguaaggcucacaacgggcgucugaucaccgcgaauccaguagucacaaaaaaggaggagcccauaaacauugaagcagagccgccuuucggcgaaucaaauaucgugaucggaauuggcgacaaagcccucaagaucaacugguauaagaaagggagcaguauuggaaagauguuugaggcuacugcccgcggugcaagaaggauggccauacugggcgauaccgcuugggacuucgggucuguuggaggcgugcuuaauucccuggguaaaaugguccaucagaucuuugggagcgccuacacagcauuguucucgggcgugucuuggauuaugaagaucggaaucggcguacuccugacuuggauuggguuaaacuccaaaaauaccucaaugaguuuuagcugcauagugaucggaauuaucacgcuguaucuaggcgcgguuguccaggcugauauggguugugugauuaacuggaaggggaaggaacucaaaugcggaaauggcaucuucgugacaaacgagguccacaccuggacugagcaguacaaguuucaagccgacucccccaaacggcuggcaacagccauagcuggugccugggaaaauggcguuugugggauccgaucuaccacucgcauggagaaccuuuuguggaagcagauugcaaaugaacugaacuauauccucugggagaauaacauuaaacugaccguggugguaggagauaucauaggcgucuuagaacaggggaagagaacacugacgccacagccuauggagcuuaaauacagcuggaagaccuggggaaaggcuaaaauugugacugccgagacacaaaacucaaguuucaucauugacggccccaauaccccagaaugccccuccgcgagcagggccuggaacguuugggagguggaagacuaugguuuuggggucuucacaacuaauaucugguugaagcuccgggagguguacacccagucuugugaucaucgccugaugucagcugcaauaaaagacgaaagagccguucacgcugauaugggauacuggaucgagagucagaagaacggcagcuggaaacuagagaaggccuccuuuauugaagugaagacgugcacauggccuaaaucucacacccuguggucgaaugguguacucgagagcgacaugaucauuccaaagucccuggcaggcccgaucucacagcauaaccacaggcccggguaucauacucaaaccgcgggaccuuggcaccuuggcaaauuggaacuggauuucaauuacugcgaggggacaacugucgugauagccgagaacuguggaacccguggcccaaguuuacggacaacgaccgugucugguaagcucauucacgaauggugcugucgaagcugcacucugcccccucuuagauauaugggggaggacggauguugguacggcauggaaaucaggccaaucaaugagaaagaagagaacauggucaagucccugguuucagcugguagcggcaagguggauaauuuuacaauggggguauugugccucgccauucuguucgaggaagugaugcgcggaaaauucggcaagaaacauaugaucgcagggguccuauuuaccuucgugcugcuccugucuggacagauuacuuggcgggacauggcucacacacuuauaaugaucggcuccaacgccagugauagaauggguauggggguuaccuauuuggcacugauugccacguuuaagauccagcccuucuuagcucucggauuuuuccugaggaaacuuacuagccgcgagaaucugcuacucggcgugggccuggcgauggccaccacauugcaacugccggaagacauugagcagauggcaaacgggaucgcuuuaggacucaugacccugaagcuuauaacucaguuugaaacauaccagcuguggaccgccuuggucucucucacauguuccaauacuaucuucacccugacgguggccuggcgaacagcuacccuaauucuggcagguguuucacuucucccucugugccaaaguagcucgaugcggaagacugauugguugccaaugaccguggccgcgaugggcguccccccucugcccuuauuuaucuucucccucaaagacacaccaaagcguaaaucuuggccucugaacgaggggguaauggcugugggacuuguuagcauucuggccucaaguuugcucagaaacgaugugcccauggcaggcccacuggucgccggugggcuacugaucgcuuguuaugugauaacuggaaccuccgcagaccuuacgguagagaaggccgcggacgugacaugggaagaggaagcugagcagaccggcgucucucauaaucucaugauuacuguugaugacgauggcacaaugaggaucaaagacgaugaaaccgagaacauccugacuguguuguuaaagacagcccugcucauugugagcgggauauuuccguacuccaucccugcaacccugcuugucuggcacacguggcagaaacagacucaacgcucaggagugcugugggacguucccagcccacccgagacccagaaggccgaauuggaggaagguguauaccggauuaagcagcagggcaucuucgggaaaacacaagugggagucggcgugcagaaggaggguguuuuucauaccauguggcacgugacaagaggggcuguccuaacucacaauggaaaaaggcuggagccuaacugggccagugugaagaaagaucucauuucuuauggcggcggguggcgacuguccgcacaguggcaaaagggagaagagguacaggucaucgcuguggaaccagguaagaaucccaaaaacuuccagaccaugccuggcauauuccagacgacaacuggggagaucggagccauugcgcuugacuuuaagccgggcaccagcgguucgccaaucauuaaucgcgaagggaaaguugugggauuauacggcaacggcgucgugacaaagaaugggggauauguuucagguaucgcccaaaccaacgcagagcccgauggcccuacuccagagcuggaagaggaaauguucaaaaagcggaaucucaccauaauggacuugcaucccgggucuggaaagacaagaaaauaccugccugcuauugugagggaggccaucaagcgucgccuccggacgcugauccuugcuccgacuagagucguggcagccgaaauggaggaggcccugaaaggcuugcccauuagguaucagaccacagcuaccaagagugaacacacuggucgagagaucguagaucuaaugugccaugcgacauuuaccaugcggcugcucuccccagugcgcguuccuaacuacaauuuaauaauuauggacgaagcacacuucacggaucccgccagcaucgcugccagaggguauauuucuacuagggucggaaugggcgaggcagccgcuaucuuuaugacagcgaccccaccuggcaccgccgaagcauucccccagagcaacgcuccaauacaggacgaggagcgggacauuccggaacgauccuggaauucagggaacgaguggaucacugauuuugugggaaaaacagugugguucgucccuaguaucaaggccgguaacgacauugcaaauugucugagaaagaacggcaaaaagguaauccaacuuagccgcaaaaccuuugauacagaauaccagaagacuaggcugaaugacugggauuucgugguuacgaccgacauuucugagaugggggccaacuuuaaagcugaucgugugauagacccccggagaugccucaagccagucaucuugacagauggacccgagagggugauucuggccggcccuaugccaguuacugcggcauccgccgcucagcgccgagguagaguggggcggaauccccagaaggaaaacgaccaauacaucuucaccggccagccucucaauaacgaugaggaccaugcccacuggacagaagcuaaaaugcugcuugacaauaucaacaccccggagggaauuauaccagcacuauucgaacccgagagggagaagucagccgcuaucgauggcgaauaucgccugaaaggggagagucguaagacuuuugucgaauugaugagacggggagacuuaccuguguggcuggcccacaaaguagcaagcgaggguauuaaguacacggauaggaaauggugcuucgacggcgaacgcaauaaccagauccucgaggagaauauggauguggaaauuuggaccaaggagggggaacgaaagaaacugagaccccgguggcuugacgcgaggacauauuccgauccacuggcccucaaggaguuuaaagacuucgcugccggacgcaagucuaucgcauuggaucugguuacugaaauaggcagagucccuucgcaucuagcucacaggacccggaacgcccuggacaaucucgugaugcuucauacaagcgagcacggugggcgugcauaccgccacgccguggaggaacugcccgagaccauggaaacuuuauugcugcucggccugaugauccuucugacaggaggcgcuaugcucuuuuugauuucagggaaaggaaucgguaagacguccauuggccugaucugugucauaguuaguucugggauguuauggauggcggaugugccacuacaguggauugccagcgcaaucguacuggaguucuuuaugauggugcuccuuauuccugagccggaaaagcaacgaaccccccaggacaaccagcuggcuuaugucgugaucggaauauugacucuggccgccaucguugcagcuaaugagaugggccuccuggaaacaaccaaaagagaucuugguauguccaaggagccagggguggucucaccuaccucuuaccucgacguagaccugcaucccgccagcgcguggacauuguaugcuguggccacuacgguuauuaccccaaugcugaggcacacaaucgaaaacaguacugcaaacguguccuuagccgcuauugcaaaucaagccgucgugcuaaugggccuggauaaaggauggccuaucagcaagauggaccucggcgucccccuucuggcguuggggugcuacucucaggugaacccgcugacccucacagcugccguucugcuuuuagugacccauuacgcaauaauuggaccaggccugcaggccaaagcuacucgggaggcccagaagcgcacggcagcugguaucaugaagaauccuacaguagaugggaucaugaccauugaccucgaucccgugaucuaugacucaaaauucgagaagcaauugggacaggucaugcugcuaguucugugugccgugcagcuccuucugaugagaacuuccugggcguugugcgaagcccugacccucgcaacaggcccaauaacuacccugugggaggguagucccggcaaauuuuggaacacaacgauugcugucagcauggccaauaucuucagggggucguacuuagcaggagcuggccuugccuuuucuauuaugaaguccguggggaccggacggcgaggcacugguagccagggggaaacacugggagagaaauggaagaagaaacucaaccaacuaucaagaaaggaauucgaucuguauaaaaagaguggcaucaccgagguagaccgcacugaggccaaagaagguuugaagaggggcgagacaacccaccaugcggugucucggggguccgcuaaacugcagugguuuguugaacguaauauggugauaccugagggaagagucaucgaucucggcugugggaggggaggcuggagcuacuauugcgcaggucuuaagaaggugacggaaguccgcggguacaccaaaggaggcccgggccacgaggagcccgugccaaugucaacauauggguggaacauuguuaagcugaugaguggaaaagacguauucuacuugccucccgaaaagugugauacucugcucugcgacaucggugagagcuccccuucuccaaccguggaagagagccggacaauucgagucuuaagaaugguggagcccuggcugaggaauaaccaguucuguaucaaaguucuuaauccuuacaugccaaacgugauugaacaccuggagcgccuacagcggaaguauggcgggaugcucgucagaaauccccugucccguaacucaacucaugaaauguacuggaucucuaauggaaccggcaacauagugaguucgguaaacauggugagcagguugcugcucaaucgguuuacaaugacccaccgccgaccgacuauugagaaggauguugaccuuggugccgggacgagacaugucaacgcugaaccugagacaccaaauauggacgugaucggagagaggaucaaacggauuaaggaagagcacuccucuaccuggcacuaugaugacgaaaaccccuacaaaacuugggccuaucauggcucauacgaggugaaggcaaccggcagcgccuccaguaugauaaauggggucguuaaacuguuaacaaagccuugggaugugguaccaauggugacgcaaauggcuaugaccgacacuacacccuucggacagcagcgcgucuuuaaggaaaaaguggauaccagaacuccgaggccuaugcccgguacacgaaagguuauggagaucaccgcggaguggcuguggcggacauugggccguaacaaaaagccaagacucugcacucgcgaagaguucaccaaaaaggugaggacgaaugccgcaaugggggcugucuuuaccgaagagaaccaaugggacucugcccgggcagccguggaagaugaggaguucuggaagcugguagacaaagaaagagagcuacacaagcuuggaaaauguggcagcugcguuuauaauaugauggguaagcgcgaaaaaaagcugggggaguuuggaaaagcuaagggcucaagggccauuugguacauguggcucggcgcgcgauaccuggaguucgaagcauugggguuucugaacgaggaucauugguucucccgggaaaauaguuauagcggaguggagggugaaggccuccacaagcuuggguacauccugagagacauuucuaaaaucccuggaggcgccauguaugcugaugacacagccgguugggacacuaggauaaccgaggaugacuuacauaacgaggaaaagaucacacagcagauggaucccgagcaccgccagcuggcaaaugcuauuuuuaaauugacuuaccaaaacaaggucgugaaagugcagcguccaacccccaaggggacggucauggacaucauuucccggaaggaucagagaggaucaggccagguuggcacauaugggcucaauaccuucacuaacauggaagcccaacuggugaggcagauggagggagaagguguacuaagcgaggcugaccuugagaacccucaccugcucgaaaaaaagaucacacaguggcuggagaccaaaggcguggaacgcuugaagcgaauggccauaucgggggaugacugcgucgugaaaccaauugaugaccgguuugcaaaugcguuacuggcccucaacgauaugggaaagguuagaaaggacaucccgcaguggcaacccucuaaaggcuggcaugauuggcagcaggugccuuucuguagucaccauuuccacgagcuuaucaugaaggacgguaggaaacuggucgugccaugccgcccccaggacgaacuaauugggagagcucggauaucccaaggagccggcuggagccugaaggagacugcaugucucggcaaagcuuacgcccagauguggucauugauguauuuucacaggcgugaucugcgacuugcauccaaugccaucugcucugcgguaccugcucauuggauuccaaccagccgcacaacguggaguauccacgcccaucaccaguggaugaccacugaggacaugcugacaguuuggaacagaguguggauugaagauaaucccuggauggaggacaagaccccugucacuacaugggaagaugugccguaccucgggaagcgggaggaccaaugguguggauccuuaaucggucugaccagcagggcaacgugggcccagaacauauugacagcuauccagcagguucgcucucugauuggcgaugaggaauuccucgacuacaugccaucaaugaaaagauuucggaaggaggaagagagugaaggggccaucugguga

SEQ ID NO: 15245 - RNA, 9873 nt, Artificial Sequence
  derived and/or modified CDS sequence (opt3) from DENV-3__FJ639731__SS-prME
accagccugugccucaugaugaugcuucccgcaacucuggcuuuccacuugacuuccagggacggagaaccuaggaugaucguggggaagaacgaacggggaaagucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaccgccgagacaagcguagcgucgcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcaaagagcaaacccacacucgacaucgagcugcagaagaccgaagcaacucaacuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugccaagaagcaagaggucgugguccucggcucacaggaaggagcuaugcacacugcccugacaggcgcuaccgagauccagaacagugggggaacaagcaucuucgccggucacuuaaagugucggcugaaaauggauaagcuagaacucaaaggcaugucuuacgcaaugugccugaauacuuuugugcuuaagaaagagguuuccgagacccagcaugggacgguguugauuaagguagaauacaagggagaggacgcccccuguaaaauaccuuucucaaccgaagauggccaagguaaggcucacaacgggcgucugaucacagcgaacccagucgugacuaaaaaggaggagcccguuaauauugaagcagagccgccuuucggcgaaagcaacaucgugauaggaauuggcgacaaagcccucaagaucaauugguauaagaaagggaguucuaucggaaagauguuugaggcuaccgcccgcggugcaagaaggauggccauucugggcgauacagcuugggacuucggguccgucggaggcgugcuuaacagccuggguaaaaugguacaucagaucuuugggucggccuacacugcauuguucucuggcguguccuggauuaugaagauaggaaucggcguucuccugaccuggauuggguuaaauucaaagaacacgaguaugagcuuuuccugcaucgucaucggaauuauaacacuguaucuaggcgcgguggugcaggcugauauggguugugccaucaauuggaaggggaaggaacucaaaugcggaucuggcauuuucgucaccaacgagguucacacuuggacagagcaguacaaguuucaagcagacagccccaaacggcuggccaccgcuaucgccggugcaugggaaaauggcgugugugggauucgaucaacuacccgcauggagaaccuuuuguggaagcagaucgcuaaugaacugaacuauauacucugggagaauaacaucaaacugacagugguagucggagauauuaucggcguguuagaacaggggaagagaacgcugaccccacagccuauggagcuuaaauacaguuggaagacuuggggaaaggccaaaauuguuacagcggagacccaaaauuccagcuucaucauagacggccccaacacaccagaaugccccucugccucaagggcuuggaacgugugggaggucgaagacuaugguuuugggguguucacuaccaauauuugguugaagcuccgggagguuuacacgcagaguugugaucaucgccugaugagcgcagccaucaaagacgaaagagcugugcacgccgauaugggauacuggauugagucccagaagaacggcucuuggaaacuagagaaggcaucguuuaucgaaguaaagacaugcaccuggccuaaaagccacacucugugguccaaugguguccucgagucagacaugauaaucccaaagagucuggcgggcccgauuucucagcauaaccacaggcccggguaucauacccaaacagccggaccuuggcaccuuggcaaauuggaacuggauuucaauuacugcgaggggacuaccguggugaucacagagaacuguggaacgcguggccccagcuuacggaccacuacagucuccgguaagcucauucacgaauggugcugucgaucaugcacccugcccccucuuagauauaugggggaggacggauguugguacggcauggaaaucaggccaauaaaugagaaagaagagaacaugguuaagagccuggugucugcugguuccggcaagauggauaauuuuacuauggggguauugugccucgccauucuguucgaggaagugaugcgcggaaaauucggcaagaaacauaugaucgcagggguccuauuuacauucgugcugcuccugaguggacagaucaccuggcgggacauggcucacacgcuuauuaugaucggcagcaacgccucugauagaauggguauggggguuacuuauuuggcacugauugccaccuuuaagauacagcccuucuuagcucucggauuuuuccugaggaaacuuacaucccgcgagaaucugcuacucggcgugggccuggcgauggccaccacuuugcaacugccggaagacaucgagcagauggcaaacgggauugcuuuaggacucaugacacugaaacuuaucacccaguuugaaacauaccagcuguggacugccuuggucucacucaccuguaguaauacgauuuucacacugaccguggccuggcgaacugcuacccuaauccuggcggguguuagccuucucccucugugccaaucguccucuaugcggaagacagauugguugccaaugacuguggccgcgaugggcguaccaccucugcccuuauuuauauucagccucaaagacaccccaaagcguagaucauggccucugaacgaggggguaauggcugugggacuuguuaguauccuggccuccucuuugcucaggaaugaugugcccauggcaggcccacuggucgccggugggcuacugauugcuuguuaugugaucacgggaacaagcgcagaccuuaccguagagaaagccgcggacgugacuugggaagaggaagcugagcagacaggcgucucccauaaccucaugauuaccguugaugacgauggcacuaugcgcaucaaggacgaugaaacagagaacauacugaccguguuguuaaaaacggcccugcucauugugucagggaucuuuccguacagcaucccugcaacucugcuugucuggcacaccuggcagaagcagacacaacggaguggagugcugugggacguucccucuccacccgagacccagaaagccgaauuggaggaagguguauacagaauuaagcagcagggcauauucgggaagacacaagugggagucggcgugcagaaagaggguguuuuucauacuauguggcacgugaccagaggggcuguccuaacgcacaauggaaagcgacuggagccuaacugggccuccgugaaaaaggaucucaucagcuauggcggcggguggcgccugaaugcacaguggcaaaaaggagaagagguacaggucauugcuguggaaccagguaagaaccccaagaauuuccagacaaugccuggcaucuuccagacuaccacaggggagauuggagccaucgcgcuugacuuuaaaccgggcaccucggguucaccaauaaucaacaaggaagggaaaguugugggauuauacggcaauggcgucgugacuaagaacgggggauauguuucugguauugcccaaaccaaugcagagcccgauggcccuacaccagagcuggaagaggaaauguucaaaaagcggaaccucacgaucauggacuugcaucccgggaguggaaagacuagaaaauaccugccugcuauugugagggaggccaucaagcgucgccuccggacccugauacuugcuccgacaagagucguggcagccgaaauggaggaggcccugaaaggcuugcccauuagguaucagaccacugcuacaaaguccgaacacaccggucgagagaucguagaucuaaugugccaugcgacguuuacuaugcggcugcucagcccagugcgcguuccuaauuacaacuuagucaucauggacgaagcacacuucacagaucccgccucuauugcugccagaggguauaucagcaccagggugggaaugggcgaggcagccgcuauauuuaugaccgcgacuccaccuggcacagccgaagcauucccccaguccaaugcuccaauucaggacgaggagcgggacaucccggaacgaucauggaacagugggaaugaguggauuaccgauuuugugggaaaaacagucugguucguaccuagcaucaaggccgguaacgacauagcaaacugucugagaaagaauggcaaaaaggugauucaacuuucucgcaaaacuuuugauacggaauaccagaagaccaggcugaacgacugggauuucguugugacaacugacaucuccgagaugggggccaauuuuaaagcugaucgugucaucgacccccggagaugccucaagccagugauuuugaccgauggacccgagaggguuauccuggccggcccuaugccagugacagcggcaucagccgcucagcgccgagguagagucgggcggaacccccagaaggaaaaugaccaauacauuuucaccggccagccucucaacaaugaugaggaccaugcccacuggacugaagcuaaaaugcugcuugacaacauaaauacgccggagggaaucauuccagcacuauucgaacccgagagggagaagagugccgcuaucgauggcgaauaucgccugaaaggggagagccguaagaccuuuguggaauugaugagacggggagacuuaccuguauggcuggcccacaaaguggcauccgaggguaucaaguacacagauaggaaauggugcuucgacggcgaacgcaacaaucagauucucgaggagaacauggauguugaaauauggacuaaggagggggaacgaaagaaacugagaccccgguggcuugacgcgaggaccuauucugauccacuggcccucaaggaguuuaaagacuucgcugccggacgcaagucgaucgcauuggaucuggucacagaaauuggcagagugccuagccaucuagcucacaggacccggaaugcccuggacaaccucgugaugcuucauacuucagagcacggugggcgugcauaccgccacgccgucgaggaacugcccgagacaauggaaacguuauugcugcucggccugaugauccuucugaccggaggcgcuaugcucuuuuugauuuccgggaaaggaaucgguaagacaaguauaggccugaucuguguuauugugucuagcgggauguuauggauggcggauguaccacuacaguggaucgccuccgcaauugugcuggaguucuuuaugaugguccuccuuaucccugagccggaaaagcaacgaacaccccaggacaaucagcuggcuuaugugguuauaggaauuuugacccuggccgccaucguggcagcuaacgagaugggccuccuggaaaccacaaaaagagaucuugguaugucaaaggagccaggggucguaucuccuacuagcuaccucgacguggaccugcaucccgccagugcguggacguuguaugcuguugccaccacagugauuacuccaaugcugaggcacaccaucgaaaauuccacagcaaacgucagcuuagccgcuauagcaaaccaagccgugguccuaaugggccuggauaaaggauggccuaucucuaagauggaccucggcgugccccuucuggcguuggggugcuacucacagguuaauccgcugacccucacugcugccgugcugcuuuuaguaacgcauuacgcaauuaucggaccaggccugcaggccaaagcuacacgggaggcccagaagcgcaccgcagcugguauuaugaagaacccuacuguggaugggaucaugaccauagaccucgaucccgucauuuaugacuccaaauucgagaagcaauugggacagguuaugcugcuagugcugugugccguccagcuccuucugaugagaacaaguugggcguugugcgaagcccugacucucgcaaccggcccaaucacaacgcugugggaggguagccccggcaaauuuuggaauaccacuaucgcugugucgauggccaacauuuucagggggucuuacuuagcaggagcuggccuugccuuuuccaucaugaaaagcguagggacaggacggcgaggcaccgguucacagggggaaacucugggagagaaauggaagaagaaacucaaucaacuaaguagaaaggaguucgaucuguauaaaaagucuggcauaacagagguggaccgcaccgaggccaaagaagguuugaagaggggcgagacgacccaccaugcgguuucccgggggagcgcuaaacugcagugguuuguggaacguaacauggucauuccugagggaagagugaucgaucucggcugugggaggggaggcuggucauacuauugcgcaggucuuaagaaggucacagaagugcgcggguacacuaaaggaggcccgggccacgaggagcccguuccaaugaguaccuauggguggaauauuguaaagcugaugagcggaaaagacguguucuacuugccucccgaaaagugugauacacugcucugcgacaucggugaguccucuccuagcccaacugucgaagagucccggaccauacgaguguuaaaaaugguugagcccuggcugagaaacaaucaguucuguaucaaggugcuuaacccuuacaugccaacagucauugaacaccuggagaggcuacagcgcaaguauggcgggaugcucgugcggaauccccugucaagaaacucuacccaugaaauguacuggaucaguaauggaacuggcaacauuguaucgagcgugaauaugguuucccguuugcugcucaacagguuuacgaugacacaccggcgcccgaccaucgagaaagaugucgaccuuggugccgggacucgacaugugaacgcugaaccugagaccccaaauauggacgugauuggagagagaaucaagaggauaaaagaagaacacucuucaacauggcacuaugaugacgaaaaccccuacaagacgugggccuaucauggcagcuacgaggucaaagcaaccggcuccgccaguucuaugauuaaugggguugugaagcuguuaacuaagccuugggauguagugccaauggucacacaaauggcuaugaccgacacuacacccuucggacagcagcggguguuuaaagaaaagguugauacccgcacaccgagaccuaugcccgguacuaggaaagugauggagaucaccgcggaguggcuguggcgaacguugggccggaacaagaaaccacgucucugcaccagagaagaguucacaaagaagguccgcacuaaugccgcaaugggggcuguguuuaccgaagagaaccaaugggacagcgccagggcagccguagaagaugaggaguucuggaaacugguugaccgggaaagagagcuacacaaacuuggaaaauguggcucaugcguguauaauaugauggguaagcgcgagaagaagcugggggaguuuggaaaagcuaagggcuccagggccaucugguacauguggcucggcgcgcgauaccuggaguucgaagcauugggguuucugaacgaggaucauugguucagucgggaaaauagcuauucuggagucgagggugaaggccuccacaaacuuggguacauucugagagacauauccaaaaucccuggaggcgccauguaugcugaugacacagccgguugggacacuaggauuaccgaggaugacuuacauaacgaggaaaagaucacgcagcagauggaucccgagcaccgccagcuggcaaaugcuauuuuuaaauugacauaccaaaacaagguggugaaaguccagcguccaacccccaaggggacuguuauggacaucauaucacggaaggaucagagaggaagcggccaggugggcacauaugggcucaauaccuucacuaacauggaagcccaacugguaaggcagauggagggagaaggugugcuaucgaaagcugaccuugagaauccucaucugcucgagaagaaaaucacccaguggcuggaaacaaagggcgucgagcgcuugaaacgaauggccauuucuggggaugacugcgugguuaagccaaucgaugaccgguuugcaaacgcguuacuggcccucaacgauaugggaaaggugagaaaagacauuccgcaguggcaacccaguaagggcuggcaugauuggcagcaggucccuuucuguucccaccauuuccacgaacuuaucaugaaagacgguaggaagcuggugguaccaugccgcccccaggacgagcuaauagggagagcucggauuagccaaggagccggcuggucacugaaagaaacggcaugucucggcaaggcuuacgcccagaugugguccuugauguauuuucacaggcgugaucugcgacuugcaucuaaugccaucugcagcgcgguuccugugcauuggaucccaaccagucgcacuacaugguccauucacgcucaucaccaguggaugaccacugaggacaugcugacagucuggaacagaguguggauagaggauaaucccuggauggaagacaagaccccuguuacgacaugggaggaugugccguaccucgggaaacgggaagaccaaugguguggcagcuuaaucggucugaccucuagggccacuugggcacagaacauuuugaccgccauccagcagguccgcucacugauuggcgaugaggaguuccucgacuacaugccaaguaugaagagauuucggaaagaagaggaauccgagggggcuaucugguga

SEQ ID NO: 15246 - RNA, 9873 nt, Artificial Sequence
  derived and/or modified CDS sequence (opt3) from DENV-3__HM181933__SS-prME
accagccugugccucaugaugaugcuucccgcaacacuggcuuuccacuugacuuccagagacggcgaaccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaccgccgagacaagcguagcgucgcccuggcaccccacgugggcauggguuuggauacacggacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaaaagcaaacccacacucgacaucgagcugcagaagaccgaagcaacucaacuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugccaagaagcaagaggucgugguccucggcucacaggaaggagcuaugcacacugcccugacaggcgcuaccgagauccagaacagugggggaacaagcaucuucgccggucacuuaaagugucggcugaaaauggauaagcuagaacucaaaggcaugucuuacgcaaugugccugaauacuuuugugcuuaagaaagagguuuccgagacccagcaugggacgauuuugauaaagguggaauacaagggagaggacgcccccuguaaaaucccuuucucaaccgaagauggccaagguaaggcucacaacgggcgucugauuacagcgaacccaguagucacuaaaaaggaggagcccgugaauaucgaagcagagccgccuuucggcgaaagcaacauaguuauuggaaucggcgacaaagcccucaagaucaauugguauaagaaagggaguucuauuggaaagauguuugaggcuaccgcccgcggugcaagaaggauggccauccugggcgauacagcuugggacuucggguccgugggaggcguccuuaacagccuggguaaaauggugcaucagauuuuugggucggccuacacugcauuguucucuggcguauccuggauaaugaagaucggaauuggcgugcuccugaccuggaucggguuaaauucaaagaacacgaguaugagcuuuuccugcaucguuauuggaauaaucacacuguaucuaggcgcggucgugcaggcugauauggguugugccauuaauuggaaggggaaggaacucaaaugcggaucuggcaucuucgugaccaacgagguccacacuuggacagagcaguacaaguuucaagcagacagccccaaacggcuggccaccgcuauugccggugcaugggaaaauggcguuugugggauccgaucaacuacccgcauggagaaccuuuuguggaagcagauagcuaaugaacugaacuauauccucugggagaauaacauuaaacugacaguggugguaggagauaucauuggcgucuuagaacaggggaagagaacgcugaccccacagccuauggagcuuaaauacaguuggaagacuuggggaaaggccaaaaucgugacagcggagacccaaaauuccagcuucauaauugacggccccaacacaccagaaugccccucugccucaagggcuuggaacguuugggagguggaagacuaugguuuuggggucuucacuaccaauaucugguugaagcuccgggagguguacacgcagaguugugaucaucgccugaugagcgcagccauuaaagacgaaagagcuguucacgccgauaugggauacuggaucgagucccagaagaacggcucuuggaaacuagagaaggcaucguuuauagaagugaagacaugcaccuggccuaaaagccacacucugugguccaaugguguacucgagucagacaugaucauuccaaagagucuggcgggcccgaucucucagcauaaccacaggcccggguaucauacccaaacagccggaccuuggcaccuuggcaaauuggaacuggauuucaauuacugcgaggggacuaccgucgugauuacagagaacuguggaacgcgucggcccagcuuacgaaccacuacaguguccggcaagcucauccacgaauggugcuguagaucaugcacccugcccccucuuagguauaugggugaggacggguguugguacggaauggaaauacgcccaauuaaugagaaagaagagaacauggucaagagccugguuucugcuggcuccgguaagguggauaauuuuacuaugggcguauugugccucgccauccuguucgaggaagugaugcgggggaaauucggaaagaaacauaugaucgcaggcguccuauuuacauucgugcugcuccugagugggcagauuaccuggagagacauggcucacacgcuuaucaugauuggaagcaacgccucugauaggaugggcauggguguuacuuauuuggcacugauagccaccuuuaagauccagcccuucuuagcucucggguuuuuccugcgcaaacuuacaucccgagagaaucugcuacucggagugggccuggcgauggccaccacuuugcaacugccggaagacauugagcagauggcaaacggcaucgcuuuagggcucaugacacugaaacuuauuacccaguuugaaacauaccagcuguggacugccuuggucucacucaccuguaguaauacgaucuucacacugaccguggccuggcggacugcuacccuaauacuggcaggaguuagccuucucccucugugccaaucguccucuaugcguaagacagauugguugccaaugacuguggccgcgauggguguaccaccucugcccuuauuuaucuucagccucaaagacaccccaaagagaaggucauggccucugaacgagggcguaauggcuguggggcuuguuaguauucuggccuccucuuugcuccgcaaugaugugcccauggcaggaccacuggucgccggcggucuacugaucgcuuguuaugugauuacggggacaagcgcagaccuuaccguagagaaagccgcggacgugacuugggaagaggaagcugagcagacaggagucucccauaaccucaugaucaccguugaugacgauggcacuaugcggauaaaggacgaugaaacagagaacauucugaccguguuguuaaaaacggcccugcucaucgugucaggcaucuuuccguacagcauuccugcaacucugcuugucuggcacaccuggcagaagcagacacaaagaaguggggugcugugggacguucccucuccacccgagacccagaaagccgaauuggaggaaggaguauacaggauaaagcagcaggguaucuucggcaagacacaagugggggucggagugcagaaagagggcguuuuucauacuauguggcacgugacccgaggugcuguccuaacgcacaaugggaagcgccuggagccuaacugggccuccgugaaaaaggaucucauuagcuauggaggcggcuggcggcugaaugcacaguggcaaaaaggggaagagguacaggucaucgcuguggaaccaggaaagaaccccaagaauuuccagacaaugccugguauuuuccagacuaccacaggcgagaucggggccauagcgcuugacuuuaaaccgggaaccucgggcucaccaaucauuaacagagaagguaagguugugggguuauacggaaauggcgucgugacuaaaaacggcggguauguuucuggaaucgcccaaaccaaugcagagcccgaugguccuacaccagagcuggaagaggaaauguucaagaaaaggaaccucacgauuauggacuugcaucccggcagugggaagacucguaaguaccugccugcuaucgugcgcgaggccauaaaacggagacucaggacccugauucuugcuccgacacgagucguggcagccgaaauggaggaggcccugaagggauugcccauccgguaucagaccacugcuacaaaauccgaacacaccggccgcgagaucguagaucuaaugugccaugcgacguuuacuaugagacugcucagcccagugaggguuccuaauuacaacuuagucauuauggacgaagcacacuucacagaucccgccucuaucgcugcccgggguuauauaagcacccgaguggggaugggagaggcagccgcuauuuuuaugaccgcgacuccaccuggcacagccgaagcauucccccaguccaaugcuccaauccaggacgaggagagagacauuccggaacgcucauggaacaguggcaaugaguggaucaccgauuuuguggggaagacagucugguucguaccuagcauaaaagccggaaacgacauugcaaacugucugaggaagaaugguaagaaagugauccaacuuucucguaagacuuuugauacggaauaccagaaaacccggcugaacgacugggauuucguugugacaacugacaucuccgagaugggcgccaauuuuaaggcugauagagucauugaccccaggcgcugccucaaaccagugaucuugaccgaugggcccgagcgaguuauucuggccggaccuaugccagugacagcggcaucagccgcucagagacggggcagggucggucgcaacccccagaaggaaaaugaccaauacauauucaccgggcagccucucaacaaugaugaggaccaugcccacuggacugaagcuaagaugcugcuugacaacaucaauacgccggagggcauuaucccagcacuauucgaacccgagcgugagaaaagugccgcuaucgauggagaauauagacugaagggcgagagccggaaaaccuuuguggaauugaugaggcgcggggacuuaccuguauggcuggcccacaagguggcauccgagggaauuaaauacacagaucgaaaguggugcuucgacggugaaagaaacaaucagauacucgaggagaacauggauguugaaaucuggacuaaagagggcgaacggaagaagcugaggccccgcuggcuugacgcgagaaccuauucugauccacuggcccucaaagaguuuaaggacuucgcugccgggaggaaaucgauugcauuggaucuggucacagaaaucggacgggugccuagccaucuagcucaccguacccgcaaugcccuggacaaccucgugaugcuucauacuucagagcacggcggucgagcauacagacacgccgucgaggaacugcccgagacaauggaaacguuauugcugcucgggcugaugauucuucugaccggcggagcuaugcucuuuuugaucuccggcaaggggauaggaaaaacaaguaucggucugauuuguguuaucgugucuagcggcauguuauggauggcggauguaccacuacaguggauugccuccgcaaucgugcuggaguucuuuaugaugguccuccuuauaccugagccggaaaagcaaaggacaccccaggacaaucagcuggcuuaugugguuauugggaucuugacccuggccgccauuguggcagcuaacgagaugggacuccuggaaaccacaaagcgggaucuuggcaugucaaaagagccaggugucguaucuccuacuagcuaccucgacguggaccugcaucccgccagugcguggacguuguaugcuguugccaccacagugaucacuccaaugcugcgccacaccauagaaaauuccacagcaaacgucagcuuagccgcuaucgcaaaccaagccgugguccuaauggggcuggauaagggcuggccuauuucuaaaauggaccucggagugccccuucuggcguugggcugcuacucacagguuaauccgcugacccucacugcugccgugcugcuuuuaguaacgcauuacgcaaucauugggccaggacugcaggccaaggcuacaagagaggcccagaaaaggaccgcagcuggcaucaugaagaacccuacuguggaugguauaaugaccauugaccucgaucccgucaucuaugacuccaaguucgagaaacaauuggggcagguuaugcugcuagugcugugugccguccagcuccuucugaugcggacaaguugggcguugugcgaagcccugacucucgcaaccggaccaaucacaacgcugugggagggcagccccgguaaguuuuggaauaccacuauugcugugucgauggccaacaucuuccgaggcucuuacuuagcaggggcuggacuugccuuuuccauaaugaaaagcguaggcacagggagacgcggaaccggcucacagggugaaacucugggggagaaguggaaaaagaagcucaaucaacuaaguaggaaagaguucgaucuguauaagaaaucuggaauuacagagguggaccggaccgaggccaaggaaggcuugaaacguggugagacgacccaccaugcgguuuccagaggcagcgcuaagcugcagugguuuguggaaaggaacauggucaucccugaggggcgcgugauugaucucggauguggcagagggggauggucauacuauugcgcaggccuuaaaaaggucacagaagugcgagguuacacuaaagggggaccgggccacgaggagcccguuccaaugaguaccuauggcuggaauaucguaaaacugaugagcgggaaggacguguucuacuugccucccgaaaaaugugauacacugcucugcgacauaggagaguccucuccuagcccaacugucgaagaguccagaaccaucaggguguuaaagaugguugagcccuggcugcgcaacaaucaguucuguauuaaagugcuuaacccuuacaugccaacagucaucgaacaccuggagcggcuacagagaaaguaugguggcaugcucgugcguaauccccugucaaggaacucuacccaugaaauguacuggauuaguaaugggacuggaaacaucguaucgagcgugaauaugguuucccgguugcugcucaaccgcuuuacgaugacacaccgaagaccgaccauugagaaggaugucgaccuuggcgccgguacuaggcaugugaacgcugaaccugagaccccaaauauggacgugaucggggagcggauaaaacgcauuaaggaagaacacucuucaacauggcacuaugaugacgaaaaccccuacaaaacgugggccuaucauggaagcuacgaggucaaggcaaccggcuccgccaguucuaugaucaauggcguugugaaacuguuaacuaagccuugggauguagugccaauggucacacaaauggcuaugaccgacacuacacccuucgggcagcagagaguguuuaaggaaaaaguugauaccaggacaccgcgaccuaugcccggaacucggaaggugauggagaucaccgcggaguggcuguggcguacguuggguagaaacaaaaagccacgccucugcaccagggaagaguucacuaagaagguccggacuaaugccgcaaugggcgcuguguuuaccgaagagaaccaaugggacagcgccagagcagccguagaagaugaggaguucuggaagcugguugaccgcgaaagggagcuacacaaacuugggaaguguggaucaugcguguauaauaugaugggcaaacgagaaaagaaacugggugaguuugggaaggcuaaaggaucccgggccauuugguacauguggcucggcgcgagauaccuggaguucgaagcauugggcuuucugaacgaggaucauugguucaguagggaaaauagcuauucuggggucgagggagaaggucuccacaaacuuggcuacauacugcgcgacaucuccaagauuccugggggagccauguaugcugaugacacagccggcugggacacucguaucaccgaggaugacuuacauaacgaggagaaaauuacgcagcagauggaucccgagcaccggcagcuggcaaaugcuaucuuuaaguugacauaccaaaacaaaguggugaagguccagagaccaacccccaaagguacuguuauggacauaaucucaaggaaggaucagcgcgggagcggacaggugggcacauauggccucaauaccuucacuaacauggaagcccaacugguacgacagauggagggggaaggagugcuaucgaaggcugaccuugagaauccucaucugcucgagaaaaagauuacccaguggcuggaaacaaaaggugucgagcgguugaagagaauggccaucucuggcgaugacugcgugguuaaaccaauugaugacagguuugcaaacgcguuacuggcccucaacgauauggggaaggugcgcaaggacaucccgcaguggcaacccaguaaaggauggcaugauuggcagcaggucccuuucuguucccaccauuuccacgaacuuauaaugaaggacggcagaaaacuggugguaccaugccggccccaggacgagcuaauugguagggcucguaucagccaaggggccggauggucacugaaggaaacggcaugucucggcaaggcuuacgcccagaugugguccuugauguauuuucaccgacgcgaucugagacuugcaucuaaugccaucugcagcgcgguuccugugcauuggauuccaaccagucggacuacaugguccauacacgcucaucaccaguggaugaccacugaggacaugcugacagucuggaacaggguguggaucgaggauaaucccuggauggaagacaagaccccuguuacgacaugggaggaugugccguaccucggcaagcgcgaagaccaauggugugggagcuuaauuggacugaccucuagagccacuugggcacagaacaucuugaccgccauucagcagguccggucacugaucggugaugaggaguuccucgacuacaugccaaguaugaaaagguuucgaaaggaagaggaauccgagggcgcuauaugguga

SEQ ID NO: 15247 - RNA, 9873 nt, Artificial Sequence
  derived and/or modified CDS sequence (opt3) from DENV-3__JF295012__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagagcaaacccacacucgacaucgagcugcagaagaccgaagcaacucaacuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaaaaaggaacuguuggugaccuuuaaaaaugcccaugcaaagaagcaagaggucgugguccucggcucacaggaaggagcuaugcacacugcccugacaggcgcuaccgagauccagaacagugggggaacaagcaucuucgccggucacuuaaaauguaggcugaagauggauaaacuagaacucaagggcaugucuuacgcaaugugccugaauacuuuugugcuuaaaaaggagguuuccgagacccagcaugggacgauuuugauaaagguggaauacaaaggagaggacgcccccuguaagaucccuuucucaaccgaagauggccaagguaaagcucacaacgggcggcugauuacagcgaacccaguagucacuaagaaagaggagcccgugaauaucgaagcagagccgccuuucggcgaaagcaacauaguuauuggaaucggcgacaaggcccucaagaucaauugguauaaaaaggggaguucuauuggaaaaauguuugaggcuaccgcccguggugcacgcagaauggccauccugggcgauacagcuugggacuucggguccgugggaggcguccuuaacagccuggguaagauggugcaucagauuuuugggucggccuacacugcauuguucucuggcguauccuggauaaugaaaaucggaauuggcgugcuccugaccuggaucggguuaaauucaaagaacacgaguaugagcuuuuccugcaucguuauuggaauaaucacacuguaucuaggcgcggucgugcaggcugauauggguugugugauuaauuggaaggggaaagaacucaagugcggaucuggcaucuucgucaccaacgagguucacacuuggacagagcaguacaaauuucaagccgacagccccaagaggcuggcaaccgccauugcuggugccugggaaaauggcgugugugggauccggucaacuacccgaauggagaaccuuuuguggaaacagauagcaaaugaacugaacuauauccucugggagaauaacauuaagcugacagugguagucggagauaucauuggcguguuagaacaggggaaacgcacgcugaccccacagccuauggagcuuaaguacaguuggaagacuuggggaaaagcuaagaucguuacagccgagacccaaaauuccagcuucauaauugacggccccaacacaccagaaugccccucugcgucaagagccuggaacgugugggaggucgaagacuaugguuuugggguguucacuaccaauaucugguugaaacucagggagguuuacacgcagaguugugaucaucggcugaugagcgcugcaauuaaggacgaacgcgccgugcacgcugauaugggauacuggaucgagucccagaaaaacggcucuuggaagcuagagaaggccucguuuauagaaguaaaaacaugcaccuggccuaagagccacacucugugguccaaugguguccucgagucagacaugaucauuccaaaaagucuggcaggcccgaucucucagcauaaccacagacccggguaucauacccaaacagcgggaccuuggcaccuuggcaaguuggaacuggauuucaauuacugcgaggggacuaccguggugauuacagagaacuguggaacgaggggcccaagcuuacguaccacuacagucuccgguaaacucauccacgaauggugcugucggucaugcacccugcccccucuucgauauaugggggaggacggauguugguacggcauggaaauaagaccaauuaaugagaaggaagagaacaugguuaagagccuggugucugccgguuccggcaaaguagauaauuuuacuauggggguguugugccucgcuauccuguucgaggaagucaugaggggaaaguucggcaaaaagcauaugaucgccggggugcuauuuacauucguucugcuccugaguggacagauuaccuggcgcgacauggcacacacgcuuaucaugauuggcagcaacgcuucugaucggauggguaugggggugacuuauuuggcccugauagcaaccuuuaaaauccagcccuucuuagcccucggauuuuuccugagaaagcuuacauccagggagaaucugcuacucggcgucggccuggcuauggcgaccacuuugcaacugccggaagacauugagcagauggccaacgggaucgcauuaggacucaugacacugaagcuuauuacccaguuugaaacauaccagcuguggacugcuuuggugucacucaccuguaguaauacgaucuucacacugaccguugccuggcgcacugccacccuaauacuggcuggugugagccuucucccucugugccaaucguccucuaugcgaaaaacagauugguugccaaugacugucgcagccaugggcguacccccucugcccuuauuuaucuucagccucaaggacaccccaaaacggcguucauggccucugaacgagggggugauggcgguuggacuugugaguauucuggcuuccucuuugcucagaaaugauguccccauggccggcccacugguggcaggugggcuacugaucgccuguuauguaauuacgggaacaagcgcugaccuuaccguggagaaggcagccgacgucacuugggaagaggaagcggagcagacaggcguuucccauaaccucaugaucaccguggaugacgauggcacuaugaggauaaaagacgaugaaacagagaacauucugaccguguuguuaaagacggcucugcucaucgucucagggaucuuuccguacagcauuccugccacucugcuuguguggcacaccuggcagaaacagacacaacgcaguggaguucugugggacguacccucuccacccgagacccagaaggcagaauuggaggaagguguguaccggauaaagcagcagggcaucuucgggaaaacacaagucggagugggcguucagaaggaggguguguuucauacuauguggcacgucaccagaggggccgugcuaacgcacaauggaaaaaggcuggagccuaacugggcuuccguaaagaaagaucucauuagcuauggcggcggguggcgacugucggcccaguggcaaaagggagaagagguccaggugaucgcaguugaaccagguaagaaucccaaaaacuuccagacaaugccuggcauuuuccagacuaccacaggggagaucggagcuauagcccuugacuuuaagccgggcaccucagguucuccaaucauuaaucgcgaagggaaaguggucggauuauacggcaacggcgugguuacuaagaaugggggauaugugagugguaucgcgcaaaccaacgccgagcccgauggcccuacaccagagcuggaagaggaaauguucaaaaagcggaaucucacgauuauggacuugcaucccggguccggaaagacuagaaaauaccugccugcaaucgucagggaggcuauaaagcgucgccuccggacccugauucuugccccgacaagagugguagcugcagaaauggaggaggcccugaaaggcuugcccaucagguaucagaccacugccacaaagagcgaacacaccggucgagagaucguggaucuaaugugccaugcuacguuuacuaugcggcugcucucuccaguucgcgucccuaacuacaauuuagugauuauggacgaagcgcacuucacagaucccgcaagcaucgccgcuagaggguauauauccaccagggugggaaugggcgaggccgcagccauuuuuaugaccgcuacuccaccuggcacagcggacgccuucccccagucaaacgcaccaauccaggacgaagagcgggauauuccggagcgaaguuggaauagcgggaacgaauggaucaccgacuuugcuggaaaaacagucugguucguaccuucuauaaaggccgguaaugauauugcaaacugucugagaaagaacggcaaaaaggugauccaacuuucccgcaaaacuuuugacacggaguaccagaagaccaaacugaaugauugggacuucguugugacaacugauaucucagaaaugggggccaacuuuaaggcugacagggucauugauccccgucggugccucaagccagugaucuugaccgacggacccgagagaguuauucuggccggcccuaugccagugacagcggcaagugccgcucagaggcgcggucgagucgggagaaauccccagaaagagaacgaucaauacauauucaccggccagccucucaauaacgacgaagaccaugcccacuggacugaggcuaagaugcugcuugauaauaucaacacgccggaaggaauuaucccagcacuauucgagcccgaacgggagaaaagcgccgcuaucgacggcgaguauaggcugaagggggaaucccgcaaaaccuuuguggaguugaugcguagaggagauuuaccuguauggcuggcccacaagguggcaucugaagguauuaaauacacagaccggaaguggugcuucgauggcgagaggaauaaccagauacucgaagagaauauggacguugagaucuggacuaaggaaggggagcgcaaaaagcugcgacccagauggcuugaugcgcggaccuauucggacccacuggcccucaaagaauuuaaggauuucgcugccggaaggaaaagcauugcauuggaccuggucacagagaucggccgcgugccuucacaucuagcucacagaaccaggaacgcccuggauaaucucgugaugcuucauacuuccgaacacggugggcgggcauaccgucacgccgucgaggagcugcccgaaacaauggagacguuauugcugcucggccugaugauucuucugaccggaggcgcuaugcucuuuuugaucagugggaagggaauagguaagacuucuaucggccugauuuguguuaucgugagcuccgggauguuauggauggcggacguaccacuacaguggauugccucagcaaucgugcuggaauucuuuaugaugguccuccuuauaccugagccggagaaacaacgcacaccccaggauaaccagcuggcuuaugugguuauuggaaucuugacccuggccgccauuguggcagcuaaugaaaugggccuccuggagaccacaaagcgagaccuugguaugucuaaagaaccaggggucguaagcccuacuaguuaccucgacguggaucugcaucccgccuccgcguggacguuguaugcuguugccaccacagugaucacuccaaugcugagacacaccauagagaacagcacagcaaaugucucuuuagccgcuaucgcaaaccaagccgugguccuaaugggccuggacaagggauggccuauuucaaaaauggaucucggcgugccccuucuggcguuggggugcuacucccagguuaacccgcugacccucacugcugccgugcugcuuuuaguaacgcauuacgcaaucauuggaccaggccugcaggccaaggcuacaagggaagcccagaagcggaccgcagcugguaucaugaaaaauccuacuguggacgggauaaugaccauugaucucgaccccgucaucuaugauaguaaguucgagaaacaauugggacagguuaugcugcuagugcugugugccguccagcuccuucugaugcgcacaagcugggcguugugcgaggcccugacucucgcaaccggcccaaucacaacgcugugggaagguucgcccggcaaguuuuggaacaccacuauugcugugucuauggccaauaucuucagaggguccuacuuagcaggagcuggccuugccuuuagcauaaugaaaucaguagggacaggaaggcggggcaccgguagucagggggagacucugggagaaaaguggaagaaaaagcucaaccaacuaucucgaaaagaguucgaccuguauaagaaauccggcauuacagaaguggauagaaccgaggccaaggaggguuugaaacgcggcgaaacgacccaccaugcgguuagcagggggucagcuaagcugcagugguuuguggagcggaauauggucaucccugaaggacgugugauugaccucggcugugggagaggaggcuggaguuacuauugcgcaggucuuaagaaagucacagaggugaggggguacacuaagggaggcccgggccacgaagagcccguuccaaugagcaccuauggguggaacaucguaaaacugauguccggaaaggauguguucuacuugccucccgagaaaugugacacacugcucugcgauauaggugaaucuagcccuuccccaacugucgaggaaucacgcaccauccggguguuaaagaugguugagcccuggcugcgaaauaaccaguucuguauuaaggugcuuaauccuuacaugccaacagucaucgagcaccuggaaagacuacagaggaaauauggcgggaugcucgugcgcaacccccugucucggaauaguacccaugagauguacuggauuucgaacggaacuggcaauaucguaagcuccgugaacaugguuucuagauugcugcucaaucguuuuacgaugacacacaggcggccgaccauugaaaaggacgucgaccuuggugccgggacucgccaugugaacgcugagccugaaaccccaaacauggaugugaucggagagcgaauaaaaagaauuaaggaggaacacucaagcacauggcacuaugacgaugagaaucccuacaaaacgugggccuaucauggcuccuacgaagucaaggcaaccggcagugccucuagcaugaucaacgggguugugaagcuguuaacuaaaccuugggacguagugccaauggucacacaaauggcuaugaccgauacuacacccuucggacagcagaggguguuuaaggagaaaguugacacccggacaccgcgcccuaugcccgguacuagaaaggugauggaaaucaccgcggaguggcuguggaggacguugggccgaaauaaaaagccacggcucugcacccgugaggaauucacaaagaaagucagaacuaacgccgcaaugggggcuguguuuaccgaggaaaaucaaugggauucagcccgcgcagccguagaggacgaagaguucuggaagcugguugauagggagcgggaacuacacaaacuuggaaaguguggcuccugcguguauaacaugauggguaaaagagagaagaaacugggggaauuuggaaaggcuaagggcagucgcgccauuugguacauguggcucggcgcgagguaccuggaguucgaggcauugggguuucugaaugaagaccauugguucagccgagagaacucuuauuccggagucgaaggugagggccuccacaaacuuggguacauacugcgggauaucucaaagauuccuggaggcgccauguaugcugacgacacagccgguugggauacuagaaucaccgaagacgauuuacauaaugaggagaaaauuacgcagcagauggaccccgaacacaggcagcuggcaaacgcuaucuuuaaguugacauaccaaaauaaaguggugaagguccagcgcccaacccccaaggggacuguuauggauauaaucagccguaaagaccagcggggaucgggccaggugggcacauaugggcucaacaccuucacuaauauggaggcccaacugguaagacagauggaaggagagggugugcuaucuaaggcugaucuugaaaacccucaccugcucgagaaaaagauuacccaguggcuggagacaaaaggcgucgaaagguugaagcgcauggccaucaguggggacgauugcgugguuaagccaauugacgaucgauuugcaaaugcguuacuggcccucaacgacaugggaaaagugcggaaggauaucccgcaguggcaacccuccaaaggcuggcaugacuggcagcaggucccuuucuguagccaccauuuccacgagcuuauaaugaaggacgguagaaaacuggugguaccaugcaggccccaggaugaacuaauugggcgcgcuagaaucucacaaggagccggcuggucccugaaggagacggcaugucucggcaaggcuuacgcccagauguggucuuugauguauuuucaccggagggaccugcgucuugcaagcaacgccaucugcagugcgguuccugugcauuggauuccaaccucccgaacuacauggagcauacacgcucaucaccaguggaugaccacugaagauaugcugacagucuggaaucgcguguggaucgaggacaaccccuggauggaggauaaaaccccuguuacgacaugggaagacgugccguaccucgggaagagagaggaucaaugguguggaucuuuaauuggucugaccucacgggccacuugggcacagaauaucuugaccgccauucagcaggucaggagucugaucggcgacgaagaguuccucgauuacaugccauccaugaaacgcuuuagaaaggaggaagagagcgaaggggcuauaugguga

SEQ ID NO: 15248 - RNA, 9873 nt, Artificial Sequence
  derived and/or modified CDS sequence (opt3) from DENV-3__FJ898463__SS-prME
accagccugugccucaugaugauccuucccgcagcucuggcauuccacuugacauccagggacggagaaccuaggaugauuguggggaagaacgaacggggaaaaucuuuacuguuuaagacugcaucagguauaaauauguguacgcuaaucgcgauggaucucggcgaaaugugcgacgauaccgucacauacaaauguccacauauuacugaaguugaaccggaagacaucgauugcugguguaaccugaccaguacaugggugaccuaugggacuugcaaucaggcuggagaacaccgccgagacaagcguagcgucgcccuugcaccccaugugggcaugggucuggauacaaggacccagacguggauguccacugaaggggccuggaggcaggucgaaaaaguggagaccugggcuuugcggcacccuggauucacaauucucgcacuguuucuggcccauuacaucggcacuucucucacccagaagguugugauauucaucuuacugaugcuugucacaccaucgaugaccaugcgcugugugggcguagggaacagagacuuuguugaaggauugucaggugcuacguggguggaugucgugcuggagcacggcgggugcgugacuacaauggccaagaauaaacccacccuagacauugagcuccagaagacugaagcgacacagcuggcaacccuuaggaaacuguguaucgagggaaagauuacgaacaucaccacagauagccggugcccuacucagggcgaagccgucuugccagaggaacaggaccagaauuauguuuguaaacacaccuacguggaucgcgguugggggaacggaugcggccucuucggcaaggggagucugguaacaugcgcuaaguuucaauguuuagagcccauagagggaaaagugguccaguaugaaaaucugaaguacacugugauuaucaccguucauacaggugaccagcaccaggugggcaacgagacccaaggggucacugccgaaauuacgccucaggcauccacaaccgaggcuauccucccagaauauggaacucuuggccuggagugcucuccgcgaaccgguuuggacuucaaugagaugauccuacugacaaugaaaaacaaggccuggauggugcauagacagugguuuuucgaucucccccugccuuggaccagcggggcgacuacagaaacgccaaccuggaauaggaaagagcuucugguaacuuuuaagaacgcccacgccaagaagcaagaaguuguggucuugggcucccaggagggagcuaugcacacagcccucaccggcgcuacagaaauucaaaauucagggggaacaaguauauucgccggucaucugaagugucgguuaaaaauggacaagcuggagcuaaaaggcaugagcuacgcaaugugcaccaacacguuugugcucaagaaagaggucucugaaacccagcacgggacaauccugauuaagguggaguacaagggagaagaugcccccuguaaaaucccuuucuccacugaggacggccaagguaaggcucauaacgggcgucuuauaaccgcgaauccaguugugacuaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgccucuagggcuuggaacgugugggaaguugaggacuaugguuuugggguguucacgacaaauauuuggcugaaacuucgggaagucuacacccaguugugugaccaccgccucaugucagcagccgugaaggaugagagagcuguucacgccgacaugggauacuggaucgagagucagaaaaacggcagcuggaagcuggaaaaagcaucccuaauagaggugaagacuugcaccuggccuaagucucauacacuguggucgaaugguguacucgaaagcgauaugaucauuccaaaaucccuggcgggcccgaucucacagcacaaccauaggcccggguaucacacucaaaccgccggaccuuggcaccuuggcaaguuggagcuggacuuuaauuacugcgaggggacaacggucgugauuaccgaaaacuguggaacucguggcccaaguuuacggacaaccacugugucugguaaacucauccaugaguggugcugucgaagcugcacacugcccccucuuagauauaugggggaagauggauguugguacggcauggagauaaggccaauuuccgaaaaggaggagaauauggucaaaucacugguuagcgcugguucuggcaagguggacaacuucaccauggggguauugugccucgccauccuguuugaagaggugaugcgcggaaaguucggcaaaaagcacaugaucgcaggggucuucuuuacguucgugcuacugcucuccggacagauuacuuggcgggauauggcucauacccugaucaugauuggcaguaaugccagcgacagaauggguauggggguuacauaucuugcauugauagccaccuuuaaaauccagcccuuccuggcuuuaggauuuuuccucaggaagcugacuucucgcgaaaaccuucugcuaggcgugggccucgcgauggccacaacccugcaauugccggaggauauugaacagauggcaaaugggaucgcucugggauuaauggcccucaaacugauuacacaguuugagacuuaccagcuuuggaccgcccugaucuccuugacguguucaaacacaauguucacccucacugucgcuuggcgaaccgcaacacugauacuagccggugugagucugcuuccuguuugccaaagcucguccaugcggaagacugacuggcucccaauggcgguggcugccaugggcguacccccucugcccuuguuuaucuucucucugaaggauaccuuaaaacguagaagcuggccacucaaugaggggguaauggcagugggacugguuucaauucuugccaguucccuguugaggaacgacgugccuauggcuggcccccucgucgccggugggcugcuaaucgccuguuaugugauuacgggaacaucugcggaucugaccguagaaaaggcugccgacaucacuugggaggaagaggcagaacagacaggcgugagccacaaccuuaugauaaccgucgacgaugacggcacuaugcgcauuaaagaugacgagacagagaauauccucaccguucuguugaagacggccuuacugaucguguccgggguguuuccauacucaauuccggcuacucuccuggucuggcauaccuggcagaaacagacacaacggagcggagugcuuugggauguuccuagucccccagaaacccagaaggccgagcuggaagaggguguauacagaauaaaacagcagggcaucuucgggaagacacaagugggagucggcgugcagaaggaggguguuuuucacacuauguggcacgugaccagaggggcagucuugacguauaacggaaaacgacuagaacccaauugggcuucugugaagaaagaccugauuuccuacggcggcggguggcgccucagcgcccaguggcaaaagggagaggaaguacaggucaucgcgguggagccugguaaaaacccaaagaauuuccagacaaugcccggcacuuuccagaccacaaccggggaaauuggagccaucgcacuggauuuuaagccuggcacuucggguucaccgauaaucaaccgggaggggaaaguugugggacuuuauggcaauggcgucgugaccaagaacgggggauacguuucugguauugcucaaacaaaugccgagccagacggccccacgccugaauuagaggaagagauguucaaaaagagaaaccugacuaucauggaucuccauccagggaguggaaaaaccaggaaguauuugcccgcuauugugcgugaagcaaucaagcgccggcugagaacacucauacuggccccuaccagggucguggccgcugagauggaggaagcgcuuaaaggccugccgauucgauaccagacuacagcaaccaaguccgagcacacgggucgggaaaucguagacuugaugugccaugccacuuuuacaaugcgccuacugagccccgugagaguuccaaauuauaaccucaucauuauggaugaggcucacuucaccgacccugccucuaucgcagccaggggguacauaagcacccgggucggaaugggcgaagcugcggccauuuuuaugacugcaacacccccaggcaccgcugaugccuucccucaguccaaugcacccauccaggacgaggagcgagacauuccagaaagaucauggaacagugggaaugaguggaucacagauuuugccggaaaaacugugugguucgugccgagcauaaaggcugguaacgacauugccaacuguuuacgcaaaaauggcaagaaggucauccaacugucuaggaaaacguuugauaccgaauaccagaagacaaaacuuaacgacugggauuucguagugacuaccgacaucuccgagaugggggcgaauuuuaaggcagaucguguuauugacccucggagaugccugaaacccgugauccucacagauggaccagagagggucauuuuggccggccccaugccugugaccgcugccucagcugcacagcgccgagguagaguugggcggaacagucagaaggaaaaugaccaauauauauucacuggccagccacugaacaaugaugaggaccaugcccacuggacggaagcuaagaugcuccuggacaacaucaauacccccgagggaauuaucccugcccuuuucgaaccggagagggagaaaagcgcagcgaucgauggcgaauaccgccuaaagggggagucccguaaaacauuuguggaacugaugagacggggagacuugccagucugguuagcccacaagguggcuucugaggguauuaaauauacugauaggaaguggugcuucgacggccagcgcaacaaucagauacuggaagagaacauggauguagagaucuggaccaaagaaggggagaagaagaaacuccgacccagauggcuggacgcccggacauacucggauccucuugcacugaaggaauuuaaagacuucgcugccggaagaaagagcauugcacucgauuuggugaccgagaucggccgcguucccucacaucuggcccacagaacuaggaaugcucuagacaaccuggucaugcuccauacauccgaacacggugggcgggcguaucgucacgccguggaggagcuuccagaaacgauggagacccuguuauugcugggccucaugauucugcuuacuggaggcgcaaugcuguuucucaucagugggaaaggaauagguaagacaucuaucggcuugauuugugugaucgcuagcuccgggaugcuguggauggccgaaauuccuuuacaauggaucgccucagcaauaguccuagaguucuuuaugaugguucugcucauucccgagccagaaaagcagcgcaccccucaggauaaucaacuugcuuacgugguaaucggcauucugaccuuggccgcgaucauagcugccaacgagaugggccugcucgaaacaacuaaacgagaccuggguaugucuaaggagccggggguggucagccccacgaguuaucuugauguggaccuccauccagcauccgccuggacccuguacgcuguugcaacaacugugaucaccccuauguugagacacacaauugaaaauagcaccgccaacgucucucuggcggcuaucgccaaccaggcaguaguguuaaugggccuagacaaaggauggcccauuucaaagauggaucugggcguuccacuccuugcccuggggugcuacucccaggugaauccuuugacucugacggcugccguccuccugcuuaucacacauuaugcaauaauuggacccggcuuacaggcuaaagccaccagggaggcgcaaaagcggacugccgcagguaucaugaagaacccgaccguggacgggaucaugacaauugaucuggacccagucaucuacgauaguaaauucgagaagcagcucggacaggugauguugcugguucuaugugcugugcagcugcuccuuaugcgcacuagcugggcccugugcgaagcauugacccuggcuacaggcccuauaacgacccucugggaggguucgcccggcaaauuuuggaauacuacaauugccguaucuauggccaacaucuucagaggguccuaucuggcgggagcuggcuuagcauuuagcauuaugaagucaguggggaccggaaaaaggggcacugguagucaaggggaaacacuuggagagaaguggaagaaaaagcugaaucagcucucucggaaagaguucgaccuauacaagaaauccggcaucaccgaggucgaucgaacggaggccaaggaaggucugaaaagaggcgagaccacacaccaugcuguuagccgcgggucagccaaguugcagugguuuguggaaaggaacauggucauaccagagggacgggugaucgaccugggcugugggcguggaggcuggaguuauuacugcgcaggucucaagaaaguaacugaagugagaggguauaccaagggaggccccggccacgaggagccuguuccgaugagcacauacggguggaauauugugaaacuuauguccggaaaggaugucuucuaccugcccccagaaaaaugugacacuuugcugugcgauaucggugagucuagcccuucccccaccguggaagagucaaggacaauucgcguccucaagaugguggagccuugguuaaagaacaaucaguucuguaucaaaguucugaacccauauaugcccaccguaauugaacaccuugagcggcugcaacgaaagcauggcgggaugcuagugagaaauccucucucuaggaacaguacucacgaaauguacuggaucucgaauggaacgggcaacauagucgccagcgugaauaugguuucccgccuguugcugaaccgguuuacaaugacccauagacguccaacuauugagaaagacguggaucucggugcugggaccaggcacgucaacgcggaacccgagacaccgaauauggacgugaucggagagcggaucaagcgcauuaaagaagaacacaacucuacguggcauuaugacgaugaaaauccuuacaagaccugggccuaucacggcucauacgagguaaaggcaacuggcagcgcuuccaguaugauaaacggggugguuaaacuucugacaaagccaugggacgucgugcccauggugacccagauggccaugacugauacaaccccuuucggacagcaacgagucuuuaaagaaaagguugacacaagaacuccaaggucuaugcccgguacccggcgcgugaugggcaucacggcagagugguuauggaccacacuggggagaaauaaaaagccgagguugugcacucgagaggaguucaccaagaaaguacggacaaacgccgcuaugggagccguguuuacugaggaaaaucagugggauagcgcgaaggcagccgucgaggacgaagauuucuggaaacucguggaccgugagagagagcugcauaagcuaggcaaaugugguucaugcguuuauaacaugauggggaagcgcgagaagaaacuuggagaguuuggcaaagcuaaaggcuccagggccauuugguacauguggcugggggcacgguaccucgaguucgaggcucugggauuuuugaaugaggaucacugguucaguagagaaaacagcuauucugguguggagggcgaagggcugcauaagcucggauacauccuucgcgacauuuccaaaaucccuggcggugccauguaugcugaugacaccgccgggugggacacgaggauaacagaggaugaccugcacaaugaagagaagaucacccagcagauggaucccgagcaccgacaauuagcaaacgcgauuuuuaaacugacuuaccagaauaaggucgugaagguacagcggccaacaccuaccggaacuguuauggacaucauuucaagaaaagaucagaggggcagcggccaaguggggaccuauggauugaacacauucacgaauauggaagcccagcucauccgccagauggagggugaaggcguccugucgaaggcugaccuagagaacccccaucuuccagagaaaaagauaacccaguggcuggagacuaaagggguggagcgucucaagcggauggccauuucuggagaugacugcguggucaagcccaucgaugacagauuugcaaacgcucuguuggccuuaaaugauaugggcaaaguuaggaaggacaucccucaauggcagccaaguaaagguuggcacgauuggcaacaggugccguucuguucccaucacuuccacgaacugauuaugaaggacgggcgcaaacucguagugcccugccgaccucaagacgagcuuauaggacgggcaagaaucagccagggcgccggcuggucacugagggaaacagcgugucuagggaaggcuuacgcccagauguggucccugauguauuuucaucgcagagaucuccgguuggcaucuaacgccauuugcagcgcugucccagugcacuggguucccaccaguaggacuacaugguccauccaugcccaccaucaauggaugaccacggaggacaugcugacaguguggaaucgugucuggauugaagauaacccuuggauggaggacaagaccccagugacuaccugggagaauguacccuaccuuggaaaacgagaagaucaguggugugguagccugaucggccucacaucucgcgcaacuugggcucagaacauaccuaccgccauccagcaaguuagaucauuaauugggaaugaggaguuccuggacuacaugccgaguaugaagcgguuuaggaaagaggaggaauccgagggagcgaucugguga

SEQ ID NO: 15249 - RNA, 9873 nt, Artificial Sequence
  derived and/or modified CDS sequence (opt3) from DENV-3__GQ868616__SS-prME
accagccugugccucaugaugauccuucccgcagcucuggcauuccacuugacuuccagggacggagaaccuaggaugauuguggggaagaacgaacggggaaaaucuuuacuguuuaagacugcaucagguauaaauauguguacgcuaaucgcgauggaucucggcgaaaugugcgacgauaccgucacauacaaauguccacauauuacugaaguugaaccggaagacaucgauugcugguguaaccugaccaguacaugggugaccuaugggacuugcaaucaggcuggagaacaccgccgagacaagcguagcgucgcccuugcaccccaugugggcaugggucuggauacaagaacccagacguggauguccacugaaggggccuggaggcaggucgaaaaaguggaaaccugggcuuugcggcacccuggauucacaauucucgcacuguuucuggcccauuacaucggcacuucucucacccagaagguugugauauucaucuuacugaugcuugucacaccaucgaugaccaugcgcugugugggcguagggaacagagacuuuguugaaggauugucaggugcuacguggguggaugucgugcuggagcacggcgggugcgugacuacaauggccaagaauaaacccacccuagacauugagcuccagaagacugaagcgacacagcuggcaacccuuaggaaacuguguaucgagggaaagauuacgaacaucaccacagauagccggugcccuacucagggcgaagccgucuugccagaggaacaggaccagaauuauguuuguaaacacaccuacguggaucgcgguugggggaacggaugcggccucuucggcaaggggagucugguaacaugcgcuaaguuucaauguuuagagcccauagagggaaaagugguccaguaugaaaaucugaaguacacugugauuaucaccguucauacaggugaccagcaccaggugggcaacgagacccaaggggucacugccgaaauuacgccucaggcauccacaaccgaggcuauccucccagaauauggaacucuuggccuggagugcucuccgcgaaccgguuuggacuucaaugagaugauccuacugacaaugaaaaacaaggccuggauggugcauagacagugguuuuucgaucucccccugccuuggaccagcggggcgacuacagaaacgccaaccuggaauaggaaagagcuucugguaacuuuuaagaacgcccacgccaagaagcaagaaguuguggucuugggcucccaggagggagcuaugcacacagcccucaccggcgcuacagaaauucaaaauucagggggaacaaguauauucgccggucaucugaagugucgguuaaaaauggacaagcuggagcuaaaaggcaugagcuacgcaaugugcaccaacacguuugugcucaagaaagaggucucugaaacccagcacgggacaauccugauuaagguggaguacaagggagaagaugcccccuguaaaaucccuuucuccacugaggacggccaagguaaggcucauaacgggcgucuuauaaccgcgaauccaguugugacuaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgccucuagggcuuggaacgugugggaaguugaggacuaugguuuugggguguucacgacaaauauuuggcugaaacuucgggaagucuacacccaguugugugaccaccgccucaugucagcagccgugaaggaugagagagcuguucacgccgacaugggauacuggaucgagagucagaaaaacggcagcuggaagcuggaaaaagcaucccuaauagaggugaagacuugcaccuggccuaagucucauacacuguggucgaaugguguacucgaaagcgauaugaucauuccaaaaucccuggcgggcccgaucucacagcacaaccauaggcccggguaucacacucaaaccgccggaccuuggcaccuuggcaaguuggagcuggacuuuaauuacugcgaggggacaacggucgugauuaccgaaaacuguggaacucguggcccaaguuuacggacaaccacugugucugguaaacucauccaugaguggugcugucgaagcugcacacugcccccucuuagauauaugggggaagauggauguugguacggcauggagauaaggccaauuuccgaaaaggaggagaauauggucaaaucacugguuagcgcugguucuggcaagguggacaacuucaccauggggguauugugccucgccauccuguuugaagaggugaugcgcggaaaguucggcaaaaagcacaugaucgcaggggucuucuuuacguucgugcuacugcucuccggacagauuacuuggcgggauauggcucauacccugaucaugauuggcaguaaugccagcgacagaauggguauggggguuacauaucuugcauugauagccaccuuuaaaauccagcccuuccuggcuuuaggauuuuuccucaggaagcugacuucucgcgaaaaccuucugcuaggcgugggccucgcgauggccacaacccugcaauugccggaggauauugaacagauggcaaaugggaucgcucugggauuaauggcccucaaacugauuacacaguuugagacuuaccagcuuuggaccgcccugaucuccuugacguguucaaacacaauguucacccucacugucgcuuggcgaaccgcaacacugauacuagccggugugagucugcuuccuguuugccaaagcucguccaugcggaagacugacuggcucccaauggcgguggcugccaugggcguacccccucugcccuuguuuaucuucucucugaaggauaccuuaaaacguagaagcuggccacucaaugaggggguaauggcagugggacugguuucaauucuugccaguucccuguugaggaacgacgugccuauggcuggcccccucgucgccggugggcugcuaaucgccuguuaugugauuacgggaacaucugcggaucugaccguagaaaaggcugccgacaucacuugggaggaagaggcagaacagacaggcgugagccacaaccuuaugauaaccgucgacgaugacggcacuaugcgcauuaaagaugacgagacagagaauauccucaccguucuguugaagacggccuuacugaucguguccgggguguuuccauacucaauuccggcuacucuccuggucuggcauaccuggcagaaacagacacaacggagcggagugcuuugggauguuccuagucccccagaaacccagaaggccgagcuggaagaggguguauacagaauaaaacagcagggcaucuucgggaagacacaagugggagucggcgugcagaaggaggguguuuuucacacuauguggcacgugaccagaggggcagucuugacguauaacggaaaacgacuagaacccaauugggcuucugugaagaaagaccugauuuccuacggcggcggguggcgccucagcgcccaguggcaaaagggagaggaaguacaggucaucgcgguggagccugguaaaaacccaaagaauuuccagacaaugcccggcacuuuccagaccacaaccggggaaauuggagccaucgcacuggauuuuaagccuggcacuucggguucaccgauaaucaaccgggaggggaaaguugugggacuuuauggcaauggcgucgugaccaagaacgggggauacguuucugguauugcucaaacaaaugccgagccagacggccccacgccugaauuagaggaagagauguucaaaaagagaaaccugacuaucauggaucuccauccagggaguggaaaaaccaggaaguauuugcccgcuauugugcgugaagcaaucaagcgccggcugagaacacucauacuggccccuaccagggucguggccgcugagauggaggaagcgcuuaaaggccugccgauucgauaccagacuacagcaaccaaguccgagcacacgggucgggaaaucguagacuugaugugccaugccacuuuuacaaugcgccuacugagccccgugagaguuccaaauuauaaccucaucauuauggaugaggcucacuucaccgacccugccucuaucgcagccaggggguacauaagcacccgggucggaaugggcgaagcugcggccauuuuuaugacugcaacacccccaggcaccgcugaugccuucccucaguccaaugcacccauccaggacgaggagcgagacauuccagaaagaucauggaacagugggaaugaguggaucacagauuuugccggaaaaacugugugguucgugccgagcauaaaggcugguaacgacauugccaacuguuuacgcaaaaauggcaagaaggucauccaacugucuaggaaaacguuugauaccgaauaccagaagacaaaacuuaacgacugggauuucguagugacuaccgacaucuccgagaugggggcgaauuuuaaggcagaucguguuauugacccucggagaugccugaaacccgugauccucacagauggaccagagagggucauuuuggccggccccaugccugugaccgcugccucagcugcacagcgccgagguagaguugggcggaacagucagaaggaaaaugaccaauauauauucacuggccagccacugaacaaugaugaggaccaugcccacuggacggaagcuaagaugcuccuggacaacaucaauacccccgagggaauuaucccugcccuuuucgaaccggagagggagaaaagcgcagcgaucgauggcgaauaccgccuaaagggggagucccguaaaacauuuguggaacugaugagacggggagacuugccagucugguuagcccacaagguggcuucugaggguauuaaauauacugauaggaaguggugcuucgacggccagcgcaacaaucagauacuggaagagaacauggauguagagaucuggaccaaagaaggggagaagaagaaacuccgacccagauggcuggacgcccggacauacucggauccucuugcacugaaggaauuuaaagacuucgcugccggaagaaagagcauugcacucgauuuggugaccgagaucggccgcguucccucacaucuggcccacagaacuaggaaugcucuagacaaccuggucaugcuccauacauccgaacacggugggcgggcguaucgucacgccguggaggagcuuccagaaacgauggagacccuguuauugcugggccucaugauucugcuuacuggaggcgcaaugcuguuucucaucagugggaaaggaauagguaagacaucuaucggcuugauuugugugaucgcuagcuccgggaugcuguggauggccgaaauuccuuuacaauggaucgccucagcaauaguccuagaguucuuuaugaugguucugcucauucccgagccagaaaagcagcgcaccccucaggauaaucaacuugcuuacgugguaaucggcauucugaccuuggccgcgaucauagcugccaacgagaugggccugcucgaaacaacuaaacgagaccuggguaugucuaaggagccggggguggucagccccacgaguuaucuugauguggaccuccauccagcauccgccuggacccuguacgcuguugcaacaacugugaucaccccuauguugagacacacaauugaaaauagcaccgccaacgucucucuggcggcuaucgccaaccaggcaguaguguuaaugggccuagacaaaggauggcccauuucaaagauggaucugggcguuccacuccuugcccuggggugcuacucccaggugaauccuuugacucugacggcugccguccuccugcuuaucacacauuaugcaauaauuggacccggcuuacaggcuaaagccaccagggaggcgcaaaagcggacugccgcagguaucaugaagaacccgaccguggacgggaucaugacaauugcucuggauccagucaucuacgacaguaaauucgagaagcagcucggacaggugauguugcugguucuaugugccgugcagcugcuccuuaugcgcacuagcugggcacugugcgaggcuuugacccuggccacaggcccuauaacgacccucugggaggguucgcccggcaaauuuuggaauacuacaauugccguaucuauggcgaacaucuucagaggguccuaucuggcuggagcaggcuuagccuuuagcauuaugaagucaguggggaccggaaaaaggggcacugguagucaaggggaaacacuuggagagaaguggaagaaaaagcugaaucagcucucucggaaagaguucgaucuauacaagaaauccggcaucaccgaggucgaccgaacggaggcuaaggaaggucugaaaagaggcgagaccacacaccaugccguuagccgcgggucagcaaaguugcagugguuuguggaaaggaacauggucauaccagagggacgggugaucgaucugggcugugggcguggaggcuggaguuauuacugcgccggucucaagaaaguaacugaagugagaggguauaccaagggaggccccggccacgaggagccuguuccgaugagcacauacggguggaauauugugaaacuuauguccggaaaggacgucuucuaccugcccccagaaaaaugugauacuuugcugugcgacaucggugagucuagcccuucccccaccguggaagagucaaggacaauucgcguccucaagaugguggagccuugguuaaagaacaaucaguucuguaucaaaguucugaacccauauaugcccaccguaauugaacaccuugagcggcugcaacgaaagcauggcgggaugcuagugagaaauccucucucuaggaacaguacucacgaaauguacuggaucucgaauggaacgggcaacauagucgcuagcgugaauaugguuucccgccuguugcugaaccgguuuacaaugacccauagacguccaacuauugagaaagauguggaccucggugcggggaccaggcacgucaacgccgaacccgagacaccgaauauggaugugaucggagagcggaucaagcgcauuaaagaagaacacaacucuacguggcauuaugacgacgaaaauccuuacaagaccugggcauaucacggcucauacgagguaaaggcuacuggcagcgccuccaguaugauaaacggggugguuaaacuucugacaaagccaugggaugucgugcccauggugacccagauggcaaugacugacacaaccccuuucggacagcaacgagucuuuaaagaaaagguugauacaagaacuccaaggucuaugcccgguacccggcgcgugaugggcaucacgccggagugguuauggagaccucuggggaggaauaaaaagccccgauugugcccacgggaggaguucaccaagaaaguacguacaaacgccccuaugggagcuguguuuacugaggaaacccagugggccagcgcgaaggcagccgucgaggacgaagauuucuggaaacucguggacagagagcgcgagcugcauaagcuaggcaaaugugguucaugcguuuauaauaugauggggaagagggagaagaaacuuggagaguuuggcaaagcuaaaggcucccgggccauuugguacauguggcugggggcaagauaccucgaguucgaggcucugggauuuuugaacgaggaucacugguucagucgcgaaaauagcuauucugguguggagggcgaagggcugcccaagcucggauacauccuuagggacauuuccaaaaucccaggcggugccauguaugcugaugacacagccgggugggauacucgaauaaccgaggacgaccugcauaacgaagagaagaucacgcagcagauggaucccgagcaccggcaauuagcaaaugcgauuuuuaaacugacauaccagaacaaggucgugaagguacagagaccuaccccaacuggaacaguuauggacaucauuucaaggaaagaucagcgcggcagcggccaaguggggaccuauggauugaauacuuucaccaacauggaagcccagcucauccgucagauggagggugaaggcguccugucgaaggcugaccuagagaauccgcaccuucccgagaaaaagauaacacaguggcuggagacgaaagggguggagcggcucaagagaauggccauuucuggagaugacugcguggucaagccuaucgaugacagguuugcaaacgcucuguuggccuuaaacgauaugggcaaaguucgcaaggacaucccacaauggcagcccaguaaagguuggcaugauuggcaacaggugccuuucuguucccaccauuuccacgaacugauuaugaaggacgggcgaaaacucguagugccaugccggccccaagaugagcuuauaggaagggcaaggaucagccagggcgccggcuggucacugcgcgaaaccgcgugucuagggaaggcuuacgcccagauguggucccugauguauuuucacagacgggaccucagguuggcaucuaaugccauuugcagcgcugucccugugcauuggguuccgacaagucguacaaccugguccauccacgcccaucaccaauggaugacuacagaggacaugcugaccguguggaaccgagucuggauugaagauaauccauggauggaggacaagacgcccgugacaaccugggagaacguaccuuaccuuggaaaacgcgaagaucaguggugugguagccugaucggccucacuucuagagcaaccugggcucagaauauacccacagccauccagcaaguucggucauuaauugggaacgaggaguuccuggacuacaugccaaguaugaagagguuucgcaaagaggaggaauccgagggagcgaucugguga

SEQ ID NO: 15250 - RNA, 9873 nt, Artificial Sequence
  derived and/or modified CDS sequence (opt3) from DENV-3__GQ199887__SS-prME
accagccugugccucaugaugauccuucccgcagcucuggcauuccacuugacauccagggacggcgagccuaggaugauuguggggaagaacgaacggggaaagucuuuacuguuuaagacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaagguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaagcccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagaguccauagagggaaaagugguccaguaugaaaaucugaaguacacagugauuaucacuguucauaccggugaccagcaccaggugggcaacgagacacaaggggucaccgcagaaauuacuccccaggcuucuacgacagaggccauccucccugaauauggaacccuuggccuggagugcagcccacgaacugguuuggacuucaaugagaugauccuacugaccaugaaaaacaaggcguggauggugcauagacagugguuuuucgaucucccgcugcccuggacauccggggccaccacugaaacaccuacguggaauaggaaagagcuucugguaaccuuuaagaacgcacacgcuaaaaagcaagaaguuguggucuugggcucacaggagggagccaugcacacugcucucacaggcgccaccgaaauucagaauagugggggaacaagcauauucgcaggucaucugaagugucgguuaaaaauggacaagcuggagcuaaaaggcaugucuuacgccaugugcacuaacaccuuugugcucaagaaagaggucuccgaaacgcagcacgggaccauccuggugaagguugaguacaagggagaagaugcuccauguaaaauucccuucucaacagaggacggccaagguaaggcgcauaacgggcgucuuaucacugcaaauccugugguaaccaaaaaggaggaaccagucaacauagaggccgaacccccguucggcgagagcaauauugugaucggaaucggcgauaacgcuuugaaaauuaauugguauaagaaggggaguucuaucggaaaaauguuugaagccacagcacgcggugccagaaggauggcuauucugggcgacacugccugggauuucggguccguuggaggcgugcucaacagccuggguaagaugguccaccagauauuugggucggcauacaccgcgcuuuucucuggcguguccuggguaaugaaaaucggaauuggcgugcuguugacguggaucgggcucaauucaaagaacacaaguaugagcuuuuccugcaucgcuauuggaauaaucacccuguauuuaggcgccguuguccaggcagacauggguugugugauuaauuggaaagggaaggagcugaagugcggaucuggcaucuucgugacuaacgagguccauacauggaccgaacaguacaaauuucaagccgauagcccuaagcggcuagcuacugccauugccggugcuugggagaauggcguuugugggauccgaucaaccacacgcauggaaaaccuccuguggaaacagauagccaaugagcuuaacuauaucuugugggaaaauaacauuaagcugacgguggugguaggagacaccaucggcguccucgagcaggggaaaagaacucugacaccccagccaauggaguuaaaguacaguuggaaaaccuggggaaaggcgaagauugugacagccgaaauccaaaacuccagcuucauaauugauggcccuaauacucccgagugcccaucugcuucaagggcauggaacguuugggaaguggaggacuaugguuuuggggucuucaccacgaauaucuggcugaaacuucgggaaguguacacacaguugugugaccaccgccucaugagugccgcuguuaaggaugagagagccgugcacgcagacaugggauacuggauugagagccagaaaaacggcuccuggaagcuggaaaaagcgucuuuuaucgagguaaagaccugcacuuggcccaagucgcauacccuauggagcaaugguguccuggaauccgauaugauaaucccuaaaucacucgccggcccaauuagucagcacaacuauaggccgggguaccauacacaaacugcuggacccuggcaccugggcaaacuugaguuggacuucaauuauugcgaggggaccacaguggugaucacggaaaacuguggaacccguggcccuucucugcggacuacaaccgucagcgguaaauuaauucacgaguggugcugucgauccugcacucucccaccccugagauacaugggggaagauggauguugguauggcauggagaucaggccuauaucagaaaaggaggagaauaugguuaaaagccuugccucugcagguuccggcaagguggacaacuuuacaauggggguacugugcuuggcuauucucuucgaagaggugaugcgcggaaaguucggcaaaaagcauaugaucgccggggucuuuuucaccuuugugcugcuacugaguggacagaucacguggcgggauauggcacacacucucauuaugaucggcagcaaugccucugacagaauggguauggggguuaccuaccuggcucuuauugcgacauucaaaauacagccauuuuuggcccugggauucuuuuuaaggaagcucaccucccgcgaaaaccugcuucugggcgugggccuagcaauggcuacuacacuccaacugcccgaggauaucgaacagauggccaaugggauugccuugggacugauggcuuuaaaacucaucacccaguucgagacauaucagcuguggacugcacuugucucacugaccuguaguaacacgauguuuacauugaccguggccuggcgaacugcgacccucauucuggcugguguuagccuacugccggugugccaaucguccucuaugcggaagacagacuggcuuccuaugacugucgccgcaaugggcguaccaccccucccucuguucaucuuuagcuugaaggauacccugaaacguagaucauggcccuuaaaugagggggugauggccguuggacucgugaguauacuggcuuccucucuucugaggaacgacgucccaauggcaggcccuuugguggccggugggcuccugaucgcguguuacguaauuacgggaacaagcgcugaucuaaccguggaaaaggccgcagacgucacuugggaggaagaggccgaacagacaggcguuucccauaaccugaugaucaccguggacgaugacggcacuaugcgcauuaaagaugacgagacagagaauauccuuaccgugcuccugaagacggcuuuguuaauagucucagggauuuuccccuacagcaucccagccacucugcucguguggcacaccuggcagaaacagacacaacggaguggaguucugugggauguaccgucuccucccgaaacccagaaggcagagcuugaagaggguguguauagaaucaaacagcagggcauucuggggaagacacaagucggagugggcguucagaaggaggguguguuucauacuauguggcacgucaccagaggggcuguguugacgcacaacggaaaacgacuagaaccaaauugggccuccguaaagaaagaccugauaagcuacggcggcggguggcgccucucggcgcaguggcaaaagggagaggaaguccaggugaucgccguugagcccgguaaaaacccuaagaauuuccagacaaugccaggcacuuuccagaccacaaccggggaaauuggagcaaucgcucuggauuuuaagcccggcacuucagguucuccuauuaucaaccgggaggggaaaguggucggacuuuauggcaauggcgugguuaccaagaacgggggauacgugagugguauagcccaaacaaaugcugagccggacggcccaacgcccgaauuagaggaagagauguucagaaaaaggaaccugacuaucauggaucuccauccuggguccggaaagacccguaaauauuugccagcaauuguccgcgaagccaucaagcggagacugaggacacucauucuggcccccacccgagugguagcugcggagauggaggaagcacuuaagggccugccuauccgguaccagacuacagccaccaaaagcgagcacacgggucgcgaaauaguggacuugaugugccaugcuacuuuuacaaugagacuacugucuccgguuaggguccccaauuauaaccucauuaucauggaugaggcccacuucaccgacccagcaagcaucgccgcucggggguacauuuccacccgagugggaaugggcgaagcggccgcaaucuuuaugacugcuacaccucccggcaccgccgaugcauucccacagucaaaugccccuauacaggacgaggagagagacauucccgaacgcaguuggaacagcgggaaugaguggaucacagauuuugcuggaaagacugugugguucgucccaucuauuaaagccgguaacgacaucgcgaacuguuuaaggaagaauggcaaaaagguaauacaacugucccguaagacguuugauaccgaauaccagaaaacaaaacuuaacgacugggauuucgugguuacuaccgacauuucagagaugggggcaaauuuuaaagccgaucgggugaucgacccgagaaggugccugaagccugucauccucacagauggacccgagcgcgugauuuuggcuggcccaaugcccguuaccgccgcuagugcagcccagcgaagaggucggguggggaggaacccucagaaagaaaaugaccaauauaucuucacuggccagccacugaacaaugaugaggaccaugcucacuggacggaagccaagaugcuccuggacaacauuaauacccccgagggaauaaucccugcacuuuucgaaccggagcgcgaaaagagcgcggccauugauggcgaauaccgucuaaaaggggaguccagaaagacauuugucgaacugaugcggaggggagacuugccagugugguuagcucacaaaguagccucugaggguaucaaguauacugaucgcaaauggugcuucgacggccagcgaaacaaucagauccuggaagagaacauggauguggagauuuggaccaaggaaggggagaaaaagaagcucagaccccgguggcuggacgcaaggacauacucggauccucuugcucugaaagaauuuaaggacuucgccgcaggacgcaaaagcauagcccucgauuugguuaccgagaucggcagaguccccucacaucuggcucacaggacucggaaugcgcuagacaaccuggugaugcuccauacauccgaacacggugggcgugccuaucgccacgcaguggaggagcuuccagaaacgauggagacccuguuauugcugggccucaugauucugcuuacuggaggcgucaugcuguuucucaucagugggaagggaauugguaaaacaucuaucggcuugauauguguuaucgcuagcuccgggaugcuguggauggccgaugugccuuuacaauggauugccucagcaaucguacuagaguucuuuaugauggugcugcucauucccgagccagagaagcagcgaaccccucaggacaaucaacuugcuuacgucgugaucggaauacugaccuuggccgcgauuaucgcugccaacgaaaugggccugcucgagacaacuaagagagaucuggguaugucuaaagaaccggggguugugagccccacgaguuaucuugacgucgaccuccauccagcauccgccuggacccuguacgcuguagcaacaacugugauuaccccuauguugaggcacacaaucgagaauagcaccgccaacguuucucuggcggcuauagccaaccaggcaguggucuuaaugggccuagauaagggauggcccaucucaaaaauggaccugggcgugccacuccuugcccuggggugcuacucccaggucaauccuuugacucugacggcugccgugcuccugcuuauuacacauuaugcaaucauuggacccggcuuacaggcuaaggccacccgggaagcgcaaaaacgcacugccgcagguaucaugaagaacccgaccguugaugggauaaugacaauugaccuggauccagugaucuacgacaguaaguucgagaaacagcucggacagguaauguugcuggugcuaugugcuguccagcugcuccuuaugagaacuagcugggcccugugcgaggcauugacccuggcuacaggcccuaucacgacccucugggaagguucgcccggcaaguuuuggaauacuacaauugccguuucuauggccaacaucuucaggggguccuaucuggcgggagcuggcuuagcauuuagcauaaugaaaucaguggggaccggaaagcggggcacugguagucaaggggagacacuuggagaaaaauggaagaagaaacugaaucagcucucucgaaaggaguucgaucuauacaaaaaguccggcauuaccgaagucgacagaacggaggccaaagagggucugaagcgcggcgaaaccacacaccaugcugugagcagggggucagccaaauugcagugguuuguagagcggaacauggugaucccagaaggacguguuauugaucugggcugugggagaggaggcuggaguuauuacugcgcaggucucaagaaggugacugaggucaggggguauaccaaaggaggccccggccacgaagaaccugugccgaugagcacauacggguggaauaucgucaaacuuauguccggaaaagacguguucuaccugcccccagagaagugugauacuuugcugugcgacauaggugaaucuagcccuucccccaccguugaggaaucacgcacaauccggguacucaaaaugguggagccuugguuaaagaacaaucaguucuguauuaagguccugaacccauauaugcccaccgugaucgagcaccuugaacgacugcaaagaaaacauggcgggaugcuaguuaggaauccucucucucgcaacaguacucacgagauguacuggauuucgaauggaacgggcaacaucgugagcuccgucaauauggugucucggcuguugcugaacagauuuacaaugacccaucguaggccaacuauugaacgggauguagaccucggugccgggacccgccacgugaacgcugagcccgaaaucccgaauauggacguuauaggagagcgaauuaagagaaucaaagaggaacacaacucaacauggcauuaugaugacgagaauccuuacaagacgugggcguaucacggcagcuacgaagucaaagccaccggcuccgcaaguucuaugaucaacgggguggugaaacuucugacuaagccaugggaugucguucccauggugacacagauggcuaugaccgacacuacaccuuucggacagcaaaggguauuuaaagagaagguggauacccggacaccacgccccaugccggguacuagaaaagucauggaaauuaccgccgagugguuauggaggacgcugggccgaaauaagcggccucguuugugcaccagagaggaguucacuaagaaggugcgcacuaacgcagccaugggggcuguuuuuaccgaggaaaaucagugggacagcgccaaggcggcaguggaggaugaagaguucuggaaacucgucgacagggagcgggaacugcauaagcuaggaaaauguggcucaugcguguauaacaugauggguaagagagagaagaaacuuggggaauuuggaaaagccaaaggcucccgcgcuauaugguacauguggcugggcgccagguaccucgaguucgaggcacugggguuuuugaaugaagaucacugguucagucgagagaacagcuauucuggaguagaaggugagggccugcauaagcucggguacauccuucgggacauuuccaaaauccccggaggcgcuauguaugccgaugacacagcugguugggacacuagaauuaccgaagaugaccugcacaaugaggagaagaucacgcagcagauggauccagaacacaggcaauuagccaacgcaauauuuaaacugacauaccagaauaagguugugaaaguccagcgcccuacccccacugggacagugauggacaucauuucacguaaggaucagcggggaagcggccaagugggcaccuauggguugaacacuuucaccaauauggaggcgcagcucgucagacagauggaaggagaggguguucugucgaaggccgaccuagaaaacccacaucuucuggagaaaaagaucacacaguggcucgagacgaaaggcguggaaaggcugaagcgcauggcuauuucuggggaugacugcguagugaaacccaucgaugaccgauuugccaacgcauuguuagcucugaaugauaugggaaagguccggaaggacauaccucaauggcagccaaguaaaggcuggcacgauuggcaacaggugccguucuguucccaucacuuccacgagcucauuaugaaggacgguagaaaacuuguugugcccugcaggccucaagacgaacugaucgggcgcgccagaaucagccagggagcaggcuggucacuacgggagaccgccugucugggcaaggcguacgcucagauguggucccucauguauuuucauaggcgugauuugcgacuggccucuaacgcaauuugcagcgccgucccagugcacuggguacccacaagucgcacaaccugguccauacaugcucaccaucaauggaugacuacagaagacaugcuuaccguuuggaauagaguguggaucgaggauaacccuuggauggaggacaaaacgccagucacaaccugggaaaaugugcccuaccuggggaagcgggaggaucagugguguggaagccucauugguuuaacuucuagggccaccugggcacagaacaucccuacagcuauucagcaaguucgcucacugaucggcaaugaagaguucuuggacuacaugccgaguaugaagagauuucggaaagaggaagaguccgaaggggccauaugguga

SEQ ID NO: 15251 - RNA, 9873 nt, Artificial Sequence
  derived and/or modified CDS sequence (opt3) from DENV-3__GQ199888__SS-prME
accagccugugccucaugaugauccuucccgcagcucuggcauuccacuugaccuccagggacggcgagccuaggaugauuguggggaagaacgaacggggaaagucuuuacuguuuaagacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaagguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaagcccacacuagacauugagcuccagaagaccgaagcaacucaacuggccacacuuaggaagcuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagaguccauagagggaaaagugguccaguaugaaaaucugaaguacacagugauuaucacuguucauaccggugaccagcaccaggugggcaacgagacacaaggggucaccgcagaaauuacuccccaggcuucuacgacagaggccauccucccugaauauggaacccuuggccuggagugcagcccacgaacugguuuggacuucaaugagaugauccuacugaccaugaaaaacaaggcguggauggugcauagacagugguuuuucgaucucccgcugcccuggacauccggggccaccacugaaacaccuacguggaauaggaaagagcuucugguaaccuuuaagaacgcacacgcuaaaaagcaagaaguuguggucuugggcucacaggagggagccaugcacacugcucucacaggcgccaccgaaauucagaauagugggggaacaagcauauucgcaggucaucugaagugucgguuaaaaauggacaagcuggagcuaaaaggcaugucuuacgccaugugcacuaacaccuuugugcucaagaaagaggucuccgaaacgcagcacgggaccauccuggugaagguugaguacaagggagaagaugcuccauguaaaauucccuucucaacagaggacggccaagguaaggcgcauaacgggcgucuuaucacugcaaauccugugguaaccaaaaaggaggaaccagucaacauagaggccgaacccccguucggcgagagcaauauugugaucggaacaggcgauaacgcuuugaaaaucaauugguauaagaaggggaguucuauuggaaaaauguuugaagccacugcacgcggugccagaaggauggcuauccugggcgacaccgccugggauuucggguccguuggaggcgugcucaacagccuggguaagaugguccaccagauuuuugggucggcauacacggcgcuuuucucuggcguguccuggguaaugaaaauaggaaucggcgugcuguugacauggauugggcucaauucaaagaacaccaguaugagcuuuuccugcaucgcuaucggaauuauaacucuguauuuaggcgccguuguccaggcagacauggguugugugaucaauuggaaagggaaggagcugaagugcggaucuggcauuuucgugacaaacgagguccauaccuggacugaacaguacaaauuucaagccgauagcccuaagcggcuagcuaccgccaucgccggugcuugggagaauggcguuugugggauucgaucaacaacgcgcauggaaaaccuccuguggaaacagaucgccaaugagcuuaacuauauauugugggaaaauaacaucaagcugaccguggugguaggagacacuauuggcguccucgagcaggggaaaagaacacugacaccccagccaauggaguuaaaguacaguuggaaaacauggggaaaggcgaagaucgugacugccgaaauucaaaacuccagcuucaucauagauggcccuaauacccccgagugcccaucugcuucaagggcauggaacguuugggaaguggaggacuaugguuuuggggucuucacgacaaauauuuggcugaaacuucgggaaguguacacccaguugugugaccaccgccucaugagugccgcuguuaaggaugagagagccgugcacgcagacaugggauacuggaucgagagccagaaaaacggcuccuggaagcuggaaaaagcgucuuuuauugagguaaagacuugcaccuggcccaagucgcauacacuauggagcaaugguguccuggaauccgauaugaucauaccuaaaucacucgccggcccaaucagucagcacaacuauaggccgggguaccauacucaaaccgcuggacccuggcaccugggcaaacuugaguuggacuucaauuauugcgaggggacaacgguggugauuaccgaaaacuguggaacucguggcccuucucugcggacaaccacugucagcgguaaauuaauccacgaguggugcugucgauccugcacacucccaccccugagauacaugggggaagauggauguugguauggcauggagauuaggccuaucucagaaaaggaggagaauaugguuaaaagccuugccucugcagguuccggcaagguggacaacuuuaccauggggguacugugcuuggcuauacucuucgaagaggugaugcgcggaaaguucggcaaaaagcauaugauugccggggucuuuuucacguuugugcugcuacugaguggacagaucacuuggcgggauauggcacacacccucaucaugauuggcagcaaugccucugacagaauggguauggggguuacauaccuggcucuuaucgcgaccuucaaaauucagccauuuuuggcccugggauucuuuuuaaggaagcucacuucccgcgaaaaccugcuucugggcgugggccuagcaauggcuacaacccuccaacugcccgaggauauagaacagauggccaaugggaucgccuugggacugauggcuuuaaaacucauuacacaguucgagacuuaucagcuguggaccgcacuugucucacugacguguaguaacacaauguuuaccuugacuguggccuggcgaaccgcgacacucauccuggcugguguuagccuacugccggugugccaaucguccucuaugcggaagacugacuggcuuccuaugaccgucgccgcaaugggcguaccaccccucccucuguucauuuuuagcuugaaggauacgcugaaacguagaucauggcccuuaaaugagggggugauggccguuggacucgugaguauccuggcuuccucucuucugaggaacgacgucccaauggcaggcccuuugguggccggugggcuccugauagcguguuacguaaucacaggaaccagcgcugaucuaacuguggaaaaggccgcagacgucacaugggaggaagaggccgaacagaccggcguuucccauaaccugaugauuacuguggacgaugacggcacaaugcgcaucaaagaugacgagaccgagaauauucuuacggugcuccugaagacugcuuuguuaaucgucucagggauauuccccuacagcauuccagccacccugcucguguggcacacauggcagaaacagacccaacggaguggaguucugugggauguaccgucuccucccgaaacacagaaggcagagcuugaagaggguguguauagaaucaaacagcagggcauccuggggaagacucaagucggagugggcguucagaaggaggguguguuucauaccauguggcacgucacgagaggggcuguguugacacacaacggaaaacgacuagaaccaaauugggccuccguaaagaaagaccugauuagcuacggcggcggguggcgccucucggcgcaguggcaaaagggagaggaaguccaggugauagccguugagcccgguaaaaacccuaagaauuuccagacuaugccaggcaccuuccagacaaccacuggggaaaucggagcaauugcucuggauuuuaagcccggcaccucagguucuccuaucauuaaccgggaggggaaaguggucggacuuuauggcaauggcgugguuacaaagaacgggggauacgugagugguaucgcccaaacgaaugcugagccggacggcccaacucccgaauuagaggaagagauguucagaaaaaggaaccugaccauaauggaucuccauccuggguccggaaagacacguaaauauuugccagcaaucguccgcgaagccauuaagcggagacugaggacccucauccuggcccccacucgagugguagcugcggagauggaggaagcacuuaagggccugccuauucgguaccagacaaccgccacgaaaagcgagcacacuggucgcgaaaucguggacuugaugugccaugcuacauuuaccaugagacuacugucuccgguuaggguccccaauuauaaccucauaauuauggaugaggcccacuucaccgacccagcaagcaucgccgcucggggguacaucuccacucgagugggaaugggcgaagcggccgcaauuuuuaugacagcuaccccucccggcacagccgaugcauucccacagucaaaugccccuauccaggacgaggagagagacauacccgaacgcaguuggaacagcgggaaugaguggauuacugauuuugcuggaaagacggugugguucgucccaucuaucaaagccgguaacgacauugcgaacuguuuaaggaagaauggcaaaaagguaauccaacugucccguaagaccuuugauacagaauaccagaaaacuaaacuuaacgacugggauuucgugguuaccacagacauaucagagaugggggcaaauuuuaaagccgaucgggugauugacccgagaaggugccugaagccugucauccucaccgauggacccgagcgcgugaucuuggcuggcccaaugcccguuacugccgcuagugcagcccagcgaagaggucggguggggaggaacccucagaaagaaaaugaccaauauauuuucacgggccagccacugaacaaugaugaggaccaugcucacuggaccgaagccaagaugcuccuggacaacaucaauacacccgagggaauuauaccugcacuuuucgaaccggagcgcgaaaagagcgcggccaucgauggcgaauaccgucuaaaaggggaguccagaaagacuuuugucgaacugaugcggaggggagacuugccagugugguuagcucacaaaguagccucugaggguauuaaguauaccgaucgcaaauggugcuucgacggccagcgaaacaaucagauccuggaagagaacauggauguggagaucuggacaaaggaaggggagaaaaagaagcucagaccccgguggcuggacgcaaggaccuacucggauccucuugcucugaaagaauuuaaggacuucgccgcaggacgcaaaagcauugcccucgauuugguuacugagauaggcagaguccccucacaucuggcucacaggacacggaaugcgcuagacaaccuggugaugcuccauacguccgaacacggugggcgugccuaucgccacgcaguggaggagcuuccagaaaccauggagacucuguuauugcugggccucaugauccugcuuacaggaggcgcuaugcuguuucucauuagugggaagggaaucgguaaaaccucuauuggcuugaucugugucauagccagcuccgggaugcuguggauggccgauguuccuuuacaauggaucgcaucagcuauugugcuagaguucuuuaugaugguacugcucauccccgagccagagaagcagcgaaccccucaggacaaucaacuugccuacguggucauuggaauccugacauuggcggcuauaauugccgcaaacgaaaugggccugcucgagacuacgaagagagaucuggguaugucuaaagaaccgggggugguuagccccaccaguuaucuugacguggaccuccauccagccuccgcuuggacacuguacgcagucgccacuaccguaaucacaccuauguugaggcacaccauugagaauagcacugcgaacgugucucuggcugccaucgcaaaccaggccguuguguuaaugggccuagauaagggauggcccauaucaaaaauggaccugggcgucccacuccuugcucuggggugcuacucccaggugaauccuuugacgcugacagccgcaguccuccugcuuaucacccauuaugcuauuaucggacccggcuuacaggccaaggcgacucgggaagcccaaaaacgcaccgcagcugguauuaugaagaacccgacaguggaugggaucaugacuauagaccuggauccaguuauuuacgacaguaaguucgagaaacagcucggacaggugauguugcugguacuaugugccgugcagcugcuccuuaugagaaccagcugggcacugugcgaggcuuugacacuggccacgggcccuaucaccacucucugggaagguucgcccggcaaguuuuggaauacaaccaucgccgucucuauggcgaacauuuucaggggguccuaucuggcuggagcaggcuuagccuuuagcaucaugaaaucaguugggacuggaaagcggggcacagguagucaaggggagacccuuggagaaaaauggaagaagaaacugaaucagcucucucgaaaggaguucgaucuauacaaaaaguccggcauaacggaaguggacagaaccgaggcuaaagagggucugaagcgcggcgaaacaacucaccaugccgucagcagggggucagcaaaauugcagugguuuguggagcggaacaugguaauuccagaaggacgugugaucgaucugggcugugggagaggaggcuggaguuauuacugcgccggucucaagaagguuaccgaggugaggggguauacaaaaggaggccccggccacgaagaaccugucccgaugagcacuuacggguggaauauugugaaacuuauguccggaaaagacgucuucuaccugcccccagagaagugugauaccuugcugugcgacaucggugaaucuagcccuucccccacaguggaggaaucacgcaccauacggguucucaaaaugguagagccuugguuaaagaacaaucaguucuguaucaaggugcugaacccauauaugcccacugucauugagcaccuugaacgacugcaaagaaaacauggcgggaugcuagugaggaauccucucucucgcaacaguacgcacgagauguacuggaucucgaauggaacaggcaacauuguuagcuccgugaauauggucucucggcuguugcugaacagauuuaccaugacucaucguaggccaaccaucgaacgggauguggaccucggugcugggacacgccacguaaacgcggagcccgaaauuccgaauauggacgugaucggagagcgaauaaagagaauuaaagaggaacacaacucaacguggcauuaugaugacgagaauccuuacaagaccugggccuaucacggcagcuacgaaguuaaagcaacuggcuccgcuaguucuaugaucaacggggucgugaaacuucugacaaagccaugggaugugguccccaugguuacccagauggccaugacugacacaaccccuuucggacagcaaaggguguuuaaagagaagguagauacacggacuccacgccccaugccggguaccagaaaagugauggaaaucacggcagagugguuauggaggacccugggccgaaauaagcggccucguuugugcacaagagaggaguucacuaaaaagguccgcaccaacgccgcuaugggggccguguuuacagaggaaaaucagugggacagcgcgaaggcagccguugaggaugaagaguucuggaaacucguggacagggagcgggaacugcauaagcuaggaaaauguggcucaugcgucuauaacaugauggguaagagagagaagaaacuuggggaauuuggaaaagcuaaaggcucccgcgccauuugguacauguggcugggcgcaagguaccucgaguucgaggcucugggguuuuugaaugaagaucacugguucagucgagagaacagcuauucuggaguggaaggugagggccugcauaagcucggguacauacuucgggacaucuccaaaauucccggaggcgccauguaugcugaugacacugccgguugggacaccagaaucacggaagaugaccugcacaaugaggagaagauuacacagcagauggauccagaacacaggcaauuagcaaacgcgaucuuuaaacugaccuaccagaauaagguaguuaaagugcagcgcccuacucccacagggaccgucauggacauaaucucacguaaggaucagcggggaagcggccaagugggcacuuauggguugaacaccuucacaaauauggaggcccagcucgugagacagauggaaggagaggacguccugucgaaggcugaucuagaaaacccacaucuucuggagaaaaagauuacgcaguggcucgagaccaaagguguugaaaggcugaagcgcauggccaucucuggcgacgauugcgugguaaaacccauugacgaucgauuugcaaacgcuuuguuagcccugaaugacauggggaaggugcggaaggauaucccucaauggcagccaaguaaaggauggcacgacuggcagcaggucccguucuguucccaucacuuccacgagcucauaaugaaggacggcagaaaacuugugguucccugcaggccucaagaugaacugauuggucgcgcaagaaucagccagggggccggauggucacuacgggagacugcgugucugggcaaggcuuacgcccagauguggucccucauguauuuucauaggcgugacuugcgacuggcaucuaacgccaucugcagcgcugugccaguccacugggugcccacaagucgcaccacuugguccauucaugcccaccaucaauggaugacaaccgaagauaugcuuacgguauggaauagaguuuggauagaggacaacccuuggauggaggauaaaacaccagugaccacuugggaaaauguccccuaccugggcaagcgggaggaccaguggugugggagccucaucggauuaaccucuagggcaacaugggcucagaacauuccuacugccauccagcaagugcgcucacugauugguaaugaagaguucuuggauuacaugccgaguaugaagagauuucggaaagaggaagaguccgaaggcgcgaucugguga

SEQ ID NO: 15252 - RNA, 9873 nt, Artificial Sequence
  derived and/or modified CDS sequence (opt3) from DENV-3__GQ252674__SS-prME
accagccugugccucaugaugauccuucccgcagcucuggcauuccacuugacauccagggacggcgaaccuaggaugauuguggggaagaacgaacggggaaagucuuuacuguuuaagacugcaucagguauaaauauguguacgcuaaucgcgauggaucucggcgaaaugugcgacgauaccgucaccuacaaauguccacauauuacugaaguugaaccggaagacaucgauugcugguguaaccugaccaguacaugggugaccuaugggacuugcaaucaggcuggagagcaccgccgagacaagcguagcgucgcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcauugggaacagagacuuuguagaaggauugucaggugccaccuggguugaugugguccuggagcacggcgggugcgugacgacuauggcgaagaauaaacccacacuagacaucgagcuccagaagaccgaagcaacucagcuggccacacuuaggaaacuguguauugagggaaagaucaccaacauaacgaccgauagccggugcccuacacagggcgaagcuguguugccagaggaacaggaccagaauuaugucuguaaacacacuuacguugaucgcgguugggggaacggaugcggccucuucggcaaggggagucuggugaccugcgccaaguuucaauguuuagagcccauugagggaaaaguagugcaguaugaaaaucugaaguacacagucaucauuacugugcauaccggugaccagcaccagguuggcaacgagacacaaggggugaccgcagaaaucacuccucaggcuuccacgacagaggccauccucccagaauauggaacccuuggccuggagugcucuccgcgaacugguuuggacuucaaugagaugauucuacugaccaugaaaaacaaggcguggaugguccauagacagugguuuuucgaucucccccugccuuggacaagcggggccaccacugaaacaccaacguggaauaggaaagagcuucuggugaccuuuaagaacgcacacgcuaaaaagcaagaaguaguuguguugggcucccaggagggagccaugcacacugcucucacaggcgccaccgaaauacaaaauucagggggaacaaguaucuucgcaggucaucugaagugucgguuaaaaauggacaagcuggagcuaaaaggcaugagcuacgccaugugcacuaacaccuuuguccucaagaaagaggugucugaaacgcagcacgggaccauucugaucaaggucgaguacaagggagaagaugcucccuguaaaauaccuuucuccacagaggacggccaagguaaggcgcauaacgggcgucuuauuacugcaaauccagugguuaccaaaaaggaggaacccgugaacaucgaggccgaaccgccuuucggcgagucaaauaucguaauuggaaucggcgauaacgcuuugaaaauuaauugguauaagaaggggagcaguauaggaaaaauguuugaagccacagcacgcggugccagaaggauggcuauccugggcgacacugccugggauuucgggucugucggaggcgugcucaacucccuggguaagaugguucaccagauuuuugggagcgcauacaccgcgcuuuucucgggcgugucuugggucaugaaaaucggaaucggcgugcuguugacguggauugggcucaauuccaagaacacaucaaugaguuuuagcugcauagcuaucggaauuaucacccuguauuuaggcgccguagugcaggcagacauggguuguguuauuaauuggaaagggaaggagcugaagugcggauccggcaucuucgucacuaacgaggugcauacauggaccgaacaguacaaauuucaagccgauucucccaagcggcuagcuacugccauagccggugcuugggagaauggcgugugugggauccgaagcaccacacgcauggaaaaccuccuguggaaacagauugccaaugagcuuaacuauaucuugugggaaaauaacauuaagcugacggucguugugggagacaccaucggcgugcucgagcaggggaaaagaacucugacaccacagccuauggaguuaaaguacucauggaaaaccuggggaaaggcgaagauaguaacagccgaaacucaaaacaguuccuucauuaucgauggccccaauaccccagagugccccagcgcuucuagggcauggaacgucugggaaguggaggacuaugguuuugggguuuucacgacaaauauuuggcugaaacuucgggacguguacacccaguugugugaucaccgccucaugucagccgcugucaaggacgaaagagccgugcacgcagauaugggauacuggaucgagagucagaaaaacggcagcuggaagcuggagaaagcgucccuaauagaaguuaagacuugcaccuggccuaagucucauacacuguggucgaauggugugcucgagagcgacaugaucauuccaaaaucccuggccggcccgaucucacagcacaacuauaggcccggguaccauacucaaaccgcuggaccuuggcaccuuggcaaguuggaacuggauuuuaauuauugcgaggggacaacgguagucauuaccgagaacuguggaacucguggcccaaguuuacggacaaccacugugucugguaaacucauccacgaauggugcugucgaagcugcacacugcccccucuuagauacaugggggaggacggauguugguauggcauggaaauaaggccaauuuccgagaaggaagagaauauggugaaaucacuggucagcgccgguucuggcaagguugauaacuucaccauggggguguugugccucgcaauccuguuugaggaaguaaugcgcggaaaguucggcaaaaagcauaugaucgcuggggugcuauucacguuuguccugcuccuguccggacagauuacuuggcgggacauggcccacacccuuaucaugauuggcaguaaugcaagcgauagaauggguaugggggugacauacuuggcccugauagcuaccuucaaaauccagcccuuuuuagcgcucggauucuuucugaggaaacuuacuucucgcgagaaccugcuacucggcguuggccuggccauggcaacaaccuugcaacugccggaagacauugagcagauggcuaaugggaucgccuuaggacucauggcccugaaacuuauuacacaguucgaaacuuaucagcuguggaccgcuuuggugucccucacguguucaaacacaauccugacccuaacugucgcauggcgaaccgccacacugauacuugcgggugugagucuccugccuguuugccaaagcucguccaugcggaagacugauugguugccaaugaccguggcugccaugggcguacccccucugcccuuauuuaucuucucucucaaggacacgcugaaacguagaagcuggccacuuaaugaggggguaauggcagugggacugguuucaauuuuggccaguucccuccugaggaacgaugugccuauggcuggcccccuagucgccggugggcugcuuaucgccuguuacgugauuacaggaaccucugcggaccucacuguagagaacgcugccgacgugacaugggaagaggaagcagagcagaccggcgucagccauaaucugaugaucacuguugaugacgauggcacaaugcgcauaaaggacgaugaaaccgagaacauuuugacgguguuacugaaaacugcccuccugaucguguccgggaucuuuccauacucaauuccggcuacccuucuggucuggcacacauggcagaagcagacccaacggagcggaguguugugggacguuccuagucccccagagacacagaaagccgaacuagaggaagguguauauagaauaaagcagcagggcaucuucgggaaaacucaagugggagucggcgugcagaaggaggguguuuuucauaccauguggcacgugacgagaggggcaguccugacacacaauggaaagcgacucgagcccaacugggcuucugugaaaaaggaucugauuuccuacggcggcggguggcgccuuagcgcccaguggcaacggggagaagagguacaggucaucgcgguggaaccugguaaaaauccaaagaacuuccagacuaugcccggcaccuuucagacaaccacuggggagauuggagccaucgcauuagacuucaaaccuggcaccucggguucaccgauaaucaauagagaagggaagguugugggacuguauggcaacggcgucgugacaaagaaugggggauacguuucugguauugcucaaacgaacgccgagccagauggccccacuccugagcucgaagaggaaauguucaaaaagaggaauuugaccaucauggaccugcauccagggaguggaaaaacacguaaguaucuccccgcuauugugcgcgaggcaaucaaacggagacugaggacccuuauacuggccccuacucgagucguggccgcugaaauggaggaggcguugaagggccuaccgauucgguaccagacaaccgcaacgaaguccgaacacacuggucgcgagaucguagaucugaugugccaugccacauuuaccaugagacucuuaagccccgugaggguuccaaacuauaaucugaucauuauggacgaagcucacuucaccgauccugccucuaucgcagcccggggguacauaagcacucgagucggaaugggcgaggcugcggccauuuuuaugacagcaacacccccaggcacagcugacgccuucccucaguccaacgcacccauccaggacgaagagagagauauuccagagcgcucauggaauagugggaacgaauggaucacugacuuugccggaaaaacggugugguucgugccgagcauaaaggcugguaacgauauugccaauugucuuaggaaaaacggcaagaaagucauccaacugucucguaagaccuuugacacagaguaccagaagacuaaacucaaugauugggacuucguagugaccacagauaucuccgaaaugggggcgaacuuuaaggcagaccggguuauugauccuagaaggugcuugaaacccgugauccugaccgacggaccagagcgcgucauucucgccggccccauaccugugacugcugccucagcugcacagcgaagaggucggguugggaggaauccacagaaggagaacgaucaauauaucuucacgggccagccccugaauaacgacgaagaccaugcccacuggaccgaggcuaaaaugcuucuagauaauauuaacacaccugaaggaaucaucccggcccuguuugagccagaacgcgagaagagugcagcgauugacggcgaguaccguuugaagggggaaagcagaaaaacuuucguggaguuaaugcggaggggagaucugcccgucuggcucgcccacaagguggcuuccgaagguauaaaauauaccgaccgcaaguggugcuucgauggccagcgaaauaaccagauccuggaggaaaauauggacguagagauuuggacaaaagagggggaaaagaagaaacuuagaccucgguggcuggaugccaggaccuacucugacccccucgcauugaaagaguuuaaagauuucgcugccggacgcaagucgaucgcacuggaccuagugacugaaauuggcagaguuccaagccaucuggcccacaggacacggaacgcucucgauaaucuugucaugcugcauacgucagagcacggugggcgugcguaucgccacgccguggaagaguuaccugagaccauggaaacuuugcugcuccugggccuuaugauccugcucacaggaggcgcaauguuguuucugauauccgggaaaggaaucgguaagaccaguauuggcuuaaucugugugauugcuucuagcgggaugcuauggauggccgagaucccccugcaauggauagccuccgcaauuguccucgaguucuuuaugaugguucuucugaucccagagccugagaaacagcgaaccccgcaggacaaccaauuggcuuacgugguaauuggaauccugacacucgccgcgauaaucgcugccaaugaaaugggccugcuugagacuacgaagagagaucucgguaugucaaaggaacccgggguggucucuccaaccagcuaucuggacguggacuugcauccugcaagugccuggacacuguacgcuguugcaacuaccgugauuacacccauguuaaggcacaccaucgagaacuccacugccaacgucagccuagcggcuauugccaaucaggcaguagugcugaugggccucgauaaaggauggccaaucucuaagauggaccuuggcguuccucuguuggcccuggggugcuacucacaggugaacccccucacgcugacagcugccguccuuuuacugauaacccauuaugcaauuaucggaccgggccuccaggcuaaagccacucgggaagcgcaaaagcgcaccgccgcagguaucaugaaaaauccaacaguggaugggauuaugacuaucgacuuggauccugucauauacgacuccaaguucgagaagcagcugggacaggugaugcuacugguucucugugcugugcagcuucuguugaugagaaccaguugggcccugugcgaggcacucacacuggcuacgggccccauuaccacuuuaugggaagguagcccaggcaaauuuuggaacacaaccaucgccguaucgauggccaauauuuucagggggucuuaucuugcgggagcuggccuggcauuuuccaucaugaaaagcguggggacuggaaaacggggcacagguucacaaggggagacccucggagaaaaguggaaaaagaagcuaaaccagcugagucgaaaagaguucgauuuguacaagaaaucuggcauaacggaagucgacagaaccgaggccaaggagggucugaaacgcggcgaaaucacacaccaugcuguuuccagggggagcgccaagcuccagugguuuguggagcggaauauggucauucccgaaggacgugugaucgaucuuggcugugggagaggaggcuggucauauuacugcgcaggucugaaaaagguaacugaggugaggggguauaccaagggaggcccuggccacgaagaaccgguucccaugaguacauacggguggaacauugugaaauugaugagcggaaaggacgucuucuaccugccaccugagaaaugugauacucucuuaugcgacaucggugaauccucucccagcccuaccguggaggaaucccgcacaauucggguccugaagaugguggagccauggcuuaaaaauaaccaguuuuguaucaagguucugaaucccuauaugccuaccguaauagagcaccuagaacgacuccaaagaaagcauggcgggaugcuggugaggaacccauugucacgcaauucuacucacgagauguacuggauuaguaacggaacgggcaauaucgucucgagcgugaacaugguuucccggcugcuccuuaacagauucacaaugacccaucguaggcccacuaucgaaaaagauguggaccugggugccgggacccggcacgucaaugcugagccggaaacaccuaacauggacgugauuggagagcgcauaaagcgaaucaaagaggaacacaauucuacguggcauuaugaugacgagaacccauacaagaccugggcguaucacggcucauacgaaguaaaagccacuggcagcgcauccaguaugauuaauggggugguuaaguuacugacaaagcccugggaugucgugccuauggugacccagauggcuaugacugacacaaccccauucggacagcaaagagucuuuaaagagaagguugauacaaggacuccccggucuaugccggguacccgcaaagugaugggcaucacggccgaaugguuguggagaacccucgggaggaacaagcgaccucggcugugcacacgugaggaguucacuaaaaagguaagaaccaaugcagccaugggagcuguguuuacagaagagaaccagugggacagcgccaaggcggcagucgaagaugaggaguucuggaagcuaguggaccgcgagagggagcuucauaagcugggcaaaugugguucaugcguuuauaauaugauggggaagcgggagaagaagcucggagaguuuggcaaagccaagggcuccagagcuauuugguacauguggcugggggcccgcuacuuggaguucgaggcacugggauuucucaacgaggaucacugguucaguagggacaauagcuauucugguguggaaggcgaggggcuucauaagcugggauacaucuuacgagauauauccaaaauccccggcggugcuauguaugccgacgacacugcugggugggauacccggauuacggaagacgaucugcacaacgaggaaaagaucacacagcagauggacccagagcacagacaauuggccaaugcaauuuuuaaacucaccuaccagaacaaggucgugaaaguacagaggccuacucccacaggaaccguuauggauaucauaucacgcaaggaccagcguggcagcggccaaguggggacuuauggacugaauaccuucacaaacauggagguccagcuagugcggcagauggaaggugagggcgugcuuucgaaggcggaucuggaaaacccacaucuccccgagaaaaagauuacgcaguggcuggaaaccaaaggggucgagagauugaagaggauggccaucucuggagacgauugcguugugaaaccuaucgacgaucgcuuugcuaaugccuuacuggcacucaacgacaugggcaagguacgaaaggauauuccacaauggcagccgaguaaagguuggcacgacuggcaacaggugcccuucuguucccaucacuuucacgagcuuauaaugaaggacgggcggaaacuggucgugccuugcagaccacaagaugaacuaaucggaagggcucgcauuagccagggcgccggcuggucacugagagagacugcaugucucgggaaggccuacgcgcagaugugguccuugauguauuuccaucggagggaccugcgucuugcuucuaaugccaucugcagcgcaguucccgugcacugggucccuacaagucgaaccacuugguccauucaugcccaccaucaauggaugacaaccgaagauaugcugacgguguggaaccgcguauggaucgaggacaauccauggauggaaaacaaaacacccguuaccacuugggagaaugugccuuaccucggaaagagagaggaucaguggugugguagcuuaauaggccugaccucucgggcuacaugggcccagaacaucccgacugcaauucagcaagucaggucauugaucgggaaugaagaguuccuggacuacaugccaaguaugaagcgcuuuagaaaagaagaggaguccgaaggagcuauuugguga

SEQ ID NO: 15253 - RNA, 9873 nt, Artificial Sequence
  derived and/or modified CDS sequence (opt3) from DENV-3__GQ199889__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugauucuugucaccccaucgauggccaugcgcugugugggcguagggaacagagacuuuguugaaggauugucaggugcgacauggguggaugucgugcuggagcacggcgggugcgugaccacgauggcaaagaauaaacccacucuagacaucgagcuccagaagacagaagccacccaacuggcuacucuuaggaaacuguguauugagggaaagaucacaaacauaaccacggauagccggugcccuacccagggcgaagccauuuugccagaggaacaggaccagaauuaugucuguaaacacacauacguugaucgcgguugggggaacggaugcggccucuucggcaaggggagucuggugacuugcgcaaaguuucaauguuuagaguccaucgagggaaaaguagugcaguaugaaaaucugaaguacaccgucauuaucacagugcauacuggugaccagcaccagguuggcaacgagacccaaggggugacagcugaaaucaccccccaggccucuacuacggaggcgauucucccugaauauggaacacuuggccuggagugcagcccacgaaccgguuuggacuucaaugagaugauacuacugacuaugaaaaacaaggccuggaugguccauagacagugguuuuucgaucucccgcugcccuggaccuccggggcaacaaccgaaacuccuacauggaauaggaaagagcuucuggugacguuuaagaacgcucacgccaaaaagcaagaaguaguuguguugggcucacaggagggagcuaugcacaccgcccucacuggcgcaacagaaauccagaauagugggggaaccagcauuuucgccggucaucugaagugucgguuaaaaauggacaagcuggagcuaaaaggcaugucuuacgcuaugugcacaaacacuuuuguccucaagaaagagguguccgaaacccagcacgggacgauccugauaaaggucgaguacaagggagaagaugcgccauguaaaauucccuucucaaccgaggacggccaagguaaggcacauaacgggcgucuuaucacagccaauccugugguuacuaaaaaggaggaaccagugaacaucgaggcugaacccccguucggcgagagcaauauuguaaucggaauuggcgauaacgccuugaaaauaaauugguauaagaaggggaguucuaucggaaaaauguuugaagcaaccgcccgcggugcuagaaggauggccauucugggcgacacagcaugggauuucggguccgucggaggcgugcucaacagccuggguaagaugguucaccagaucuuugggucggcguacacugcucuuuucucuggcguguccugggucaugaaaaucggaauuggcgugcuguugaccuggauagggcucaauucaaagaacacgaguaugagcuuuuccugcaucgccauuggaaucauuacacuguauuuaggcgcaguagugcaggccgacaccgguuguguuaucaauuggaaagggaaggagcugaagugcggaucuggcauauucgucacuaacgaggugcauacauggaccgaacaguacaaauuucaagcugauagcccuaagcggcuagccacugcaaucgcuggugccugggagaauggcgugugugggauucgaucaaccacacgcauggaaaaccuccuguggaaacagaucgcgaaugagcuuaacuauauuuugugggaaaauaacaucaagcugacggucguugugggagacaccauaggcgugcucgagcaggggaaaagaacucugacaccccagccaauggaguuaaaguacaguuggaaaaccuggggaaaggccaagauuguaacagcugaaauccaaaacuccagcuucauuaucgauggcccuaauacucccgagugcccaucugcaucaagggccuggaacgucugggaaguggaggacuaugguuuugggguuuucaccacgaauauauggcugaaacuucgggaaguguacacacaguugugugaccaccgccucaugagugcugccgucaaggaugagagagcagugcacgcggacaugggauacuggaucgagagccagaaaaacggcuccuggaagcuggaaaaagccucuuuuauugagguuaagaccugcacuuggcccaagucgcauacccuauggagcaauggugugcuggaauccgauaugaucauuccuaaaucacucgcuggcccaaucagucagcacaacuauaggccgggguaccauacacaaacugccggacccuggcaccugggcaagcuugaguuggacuucaauuauugcgaggggaccacaguagucauaacggaaaacuguggaacccguggcccuucucugcggacuacaaccgugagcgguaaauuaauucacgaguggugcugucgauccugcacucucccaccccugagauacaugggggaagauggauguugguauggcauggagaucaggccuaucucagaaaaggaggagaauauggugaaaagccuugcaucugcugguuccggcaaggucgacaacuuuacaauggggguucugugcuuggccauucucuucgaagaggugaugcgcggaaaguucggcaaaaagcauaugaucgcagggguauuuuucaccuuugugcugcuacugaguggacagauuacguggcgggauauggcccacacucucauaaugaucggcagcaaugcuucugacagaauggguaugggggucaccuaccuggcgcuuauugccacauucaaaauccagccauuuuuggcacugggauucuuuuuaaggaagcucaccucccgcgaaaaccugcuucugggcgugggccuagcuauggccacuacacuccaacugcccgaggauauugaacagauggccaaugggaucgcuuugggacugauggcauuaaaacucauaacccaguucgagacauaucagcuguggacugcccuuaucucacugaccuguaguaacacgauguuuacauugaccguugcguggcgaacugcuacccucauucuggccggugugagccuacugccggucugccaaucguccucuaugcggaagacagacuggcuuccuaugacuguggcagccaugggcguuccaccccucccucuguucaucuuuagcuugaaggauacccugaaacguagaucauggcccuuaaaugagggggugauggcugucggacucguaaguauucuggcauccucucuucugaggaacgacgugccaauggccggcccuuugguugcgggugggaugcucaucgcuuguuacgugauaacgggaacaagcgccgaucugaccgucgaaaaggcagccgacgugacuugggaggaagaggcugaacagacaggcguaucccauaaccuaaugauuaccguggacgaugacggcacuaugcgcaucaaagaugacgagacagagaauauccugaccguccuucucaagacggcccuguugauuguuucagggauauuccccuacagcaucccagcaacuuuacugguguggcacaccuggcagaaacagacacaacggaguggagugcucugggaugucccgucuccucccgaaacccagaaggcugagcuggaagaggguguguauagaauuaaacagcagggcauccuugggaagacacaaguuggaguaggcgugcagaaggagggugucuuucauacuauguggcacgugaccaggggggccguucugacgcacaacggaaaacgauuggaaccaaauugggcguccgugaagaaagaccuaauuagcuacggcggcggguggcgccugucggcccaguggcaaaagggagaggaaguccaggugaucgcaguagagcccgguaaaaacccuaagaauuuccagacaaugccaggcacuuuccagaccacaaccggggaaauaggagcuaucgcccucgauuuuaagcccggcacuucagguucuccuauuaucaaccgggaggggaaagucgugggacuguauggcaauggcguugugaccaagaacgggggauacgucagugguauugcucaaacauccgcagagccggacggcccaacgcccgaacuugaggaagagauguucagaaaaaggaauuuaacuaucauggaucugcauccugggagcggaaagacccguaaauaucucccagccauagugcgcgaagccauuaagcggagauugaggacacugauccucgcucccacccgaguuguggcggcagagauggaggaagcccugaagggccuuccuauccgguaccagacuacagcuaccaaaucugagcacacgggucgcgaaauugucgaccugaugugccaugccacuuuuacaaugagauugcuaagcccggugaggguacccaacuauaaucugaucauaauggaugaggcacacuucaccgacccagccuccauugcugcgcggggguacaucucaacccgagugggaaugggcgaagccgcagcuauuuuuaugacugccacaccucccggcaccgcagaugccuucccacagaguaacgcuccuauccaggacgaggagagagacauacccgaacgcagcuggaauucugggaacgaguggauuacagauuuugccggaaagacuguuugguucgucccauccaucaaagcggguaaugacaucgcaaacugucucaggaagaacggcaaaaaggugauucaauuaucacguaagacguuugauaccgaauaccagaaaacaaagcugaaugacugggauuucguggucacuaccgacaucagugagaugggggccaacuuuaaagcugaucggguaauugacccgagaaggugccuuaagccugugauacugacagauggacccgagcgcguuauccucgccggcccaaugcccgugaccgcugcaagcgccgcucagcgaagaggucgggucgggaggaauccucagaaagaaaacgaccaauauauuuucacuggccagccauugaauaacgaugaggaccaugcccacuggacggaagcaaagaugcugcucgacaauaucaacacccccgagggaaucauuccugcgcuguucgaaccggagcgcgagaaguccgccgcuauagauggcgaauaccgucuuaaaggggagucuagaaagacauuuguggaacuaaugcggaggggagaccugccaguuugguuggcccacaaaguggcaucggaggguaucaaguauacugaucgcaaauggugcuucgacggccagcgaaauaaccagauuuuagaagagaauauggaugucgagaucuggaccaaggaaggggagaaaaagaagcugagaccccgguggcucgacgcuaggacauacagcgauccucuggcccuuaaagaauuuaaggacuucgcagccggacgcaaaucaauugcucuggaucucgugaccgagaucggcagaguacccucccauuuggcgcacaggacucggaacgcccuggacaaucuagugaugcugcauacaagugaacacggugggcgugcauaucgccacgcuguugaggagcucccagaaacgauggagacccuucuguuauugggccugaugauacuccugacuggaggcgccaugcuuuuucugaucucugggaagggaauugguaaaacaagcaucggccucauuugugucaucgccuccucagggauguuguggauggcagaugugccucugcaauggauagcuucugccauuguguuagaauucuuuaugaugguccuacugauccccgagccagagaagcagcgaaccccucaggacaaccaacucgcguacguugugauuggaauccuuacccuggcugccauaaucgcagccaaugaaaugggcuugcuggagacaacuaagagagaucucgguaugagcaaagaaccggggguagugagucccacguccuaucuggacgucgaccuucauccagcuagcgcauggacccucuacgccguggcgacaacuguuauuaccccuaugcugaggcacacaaucgagaacucuaccgcuaaugugucauuggccgcaauugccaaccaggcugucguacugaugggcuuagauaagggauggcccaucuccaaaauggaccuaggcgugccacugcucgcccuugggugcuacagucagguuaacccucugacuuugacggcagcugugcugcuccugauaacacauuaugccauuaucggacccggccuucaggcgaaggccacccgggaagcacaaaaacgcacugcugccgguaucaugaagaauccgaccgucgaugggauuaugacaaucgacuuagauccagugauauacgacagcaaguucgagaaacagcugggacaggucaugcucuuggugcugugugcaguucagcuacugcucaugagaacuucgugggcucuuugcgaggcccugaccuuggccacaggcccuauuacgacccugugggaagguucucccggcaaguuuuggaacacuacaaucgcgguguccauggcuaauauuuucagggggagcuaucucgcaggagccggccuggcuuuuucaaucaugaaaaguguagggaccggaaagcggggcacugguucucaaggggagacauuaggagaaaaauggaagaagaaacuuaaccagcugucccgaaaggaguucgaucucuacaaaaagagcggcauaaccgaaguggacagaacggaggccaaagagggucuaaagcgcggcgaaaccacaaggcacgcagucucacgggggagugccaaacugcagugguuuguugagcguaauauggugaucccagaaggaagagucauugauuugggcugugggaggggaggcuggagcuauuacugcgcuggucugaagaaggugacugagguacgcggguauaccaaaggaggccccggccaugaagagccugugccgauguccacauacggguggaacaucguuaagcucaugucuggaaaagacguguucuaccuucccccagagaagugugauacucuguugugcgacauuggugaaagcuccccuucacccaccgucgaggaaucucggacaauccgagugcugaaaauggucgagccuuggcucaagaauaaccaguucuguauuaagguguuaaauccauauaugcccaccguuaucgagcaccuggaaagacuucaaaggaaacacggcgggaugcugguacgcaacccucuaagucggaauucgacucaugagauguacuggauaagcaacggaacgggcaauauuguguccucugucaacauggugucaagacuccuguugaaucguuuuacaaugacccacaggcggccaacuaucgaacgcgauguugaccugggugcggggacccgacaugugaacgccgagcccgaaaucccgaacauggacgucauuggagagagaauaaagaggaucaaagaggaacacaauagcacauggcacuaugaugacgagaacccuuacaagacgugggcauaucauggcuccuacgaagugaaagcuaccggcagugccucuagcaugauuaaugggguagugaagcuccuuacuaagccaugggauguuguccccauggugacacagauggcaaugaccgacacuacaccuuucggacagcaacggguguuuaaagagaaggucgauacccgcacaccaagacccaugccggguacuaggaaaguuauggaaaucaccgccgaguggcuguggcgaacguuaggccggaacaagcguccuagacugugcacccgcgaggaauucacaaaaaaggugaggacuaaugcugccaugggggcgguauuuaccgaggaaaaccagugggacucagcaaaggccgcuguggaggaugaagaguucuggaaauuggucgaccgggagagagaacuccacaagcugggaaaauguggcuccugcguguauaauaugauggguaagcgcgagaaaaagcuaggggaauuuggaaaagccaagggcaguagggcaauuugguacauguggcuuggcgcucgauaccuggaguucgaggcccucggguuucugaacgaagaucauugguucagccgggagaauucuuauuccggaguugaaggugagggcuugcacaagcugggguacauccucagagacauaucaaaaauccccggaggcgcuauguaugccgaugacacagcagguugggacacuaggauuaccgaagaugaccuucauaacgaggagaagaucacgcagcagauggauccagaacaccgccaacuggcgaaugccauuuuuaaauuaacauaccagaacaagguggucaaagugcagcguccuacccccacugggacaguaauggacaucauaagccggaaggaucagagaggaucgggccaaguuggcaccuaugggcugaauacuuucaccaacauggaggcucaguuggugaggcagauggaaggagaggguguccucucuaaggccgaccuggaaaauccacaccuacuugagaaaaagauuacacaguggcuggagacgaaaggcguggaacgccucaagcgaauggcaaucaguggggaugacugcguggucaaacccaucgaugaccgguuugcuaacgcccuguuggcauuaaacgauaugggaaagguuagaaaggacauuccucaauggcagccauccaaaggcuggcaugauuggcagcaggugccguucuguagccaccauuuccacgagcugauaaugaaggacgguaggaaacucguagugcccugccgcccucaagacgaacuuaucgggagagcccggauuucacagggagcgggcuggucccugagggagaccgcuugucuaggcaaggccuacgcacagauguggucucugauguauuuucaccgucgagaucuccgcuuggccagcaaugcuaucugcagugccgucccagugcauuggguucccacuuccagaacaaccuggagcauucacgcacaucaccaauggaugacuacagaagacaugcugaccguguggaaccgggucuggaucgaggauaauccuuggauggaggacaaaacgccagugacaaccugggaaaacguacccuaccuugggaagagggaggaucagugguguggaucucugauaggucucacuucacgcgcuaccugggcccagaauaucccuacagcgauucagcaaguuagaaguuuaaucggcaacgaagaguuccuggacuacaugccguccaugaagcgguuuaggaaagaggaagagagcgaaggggcuauuugguga

SEQ ID NO: 15254 - RNA, 9873 nt, Artificial Sequence
  derived and/or modified CDS sequence (opt3) from DENV-3__FJ882571__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgcaggugcuugggagaauggcgucugugggauacgaagcaccacacgcauggaaaaccuccuguggaaacagaucgccaaugagcuuaacuauauuuugugggaaaauaacaucaagcugacgguuguggugggagacaccauuggcguacucgagcaggggaaaagaacucugacaccacagccuauggaguuaaaguacucauggaaaaccuggggaaaggcgaagaucgucacagccgaaacucaaaacaguuccuucauaauugauggccccaauaccccagagugccccagcgcuucuagggcauggaacgugugggaaguugaggacuaugguuuugggguguucacgacaaauaucuggcugaaacuucgggacgucuacacccaguugugugaucaccgccucaugucagccgcugugaaggacgaaagagccguucacgcagauaugggauacuggauugagagucagaaaaacggcagcuggaagcuggagaaagcgucccuaaucgaagugaagacuugcaccuggccuaagucucauacacuguggucgaaugguguacucgagagcgacaugauaaucccaaaaucccuggccggcccgauuucacagcacaacuauaggcccggguaccauacucaaaccgcuggaccuuggcaccuuggcaaguuggaacuggauuuuaauuauugcgaggggacaacggucgugaucaccgagaacuguggaacucguggcccaaguuuacggacaaccacugugucugguaaacucauucacgaauggugcugucgaagcugcacacugcccccucuuagauacaugggggaggacggauguugguauggcauggaaaucaggccaauauccgagaaggaagagaauauggucaaaucacugguuagcgccgguucuggcaagguggauaacuucaccauggggguauugugccucgcaauucuguuugaggaagugaugcgcggaaaguucggcaaaaagcauaugaucgcugggguccuauucacguuugugcugcuccuguccggacagaucacuuggcgggacauggcccacacccuuauuaugaucggcaguaaugcaagcgauagaauggguauggggguuacauacuuggcccugauugcuaccuucaaaauacagcccuuuuuagcgcucggauucuuucugaggaagcuuacuucucgcgagaaccugcuacucggcgugggccuggccauggcaacaaccuugcaacugccggaagacaucgagcagauggcuaaugggauugccuuaggacucauggcccugaaacuuaucacacaguucgaaacuuaucagcuguggaccgcuuuggucucccucacguguucaaacacaauucugacccuaacuguggcauggcgaaccgccacacugauccuugcggguguuagucuccugccugugugccaaagcucguccaugcggaagacugauugguugccaaugaccgucgcugccaugggcguacccccucugcccuuauuuauauucucucucaaggacacgcugaaacguagaagcuggccacuuaaugagggggugauggcaguuggacuggugucaaucuuggccaguucccuccugaggaacgaugucccuauggcuggcccccuaguggcaggugggcugcuuauugccuguuacguaaucacaggaaccucugcggaccucauuguggagaaggcugccgacgucacuugggaagaggaagcagagcagacaggcguuagccauaaccugaugaucaccguggaugacgauggcacuaugcgcauaaaagacgaugaaacagagaauauuuugaccguguuacugaagacggcccuccugaucgucuccgggaucuuuccauacucaauuccggcuacucuucugguguggcacaccuggcagaaacagacacaacggagcggaguuuugugggacguaccuagucccccagagacccagaaggccgaacuagaggaagguguguauagaauaaaacagcagggcauccuggggaagacacaagucggagugggcguucagaaggaggguguguuccauacuauguggcacgucaccaggggggcagugcucacgcacaacggaaaacgacuggagcccaauugggcuucuguaaagaaagaucuuauuuccuacggcggcggguggcgcuuaagcgcccaguggcaaaagggagaagagguccaggugaucgcgguugaaccugguaaaaacccaaagaauuuucagacaaugcccggcacuuuccagaccacaaccggggagauuggagccaucgcacuggacuuuaagccuggcacuucggguucaccgauaaucaaccgggaagggaaaguggucggacucuauggcaauggcgugguuaccaagaacgggggauacgugucugguauugcucaaacaaaugccgagccagauggccccacgccugaguuggaagaggaaauguucaaaaagagaaaccugacuaucauggaccuccauccagggaguggaaaaaccaggaaguaucugcccgcuauuguccgugaggcaaucaagcgccggcuuagaacacugauauuggccccuaccagggugguagccgcugaaauggaggaggcgcuaaaaggccugccgauucgauaccagacuacagcaaccaaguccgaacacacgggucgggagaucguggaucucaugugccaugccacuuucacaaugcgcuuacugagccccguuagagucccaaauuauaaccuuaucauuauggacgaagcucacuuuaccgauccugccucuaucgcagccaggggguacauaagcacccgggugggaaugggcgaggcugcggccauuuucaugacugcaacacccccaggcaccgcugacgccuuuccucaguccaaugcacccauccaggacgaagagcgagauauuccagagagaucauggaacagugggaaugaauggaucacagacuucgccggaaaaacugugugguuugucccgagcauaaaggcugguaacgauauugccaacugucugcgcaaaaauggcaagaagguaauccaacucucuaggaaaacguucgacaccgaguaccagaagacaaaauugaacgauugggacuuugugguuacuaccgauaucuccgaaaugggggcgaauuucaaggcagaccgugugauugauccucggagaugccugaaacccgucauccucacagacggaccagagagggugauucuggccggccccaugccuguuaccgcugccucagcugcacagcgccgagguagaguggggcggaacccacagaaggagaaugaucaauauauauuuacuggccagccccuuaacaaugacgaagaccaugcccacuggacggaggcuaagaugcuacuggauaacaucaauaccccugaaggaauuaucccggccuuguucgagccagaaagggagaaaagugcagcgaucgacggcgaguaccgcuuaaagggggaaagccguaaaacauuugucgagcugaugagacggggagaucuccccguguggcuggcccacaagguagcuuccgaagguauuaaauauacugacaggaaguggugcuucgauggccagcgcaacaaucagauacuugaggaaaacauggacguggagaucuggaccaaagagggggaaaagaagaaacugcgaccuagauggcucgaugcccggacauacucugaccccuuggcacugaaggaguucaaagauuuugcugccggaaggaagucgauugcacuagaccugguuaccgaaaucggccgcgucccaagccaucucgcccacagaacuaggaaugcucuugauaaccuggugauguuacauacaucagagcacggugggcgggcguaucgucacgccguggaagaguugccugagacgauggaaacccugcuccugcuuggccugaugauucucuugacuggaggcgcaaugcuguucuuaaucuccgggaaaggaauagguaagacaaguaucggccuaauuugugucaucgcuucuagcgggaugcuguggauggccgagauuccccuccaauggaucgccuccgcaauaguucuugaauuuuucaugauggugcuguugauuccagagccugagaagcagcgcaccccgcaggacaaucaacuggcuuacguagugaucggaauucucacccuggccgcgaucauagcugccaacgaaaugggccuucucgagacaacuaaacgagaucuggguaugucaaaggaacccggggucgugucuccaacgagcuauuuggacguugaccugcauccugcaagugccuggaccuuauacgcuguggcaacaacugucaucacccccaugcuaagacacacaauugagaauuccaccgccaacguaagccuggcggcuaucgccaaccaggcagugguucucaugggccuugauaaaggauggccaauuucuaagauggaccugggcgugccuuugcuggcccucgggugcuacucacaggucaauccccugacucuuacggcugccguguuacugcucaucacacauuaugcaauaauuggaccgggcuugcaggcuaaagccaccagggaagcgcaaaagcggacugccgcagguaucaugaagaacccaaccgucgaugggaucaugacaauugaccuggauccugugaucuacgacuccaaauuugagaagcagcuaggacagguuaugcugcucgugcuuugugcuguacagcuguugcugaugcgcacuaguugggcccucugcgaggcacugaccuuagcuacaggccccauaacgacccuuugggaagguagcccaggcaaauucuggaauacuacaauugccgugucgauggccaacaucuuuagagggucuuaucuggcgggagcuggccucgcauucuccauuaugaagagcgucgggaccggaaaaaggggcacugguucacaaggggagacacuaggagaaaaguggaagaaaaagcugaaucaguugagucggaaagaguuugaucuguacaagaaaucuggcaucaccgaaguugaccgaacggaggccaaggagggucucaaaagaggcgaaauaacccaccaugcugugucccgcgggagcgccaagcuucagugguucgucgagaggaacauggugauccccgaaggacggguaauugaucugggcugugggcguggaggcuggucauauuacugcgcagguuugaagaaagugacagagguuagaggguauacuaagggaggcccuggccacgaagagccggugcccaugaguaccuacggguggaauaucgucaaacugaugagcggaaaggacguguuuuaccucccaccugagaaaugugauacauuacugugcgacauuggugaauccucucccagcccuacugucgaggaauccaggaccauccgcgugcuuaagaugguugagccauggcugaagaacaaucaguucuguauuaaaguacuaaaccccuauaugccuacagugaucgagcaccucgaacggcugcaacgaaagcauggcgggauguuggucagaaauccacugucaaggaacucuacccacgagauguacuggauaaguaauggaacuggcaacauugugucgagcguuaauauggugucccgccuccuucugaaccgguuuacgaugacacauagacgucccaccaucgaaaaagaugucgacuuaggugccgggacuaggcacgugaacgcugagccggaaaccccuaauauggacguaaucggagagcggauuaagcgcauaaaagaggaacacaacucuacauggcauuaugaugacgagaauccauacaagacgugggcguaucacggcucauacgaagugaaggccaccggcagcgcauccaguaugaucaacgggguugucaaacuguugacuaagcccugggauguggugccuauggucacacagauggcuaugaccgacacuacaccauucggacagcaacgaguuuucaaagagaagguggauaccagaacacccaggccgaugccugguacucggaaaguaaugggcauuaccgccgaauggcucuggcgcacgcuggggagaaauaagaggccccgacuaugcacccgggaggaguuuacaaagaaagugcguacuaacgcagccaugggagcugucuucaccgaagagaaucagugggacucugccaaggcggcaguggaagaugaggaauuuuggaaacuuguugacagagagcgcgagcugcauaagcucggcaaaugugguagcugcguguauaacaugauggggaagagggaaaaaaagcugggagaguucggcaaggccaaaggcucacgggcuaucugguacaugugguugggggccagauaccuggaauuugaggcacucggauuccuuaaugaggaucacugguuuucccgcgacaacaguuauagcggugucgaaggcgaggggcugcauaaguuaggauacauucugagggauaucucuaaaauaccaggcggugcuauguaugccgacgacacagcugggugggauacucgaaucaccgaagacgauuugcacaaugaggaaaagauuacgcagcagauggacccugagcaccggcaacucgccaacgcaaucuucaaacugacauaccagaauaaggugguaaagguucagagacccaccccaacuggaacagugauggauauuaucuccaggaaagaccagcgcggcucaggccaagucgggaccuauggacuaaacacuuuuaccaauauggaggugcagcuugugcgucagauggaaggugagggcguccugagcaaggcggaucucgaaaacccccaucugccugagaaaaagauaacacagugguuggaaacgaaagggguugagcgguuaaagagaauggccauuucgggagacgauugcgugguaaagccaaucgacgauagguucgcuaacgcccugcucgcacuuaaugacaugggcaaagugcgcaaggauaucccgcaauggcagcccucuaaagguaugcacgacuggcagcaggucccuuuuuguagucaucacuuccacgagcugauuaugaaggacgggcgaaaacuagugguuccaugccggccccaagaugaacugauaggaagagcuaggaucucccagggcgccggcuggagccuccgcgagaccgcauguuuggggaaggccuacgcgcagauguggucacugauguauuuucauagacgggaccuuaggcuggcuuccaacgccauuugcucugcagugccuguccacugggugccaacuagccguacaaccuggaguauccaugcccaccaucaauggaugacuacagaagauaugcucgcuguauggaaucgaguuuggauugaggacaaccccuggauggaagauaagaccccugugacgacaugggaggacgucccguacuuaggaaaacgcgaggaucaguggugugguucccugaucggcuugaccagcagagccacuugggcacagaauauacugaccgcuauccagcaagugcggucucucauugggaacgaagaguuccuugacuacaugccaucaaugaagagguuccgcaaagaagaggagagugaaggagccaucugguga

SEQ ID NO: 15255 - RNA, 9873 nt, Artificial Sequence
  derived and/or modified CDS sequence (opt3) from DENV-3__FJ882572__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagaguccauagagggaaaagugguccaguaugaaaaucugaaguacacagugauuaucacuguucauaccggugaccagcaccaggugggcaacgagacacaaggggucaccgcagaaauuacuccccaggcuucuacgacagaggccauccucccugaauauggaacccuuggccuggagugcagcccacgaacugguuuggacuucaaugagaugauccuacugaccaugaaaaacaaggcguggauggugcauagacagugguuuuucgaucucccgcugcccuggacauccggggccaccacugaaacaccuacguggaauaggaaagagcuucugguaaccuuuaagaacgcacacgcuaaaaagcaagaaguuguggucuugggcucacaggagggagccaugcacacugcucucacaggcgccaccgaaauucagaauagugggggaacaagcauauucgcaggucaucugaagugucgguuaaaaauggacaagcuggagcuaaaaggcaugucuuacgccaugugcacuaacaccuuugugcucaagaaagaggucuccgaaacgcagcacgggaccauccugauuaagguggaguacaagggagaagaugcuccauguaaaauccccuucucaacagaggacggccaagguaaggcgcauaacgggcgucuuauaacugcaaauccuguugugaccaaaaaggaggaaccaguaaacauugaggccgaacccccguucggcgagagcaauaucgucaucggaauuggcgauaacgcuuugaaaaucaauugguauaagaaggggaguucuauuggaaaaauguuugaagccacagcacgcggugccagaaggauggcuauacugggcgacacugccugggauuucggguccgugggaggcguucucaacagccuggguaagauggugcaccagaucuuugggucggcauacaccgcgcuuuucucuggcgucuccugggugaugaaaauuggaaucggcguacuguugacguggaucgggcucaauucaaagaacacaaguaugagcuuuuccugcauugcuauaggaaucauuacccuguauuuaggcgccgugguucaggcagacacugguugugucaucaauuggaaagggaaggagcugaagugcggaucuggcauuuucgugacaaacgaggugcauaccuggacugaacaguacaaauuucaagccgauagcccuaagcggcuagcuaccgccaucgcaggugcuugggagaauggcgucugugggauacgaucaacaacgcgcauggaaaaccuccuguggaaacagaucgccaaugagcuuaacuauauuuugugggaaaauaacaucaagcugaccguuguggugggagacacuauuggcguacucgagcaggggaaaagaacacugaccccccagccaauggaguuaaaguacaguuggaaaacauggggaaaggcgaagaucgucacugccgaaauacaaaacuccagcuucauuaucgauggcccuaauacccccgagugcccaucugcuucaagggcauggaacgugugggaaguugaggacuaugguuuugggguguucacgacaaauauuuggcugaaacuucgggaagucuacacccaguugugugaccaccgccucaugagugccgcugugaaggaugagagagccguucacgcagacaugggauacuggaucgagagccagaaaaacggcuccuggaagcuggaaaaagcgucuuuuauagaggugaagacuugcaccuggcccaagucgcauacacuauggagcaaugguguacuggaauccgauaugaucauuccuaaaucacucgccggcccaaucagucagcacaacuauaggccgggguaccauacucaaaccgcuggacccuggcaccugggcaagcuugaguuggacuucaauuauugcgaggggacaacggucgugauuaccgaaaacuguggaacucguggcccuucucugcggacaaccacugugagcgguaaauuaauccacgaguggugcugucgauccugcacacucccaccccugagauacaugggggaagauggauguugguauggcauggagauaaggccuauuucagaaaaggaggagaauauggucaaaagccuugccucugcagguuccggcaagguugacaacuuuaccaugggggugcugugcuuggcuauccucuucgaagagguaaugcgcggaaaguucggcaaaaagcauaugaucgccgggguguuuuucacguuuguccugcuacugaguggacagauuacuuggcgggauauggcacacacccucaucaugauuggcagcaaugccucugacagaauggguaugggggugacauaccuggcucuuauagcgaccuucaaaauccagccauuuuuggcccugggauucuuuuuaaggaagcucacuucccgcgaaaaccugcuucugggcguuggccuagcaauggcuacaacccuccaacugcccgaggauauugaacagauggccaaugggaucgccuugggacugauggcuuuaaaacucauuacacaguucgagacuuaucagcuguggaccgcacuuaucucacugacguguaguaacacaauguuuaccuugacuguggccuggcgaaccgcgacacucauacuggcuggugucagccuacugccggugugccaaucguccucuaugcggaagacugacuggcuuccuaugaccguugccgcaaugggcgugccaccccucccucuguucaucuuuagcuugaaggauacgcugaaacguagaucauggcccuuaaaugagggggucauggccguaggacucgugaguauucuggcuuccucucuucugaggaacgacguuccaauggcaggcccuuugguggccggugggaugcucaucgcguguuacgucauuacaggaaccagcgcugaucugacuguggaaaaggccgcagacguaacaugggaggaagaggccgaacagaccggcgugucccauaaccuaaugaucacugucgacgaugacggcacaaugcgcauaaaagaugacgagaccgagaauauucugacgguucuucucaagacugcucuguugaucgugucagggaucuuccccuacagcauuccagccaccuuacugguguggcacacauggcagaaacagacccaacggaguggaguccucugggaugugccgucuccucccgaaacacagaaggcagagcuggaagaggguguuuauagaauaaaacagcagggcauccuugggaagacucaaguaggagugggcguccagaaggaggguguguuucauaccauguggcacguuacgaggggggcugugcugacacacaacggaaaacgauuggaaccaaauugggccuccgucaagaaagaccuaauuagcuacggcggcggguggcgccugucggcgcaguggcaaaagggagaggaagugcagguaaucgccgucgagcccgguaaaaacccuaagaauuuccagacuaugccaggcaccuuccagacaaccacuggggaaauuggagcaaucgcucucgauuuuaagcccggcaccucagguucuccuauaaucaaccgggaggggaaagugguuggacuguauggcaauggcguggucacaaagaacgggggauacgugagugguauugcccaaacguccgcugagccggacggcccaacucccgaacuugaggaagagauguucagaaaaaggaauuuaaccaucauggaucugcauccugggagcggaaagacacguaaauaucucccagcaauuguucgcgaagccaucaagcggagauugaggacccugauacucgcccccacucgaguggucgcugcggagauggaggaagcacugaagggccuuccuauucgguaccagacaaccgccacgaaaucugagcacacuggucgcgaaaucguggaccugaugugccaugcuacauuuaccaugagauugcuaagcccgguaagggugcccaacuauaaucugaucauuauggaugaggcccacuucaccgacccagcauccaucgccgcucggggguacauaucaacucgaguuggaaugggcgaagcggccgcaauuuuuaugacagcuaccccucccggcacagccgaugcauucccacagaguaacgccccuauccaggacgaggagagagacauucccgaacgcagcuggaauucugggaacgaguggaucacugauuuugcuggaaagacggucugguucgugccauccauaaaagccgguaaugacauugcgaacugucucaggaagaacggcaaaaaggugauccaauuaucacguaagaccuuugauacagaauaccagaaaacuaagcugaaugacugggauuucgucguaaccacagacaucagugagaugggggcaaacuuuaaagccgaucgggugauugacccgagaaggugccuuaagccuguuauccugaccgauggacccgagcgcgugauucucgcuggcccaaugcccgucacugccgcuagcgcagcccagcgaagaggucggguggggaggaauccucagaaagaaaacgaccaauauauauucacgggccagccauugaauaacgaugaggaccaugcucacuggaccgaagccaagaugcugcucgacaauaucaacacacccgagggaauuaucccugcacuguucgaaccggagcgcgagaaguccgcggccaucgauggcgaauaccgucuuaaaggggagucuagaaagacuuuuguugaacuaaugcggaggggagaccugccagugugguuggcucacaaagucgccucggaggguauuaaguauaccgaucgcaaauggugcuucgacggccagcgaaauaaccagauauuagaagagaauauggauguggagaucuggacaaaggaaggggagaaaaagaagcugagaccccgguggcucgacgcaaggaccuacagcgauccucuggcucuuaaagaauuuaaggacuucgccgcaggacgcaaaucaauugcccuggaucucguaacugagaucggcagagugcccucccauuuggcucacaggacacggaacgcgcuggacaaucuaguuaugcugcauacgagugaacacggugggcgugccuaucgccacgcagucgaggagcucccagaaaccauggagacucuucuguuauugggccugaugauucuccugacaggaggcgcuaugcuuuuucugaucucugggaagggaauagguaaaaccagcaucggccucauuugugugaucgccuccucagggauguuguggauggccgaugugccucugcaauggauugcaucugcuaucgucuuagaauucuuuaugaugguucuacugauacccgagccagagaagcagcgaaccccucaggacaaccaacucgccuacgugguaauuggaauccuuacacuggcggcuauuaucgccgcaaaugaaaugggcuugcuggagacuacgaagagagaucucgguaugagcaaagaaccggggguggucagucccaccuccuaucuggacguggaccuucauccagccagcgcuuggacacucuacgcaguugccacuaccgugauaacaccuaugcugaggcacaccaucgagaacucuacugcgaaugucucauuggcugccauugcaaaccaggccguagugcugaugggcuuagauaagggauggcccaucuccaaaauggaccuaggcguuccacugcucgcucuugggugcuacagucaggugaacccucugacguugacagccgcaguccugcuccugauuacccauuaugcuaucauaggacccggccuucaggccaaggcgacucgggaagcccaaaaacgcaccgcagcugguauuaugaagaauccgacaguggaugggaucaugacuaucgacuuagauccagucauuuacgacagcaaguucgagaaacagcugggacaggugaugcucuugguucugugugccgugcagcuacugcucaugagaaccucgugggcacuuugcgaggcucugacauuggccacgggcccuaucaccacucugugggaagguucucccggcaaguuuuggaacacaaccauagccguauccauggcgaauauuuucagggggagcuaucucgcuggagcaggccuggccuuuucaaucaugaaaaguguggggacuggaaagcggggcacagguucucaaggggagaccuuaggagaaaaauggaagaagaaacuuaaccagcugucccgaaaggaguucgaucucuacaaaaagagcggcauuacggaagucgacagaaccgaggcuaaagagggucuaaagcgcggcgaaacaacucaccaugccguuucaagggggagugcaaaacugcagugguuuguggagcggaauauggucaucccagaaggacgugugauagauuugggcugugggagaggaggcuggagcuauuacugcgccggucugaagaagguaaccgaggugaggggguauacaaaaggaggccccggccacgaagagccuguuccgauguccacuuacggguggaacaucgugaagcucaugucuggaaaagacgucuucuaccuucccccagagaagugugauacccuguugugcgacauuggugaaagcuccccuucacccacaguggaggaaucucgcaccauccggguccugaaaaugguggagccuuggcucaagaauaaccaguucuguauuaagguuuuaaauccauauaugcccacuguaaucgagcaccuggaacgacuucaaagaaaacauggcgggaugcuggugaggaacccucuaagucgcaauucgacgcacgagauguacuggauuagcaacggaacaggcaauaucgucuccucugugaacaugguuucacggcuccuguugaauagauuuaccaugacucaucguaggccaaccauagaacgggauguggaccugggugcugggacacgccacgucaacgcggagcccgaaauuccgaacauggacgugaucggagagcgaaucaagagaauuaaagaggaacacaauagcacguggcauuaugaugacgagaacccuuacaagaccugggccuaucacggcuccuacgaaguaaaagcaacuggcagugcuucuagcaugauaaauggggugguuaagcuccuuacaaagccaugggaugucgugcccauggugacccagauggccaugacugacacaaccccuuucggacagcaaagggucuuuaaagagaagguugauacacggacuccacgccccaugccggguaccagaaaagugauggaaaucacggcagaguggcuguggaggaccuuaggccgaaacaagcggccucgucugugcacaagagaggaauucacuaaaaagguacgcaccaaugccgcuaugggggccguguuuacagaggaaaaccagugggacucagcgaaggcagccgucgaggaugaagaguucuggaaauugguggacagggagcgggaacuccauaagcugggaaaauguggcuccugcguuuauaauaugauggguaagagagagaaaaagcuaggggaauuuggaaaagcuaagggcagucgcgccauuugguacauguggcuuggcgcaagguaccuggaguucgaggcucucggguuucugaacgaagaucacugguucagccgagagaauucuuauuccggaguggaaggugagggcuugcauaagcugggguacauccuccgggacauuucaaaaauccccggaggcgccauguaugcugaugacacugccgguugggacaccagaauaacggaagaugaccuucacaacgaggagaagaucacacagcagauggauccagaacacaggcaacuggcaaaugcgauuuuuaaauuaaccuaccagaacaaggucgugaaaguacagcgcccuacucccacagggaccguuauggacaucauuagccguaaggaucagcggggaucgggccaagugggcacuuaugggcugaauaccuucacaaacauggaggcccaguuggucagacagauggaaggagagggugugcucucuaaggcugaccuggaaaauccacaucuacuugagaaaaagaucacgcaguggcuggagaccaaaggcguggaaaggcucaagcgcauggccauaaguggggaugacugcgucguuaaacccauugaugaccgauuugcaaacgcucuguuggccuuaaacgauaugggaaaggugcggaaggacaucccucaauggcagccauccaaaggcuggcacgauuggcagcagguaccguucuguagccaucacuuccacgagcugaucaugaaggacgguagaaaacucgugguccccugcaggccucaagacgaacuuauugggcgcgcaagaauaucacagggagccggcuggucccugcgggagacugcgugucuaggcaaggcuuacgcccagauguggucucugauguauuuucauaggcgugaucuccgauuggcaagcaaugccaucugcagugcugugccaguucacugggugcccacaucccgcaccacuuggagcauucaugcccaccaucaauggaugacaaccgaagacaugcugacggucuggaacagaguguggaucgaggauaauccuuggauggaggacaaaacaccaguaaccacuugggaaaacguucccuaccuugggaagcgggaggaucagugguguggaucucugauuggucucaccucaagggcaacaugggcucagaauaucccuacugccauacagcaagugcgcaguuuaaucggcaacgaagaguuccuggacuacaugccguccaugaagagauuucggaaagaggaagagagcgaaggggcgauuugguga

SEQ ID NO: 15256 - RNA, 9873 nt, Artificial Sequence
  derived and/or modified CDS sequence (opt3) from DENV-3__FJ882573__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuugggccagcggggcaacaaccgaaacuccaacauggaauaggaaagagcuucugguaacguuuaagaacgcucacgccaaaaagcaagaaguuguggucuugggcucccaggagggagcuaugcacaccgcccucacuggcgcaacagaaauucagaauucagggggaaccaguauauucgccggucaucugaagugucgguuaaaaauggacaagcuggagcuaaaaggcaugagcuacgcuaugugcacaaacacuuuugugcucaagaaagaggucucugaaacccagcacgggacgauccugauuaagguggaguacaagggagaagaugcgcccuguaaaaucccuuucuccaccgaggacggccaagguaaggcacauaacgggcgucuuauaacagccaauccaguugugacuaaaaaggaggaacccguaaacauugaggcugaaccgccuuucggcgagucaaauaucgucaucggaauuggcgauaacgccuugaaaaucaauugguauaagaaggggagcaguauuggaaaaauguuugaagcaaccgcccgcggugcuagaaggauggccauacugggcgacacagcaugggauuucgggucugugggaggcguucucaacucccuggguaagauggugcaccagaucuuugggagcgcguacacugcucuuuucucgggcgucucuugggugaugaaaauuggaaucggcguacuguugaccuggaucgggcucaauuccaagaacacgcccaugucauuuaguugcauugccauaggaaucauuacacuguauuuaggcgcagugguucaggccgacauggguugugucaucaauuggaaagggaaggagcugaagugcggaagcggcauuuucgugaccaacgaggugcauacuuggacagaacaguacaaauuucaagcugauuccccaaagcggcuagccaccgcaaucgcuggugccugggagaauggcgucugugggauacgaucuacuacccgcauggaaaaccuccuguggaaacagaucgcgaaugagcuuaacuauauuuugugggaaaauaacaucaagcugacaguuguggugggagacacgaccggcguacucgagcaggggaaaagaacucugacaccucagcccauggaguuaaaguacagcuggaaaaccuggggaaaggccaagauugucacagcugaaacucaaaacucaaguuucaucauagauggcccaaauacccccgagugcccuuccgcaagcagggccuggaacgugugggaaguugaggacuaugguuuugggguguucacgacaaauauuuggcugaaacuucgggaagucuacacccaguugugugaccaccgccucaugucugcugccgugaaggaugagagagcaguucacgcggacaugggauacuggaucgagucacagaaaaacggcaguuggaagcuggaaaaagccagccuaauugaggugaagacuugcaccuggccaaagucccauacacuguggucuaaugguguacucgaaucggauaugaucauaccgaaaagccuggcuggccccaucucccagcacaacuauaggccuggguaccauacucaaaccgccggaccauggcaccuuggcaaguuggagcuggacuuuaauuauugcgaggggacaacggucgugauuaccgaaaacuguggaacucguggccccucauuacggacaaccacugugagugguaaacucauccacgaguggugcugucgaucuugcacacugccuccacuuagauacaugggggaagauggauguugguauggcauggagauuaggcccaucagcgaaaaggaggagaauauggucaaaucccugguuucagcagguagcggcaagguggacaacuucaccauggggguauugugccucgcuauacuguuugaagaggugaugcgcggaaaguucggcaaaaagcauaugauugccggggucuucuuuacguucgugcuacugcucucuggacagaucacuuggcgggauauggcacacacccugaucaugauuggcuccaaugccagugacagaauggguauggggguuacauaccuugcuuugaucgcgaccuuuaaaauucagccguuccuggccuuaggauuuuuccucaggaagcugacuagccgcgaaaaccuucugcuaggcgugggccucgcaauggcuacaacccugcaauugccugaggauauagaacagauggccaaugggaucgcccugggauuaauggcucucaaacugauuacacaguuugagacuuaucagcuuuggaccgcacuggucucuuugacguguuccaacacaaucuucacccucacuguggccuggcgaaccgcgacacugauucuagcugguguuucacugcuuccagugugccaaaguagcucgaugcggaagacugacuggcuccccaugaccgucgccgcaaugggcguaccuccccugccauuguuuaucuucucccugaaggauacguuaaaacguagaucuuggccucucaaugagggggugauggccguuggacuggugagcauacuugcuucaagucuguugaggaacgacguccccauggcaggcccacucguggccggugggcugcuaaucgcguguuacguaauuacaggaaccuccgcugaucugacuguggaaaaggccgcagacgucacaugggaggaagaggccgaacagaccggcguuucucauaaccuuaugaucacuguggacgaugacggcacaaugcgcauuaaagaugacgagaccgagaauauccucacggugcuguugaagacugcuuuacugauagucagcgggauuuuuccguacuccaucccugccacccuccugguguggcacacauggcagaaacagacccaacggucaggaguucuuugggauguacccagcccacccgaaacacagaaggcagagcuggaagaggguguguauagaaucaaacagcagggcauuuuggggaagacucaagucggagugggcguucagaaggaggguguguuccauaccauguggcacgucacgaggggggcugugcuaacacacaacggaaaacgacuggaaccuaauugggccaguguaaagaaagaccucauaucuuacggcggcggguggcgccuguccgcgcaguggcaaaagggagaggaaguccaggugaucgccguugagccagguaaaaaccccaagaauuuucagacuaugccuggcaccuuccagacaaccacuggggaaauuggagcaaucgcucuugauuucaagccgggcaccagcgguucgccaauuaucaaccgggaggggaaaguggucggauuauauggcaauggcgugguuacaaagaacgggggauacgugucagguauagcccaaacgaaugcugagcccgacggcccuacuccagaacuggaggaagagauguuuaaaaagagaaaccucaccaucauggauuugcaucccgggucuggaaaaacaaggaaguaucugccugcaauuguccgugaagccaucaagcgccggcucagaacccugauucuugccccgacuagggugguagcugcggagauggaggaagcacugaaaggcuugcccauccgauaccagacaaccgccacgaagagugagcacacuggucgggaaauaguggaccuaaugugccaugcuacauucaccaugcgccugcucuccccaguuagagucccuaauuauaacuuaauuaucauggaugaggcccacuuuaccgaccccgcaagcaucgccgcuaggggguacauuucuacucgggugggaaugggcgaagcggccgcaaucuucaugacagcuaccccaccuggcacagccgaugcauuuccccagagcaaugccccaauacaggacgaggagcgagacauuccggaaagauccuggaacucagggaaugaguggaucacugauuucgcuggaaaaacggugugguuugucccuaguauuaaggccgguaacgacaucgcgaacugucugcgcaaaaauggcaagaagguaauacaacuuagcaggaaaaccuucgauacagaauaccagaagacuaaacugaacgacugggauuuugugguuaccacagacauuucugagaugggggcaaauuucaaggccgaucgugugaucgacccccggagaugccucaaaccagucaucuugaccgauggacccgagagggugauucuggcuggcccuaugccaguuacugccgcuuccgcagcccagcgccgagguagaguggggcggaacccccagaaggaaaaugaccaauauaucuuuacgggccagccucucaacaaugaugaggaccaugcucacuggaccgaagccaagaugcugcuugacaacauuaauacaccggagggaauaaucccagcacuauucgaacccgagagggagaaaucagcggccauugauggcgaauaccgccugaagggggagagucguaaaacuuucgucgaauugaugagacggggagacuuaccuguguggcuggcucacaagguagccagcgaggguaucaaauauaccgauaggaaguggugcuuugacggccagcgcaacaaucagauccucgaagagaacauggauguggagauuuggacaaaagaaggggagaagaagaaacugcgacccagauggcuugacgcacggaccuacuccgauccacuggcucucaaggaauucaaagacuuugccgcaggaaggaagucuauagccuuggaucugguuacugagaucggccgcgucccuucgcaucuagcucacagaacaaggaaugcgcuggacaaccucgugaugcuucauacgagcgaacacggugggcgggccuaucgucacgcaguggaggagcugcccgaaaccauggagacuuuauugcugcucggccugaugauucuucugacaggaggcgcuaugcucuucuugaucucagggaaaggaauugguaagaccuccaucggccugauaugugucaucgccaguucugggauguuauggauggccgaaguuccacuacaauggauugcaagcgcuaucgugcuggaguuuuucaugaugguacuccuuauuccugagccggaaaagcagcgcaccccccaggauaaucaacuggccuacguggucaucggaauauugacacuggcggcuaugauugccgcaaacgagaugggccuccuggaaacuacgaaacgagaccuugguauguccaaggagccaggggugguuucaccuaccucuuaucucgauguggaccugcaucccgccagcgcuuggacauuguacgcagucgccacuaccguaaucacaccaaugcugagacacaccauugaaaauaguacugcgaacguguccuuagcugccaucgcaaaccaggccguugugcuaaugggccuggacaaaggauggccuauaagcaagauggaucucggcgucccccuucuggcuuuggggugcuacucucaggugaauccgcugacgcucacagccgcaguccugcuuuuaaucacccauuaugcuauuaucggaccaggccugcaggccaaagcgacuagggaggcccaaaagcggaccgcagcugguauuaugaagaacccuacaguggacgggaucaugacuauagaucucgaccccguuauuuacgauucaaaauuugagaagcaguugggacaggugaugcugcuaguacugugugccgugcagcuccuucugaugcgcaccuccugggcauugugcgaagcucugacacucgccacgggcccaaucaccacucugugggaggguagucccggcaaauucuggaauacaaccaucgccgucagcauggcgaacauuuuuagagggucguauuuagcuggagcaggccuugccuucucuaucaugaaguccguugggacuggaaaaaggggcacagguagccaaggggaaacccugggagagaaguggaagaaaaagcucaaucagcuaucacggaaagaauuugaccuguacaagaaaaguggcauaacggagguggaucgaaccgaggcuaaggaagguuugaaaagaggcgagauuacacaccaugccgucucucgcggguccgcaaagcugcagugguucguggaaaggaacaugguagugccugagggacggguuaucgaccucggcugugggcguggaggcuggagcuauuacugcgccggucuuaagaaagugacugaagucagaggguauaccaagggaggcccgggccacgaggagcccgugccaaugucaacauacggguggaauauugucaaacugaugaguggaaaggauguguuuuacuugccucccgaaaaaugugacacucugcucugcgauaucggugagagcuccccuucuccaaccguugaagagagcaggacaauacgcguauuaaagaugguggagcccuggcugaagaacaaucaguucuguaucaaaguccuuaacccuuauaugccaaccgugauugaacaccuggagcggcuacaacgaaagcauggcgggaugcucguuagaaauccccuguccaggaacucaacucacgaaauguacuggaucucuaauggaacgggcaacauugugaguucggucaauauggugagccgcuugcugcucaaccgguucacaaugacccauagacguccgacuaucgagaaagacguagaucuuggugcugggaccaggcacgugaacgcggaaccugagacaccaaauauggacguuauuggagagcgggucaagcgcaucaaagaagagcacaacuccacguggcauuaugacgaugaaaaucccuacaagaccugggccuaucacggcucuuacgaggugaaggcaacuggcucagcuagcuccaugauaaacgggguggucaaacuguuaacaaagccuugggacguugugccaaugguaacccagauggccaugacugauacaacccccuuuggacagcaacgaguguucaaagaaaaggucgacacaagaacuccgaggccuaugcccgguacccggaaagugauggagauuacggcagaguggcuguggcgcaccuugggcagaaauaagaggccacgacucugcacacgggaagaguuuacuaagaaaguucguaccaacgccgcuaugggggccguguucacagaagagaaucagugggauagugcgaaggcagccgucgaagacgaggaguuuuggaaacugguggauagagaacgcgagcuacauaagcuuggaaaauguggcucuugcguauauaacaugauggguaagagggaaaaaaagcugggggaguucggaaaggcuaaaggcagccgggccaucugguacauguggcucggcgcaagauaccuggaguuugaagcuuugggguuccugaaugaggaccacugguuuucacgcgaaaacuccuauaguggaguugagggugaaggccuccauaagcuuggguacauccugagggauauuagcaaaauaccuggaggcgccauguaugcugacgauacugccgguugggacacccgaaucacggaggacgauuuacacaaugaggaaaagauuauccagcagauggaccccgagcaccggcaacuggcaaacgcgauuuucaaauugacauaccagaauaagguggucaaggugcagagaccaacccccacugggacagugauggauaucauaucuaggaaagaccagcgcggauccggccaagucggcaccuaugggcucaacacuuuuaccaauauggaagcccagcugguucgucagauggagggagaaggugugcuaacaaaggcugaucuugagaacccucaucugcucgagaaaaagaucacgcaguggcuggaagccaaaggcguagagcgguugaagagaauggcaauuucaggggacgauugcguggucaagccaaucgacgauagguucgcuaacgccuuacuggcacucaaugacaugggaaaagugcgcaaggauauuccgcaauggcagcccagcaaaggcuggcacgacuggcagcagguuccuuuuuguucgcaucacuuccacgaacuuaucaugaaggauggucgaaaacugguggucccaugccggccccaagacgagcuaauagggagagccaggauuucucagggagcgggcuggagucugcgcgaaaccgcuugucucggcaaggccuacgcacagaugugguccuugauguauuuccauagacgggaccugaggcuugccagcaacgcuaucugcucagccgugccuguacacuggguuccaacuucccguacaaccuggucuauccaugcacaccaucaauggaugacuacagaggauaugcugaccguguggaaucgagucuggauugaggaaaaccccuggauggaggacaagacgccugugacaaccugggaaaauguuccguaccucgggaaacgcgaggaucagugguguggaagcuuaauaggucugacuaguagagcuaccugggcccagaacaucccaacagcgauucagcaagugcgguccuugaucggcaaugaggaauuucuggacuacaugcccagcaugaagagguuccgcaaagaggaagagucugaaggggcuauuugguga

SEQ ID NO: 15257 - RNA, 9873 nt, Artificial Sequence
  derived and/or modified CDS sequence (opt3) from DENV-3__FJ898440__SS-prME
accagccugugccucaugaugauccuucccgcagcucuggcauuccacuugacauccagggacggcgaaccuaggaugauuguggggaagaacgaacggggaaagucuuuacuguuuaagacugcaucagguauaaauauguguacguuaaucgcgauggaucucggcgaaaugugcgacgauaccgucacauacaaauguccacauauuacugaaguugaaccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccaucacggaggccauccucccagaauauggaacacuuggccuggagugcucuccgcgaaccgguuuggacuucaaugagauggugcuacugacuaugaaaaacaaggcguggaugguacauagacagugguuuuucgaucucccccugccuuggaccagcggggccacaaccgaaacuccaauuuggaauaggaaagagcuucugguuacauuuaagaacgcacacgcuaaaaagcaagaaguggucguguugggcucccaggagggagccaugcacacggcucucaccggcgccacugaaauacaaaauucagggggaacaaguaucuucgcaggucaucugaagugucgguuaaaaauggacaagcuggagcuaaaaggcaugagcuacgccaugugcaccaacacauuuguccucaagaaagaggugucugaaacucagcacgggaccauucugaucaagguugaguacaagggagaagaugcucccuguaaaauaccuuucuccacggaggacggccaagguaaggcgcauaacgggcgucuuauuaccgcaaauccagugguaacuaagaaggaggaacccgucaacaucgaggccgaaccgccuuucggcgagucaaauaucgugauuggaaucggcgauaacgcuuugaaaauuaauugguauaagaaggggagcaguauaggaaaaauguuugaagccacugcacgcggugccagaaggauggcuauccugggcgacaccgccugggauuucgggucuguuggaggcgugcucaacucccuggguaagaugguccaccagauuuuugggagcgcauacacagcgcuuuucucgggcgugucuuggguaaugaaaaucggaaucggcgugcuguugacuuggauugggcucaauuccaagaacaccucaaugaguuuuagcugcauagcuaucggaauuaucacgcuguauuuaggcgccguuguccaggcagacacagguugugugauuaauuggaaagggaaggagcugaagugcggauccggcaucuucgugaccaacgagguccauacuuggacagaacaguacaaauuucaagccgauucucccaagcggcuagcuaccgccauagccggugcuugggagaauggcguuugugggauccgaagcacuacccgcauggaaaaccuccuguggaaacagauugccaaugagcuuaacuauaucuugugggaaaauaacauuaagcugacaguggugguaggagacaucauaggcguccucgagcaggggaaaagaacgcugaccccacagccuauggaguuaaaguacucauggaaaacuuggggaaaggcgaagauugugacagccgaaacccaaaacaguuccuucaucauugauggccccaauacaccagagugccccagcgcuucuagggcauggaacguuugggaaguggaggacuaugguuuuggggucuucacuaccaauaucuggcugaaacuucgggaaguguacacgcaguugugugaccaccgccucaugucagccgcuguuaaggaugagagagccgugcacgcagacaugggauacuggauagagagucagaaaaacggcagcuggaagcuggaaaaagcgucccuaaucgagguaaagacaugcaccuggccuaagucucauacucuguggucgaaugguguccucgaaagcgauaugauuaucccaaaaucccuggccggcccgauuucacagcacaacuauaggcccggguaccauacccaaacagcuggaccuuggcaccuuggcaaguuggagcuggacuuuaauuauugcgaggggacuaccguggugaucacagaaaacuguggaacgcguggcccaaguuuacggaccacuacagucucugguaaacucauacacgaguggugcugucgaagcugcacccugcccccucuuagauacaugggggaagauggauguugguauggcauggagauuaggccaaucuccgaaaaggaggagaauaugguuaaaucacuggugagcgccgguucuggcaagguagacaacuucacuauggggguguugugccucgcaauccuguuugaagaggucaugcgcggaaaguucggcaaaaagcauaugauugcugggguguucuuuacauucguucuacugcucuccggacagaucaccuggcgggauauggcccacacgcugauuaugauaggcaguaaugcaagcgacagaauggguaugggggugacuuaccuugccuugaucgcuaccuuuaaaauucagcccuuccuggcguuaggauuuuuccucaggaagcugacaucucgcgaaaaccuucugcuaggcgucggccucgccauggcaaccacucugcaauugccggaggauaucgaacagauggcuaaugggauugcccugggauuaauggcccucaaacugaucacacaguuugagaccuaucagcuuuggacagcucugauauccuugacuuguucaaacaccaucuucacgcucacaguggcauggcgaaccgccacucugauucuagcggguguuagucugcuuccugugugccaaagcucguccaugcggaagaccgacuggcucccaaugacagucgcugccaugggcguacagccccugccuuuguuuaucuucucucugaaggauacuuuaaaacguagaagcuggccccucaaugagggggugauggcaguuggacuggugucaauucuugccaguucccuguugaggaacgacgucccaauggcuggcccucucguggccggugggcugcuaaucgccuguuacguaauaaccggaacgucugcggaucugacaguggaaaaggcugccgacgucaccugggaggaagaggcagaacagacuggcguuagccauaaccuuaugauuacaguggacgaugacggcaccaugcgcaucaaagaugacgagacugagaauauccucacagugcuguugaagaccgccuuacugauugucuccgggauauuucccuacucaaucccagcuacgcuccugguguggcacacuuggcagaaacaaacccagcggagcggaguucuuugggauguaccgaguccucccgaaacacagaaggccgagcuggaagaggguguguauagaauuaaacagcaaggcaucuucgggaagacccaggucggagugggcguucagaaggaggguguguuucauacaauguggcacgucacuagaggggcaguguugaccuacaacggaaaacgacuagaaccaaauugggcuucuguaaagaaagaccugauuuccuauggcggcggguggcgccucagcgcccaauggcagaagggagaggaaguccaggugaucgcgguugagcccgguaaaaacccuaagaauuuccagacgaugccaggcacauuccaaacuaccacaggggaaauaggagccaucgcacuggauuuuaagcccggcaccucggguucaccuauuaucaaccgggaggggaaaguggucggacuuuacggcaauggcgugguuacuaagaacgggggauaugugucugguauugcucagaccaaugccgagccggacggcccaacacccgaauuagaggaagagauguucaaaaagagaaaccugacgaucauggaucuccacccugggaguggaaaaacuaggaaguacuugccagcuauaguccgugaagcaauuaagcgccggcugagaacccucauccuggcccccacaagggugguagccgcugagauggaggaagcgcuuaaaggccugccuauccgauaucagaccacugcaacaaaguccgagcauaccggucgggaaauuguggacuugaugugccacgccacguuuacuaugcgccuacugagcccgguuagaguccccaauuacaaccucaucauaauggaugaggcucauuucacagacccagccucuauugcagccaggggguacaucagcacccgggugggaaugggcgaagcugcggccauuuuuaugaccgcaacuccucccggcacagcugaugccuucccacaguccaaugcaccuauccaagacgaggagcgagacauacccgaaagaucauggaacagugggaaugaguggauuaccgauuuugccggaaaaacagugugguucgucccaagcaucaaggcugguaacgacaucgccaacuguuuacgcaaaaauggcaagaagguaauucagcugucuaggaaaacuuuugauacggaauaucagaagaccaaacuuaacgacugggauuucgugguuacaacugacaucuccgagaugggggcgaauuuuaaggcagaucgugugauugacccgcggagaugccugaaaccugucauacucaccgauggacccgagagggugaucuuggccggcccaaugcccguuacagcugccucagcugcacagcgccgagguagaguggggcggaacccucaaaaggaaaaugaccaguacauuuucaccggccagccacugaacaaugaugaggaccacgcccauuggacugaagcuaagaugcuccuggacaacaucaauacgcccgagggaaucauuccugcccuuuucgaaccggagagggagaaaagugcagcgauagauggcgaauaucgccuaaagggggagagccguaaaaccuuugucgaacugaugagacggggagacuugccagugugguuagcccacaagguagcuuccgaggguaucaaauacacagauaggaaguggugcuucgacggccagcgcaacaaucaaauucuggaagagaacauggauguggagaucuggacuaaagaaggggagaagaagaaacuccgacccagauggcuggacgcccggaccuauucugauccucuugcacugaaggaauuuaaagacuucgcugccggaaggaagucgauugcacucgauuugguuacagagaucggccgcguccccagccaccuggcccauagaaccaggaaugcucuagacaaccuggugaugcuccacacuucagaacauggugggcgggcguaccgucacgccguggaggagcuuccagaaacaauggagacgcuguuauugcugggccucaugauacugcuuaccggaggcgcaaugcuguuucucaucuccgggaaaggaauugguaagacaaguaucggcuugauuugugucaucgcuucuagcgggaugcuguggauggccgaaauaccuuuacaguggauugccuccgcaaucguucuagaguucuuuaugauggugcugcucauucccgagccagaaaagcagcgcacaccucaagauaaucagcuugcuuauguagugaucggaauacugaccuuggccgcgaucauugcugccaacgagaugggccugcucgaaaccacuaaaaaggaccuggguaugucaaaagagccgggggucgugucucccacaagcuaccuugauguugaccuccacccagcaagugccuggacgcuguacgcuguggcaaccacagucaucacuccuauguugcgacauaccauugaaaauuccacagccaacguaagccuggcggcuaucgccaaccaggcagugguuuuaaugggccuagacaagggauggcccauaucuaaaauggaucugggcgugccacuccuugcccuggggugcuauucacaggucaauccuuugacccugacugcugccgugcuccugcuuauuacgcacuacgcaaucaucggacccggcuuacaagcuaaggccacaagagaggcgcagaagaggaccgccgcagguauuaugaaaaacccgacugucgacgggaucaugaccauagaucuggacccagugauuuaugauuccaaguucgagaaacagcucggacagguuauguugcuggugcuaugugcuguacaacugcuccuuaugcggacaaguugggcccugugcgaagcauugacucuggcuaccggcccuaucacaacgcucugggaggguagccccggcaaguuuuggaauaccacuauugccgugucgauggccaacaucuuccgcgggucuuaccuggcgggagcuggcuuagcauuuuccauaaugaaaagcgucgggacaggaaagagaggcaccgguucacagggggaaacucuuggagagaaguggaaaaagaaacugaaucagcucaguaggaaggaguucgaccuauauaaaaagucuggcaucacagagguugaucggaccgaggccaaagaaggucugaagcgaggcgagauuacgcaucacgcuguguccagagggagcgccaaguugcagugguuugucgaacgcaacauggugaucccagagggaaggguaauugaccugggcugugggcggggaggcuggucauacuauugcgcaggucucaaaaaggugaccgaaguucguggguacacaaaaggaggccccggccaugaggagccugugccgaugaguacuuacggguggaauaucgucaaacuuaugagcggaaaagauguguucuaucugcccccagaaaagugugacaccuugcugugcgauauuggugaguccucuccuagccccacagucgaagaguccagaacuaucagggugcucaagaugguugagccuuggcuaaagaacaaucaauucuguauaaagguacugaacccauacaugcccaccgugauugaacaccuugagcgccugcagcggaaacacggcgggaugcuaguccgaaauccucucucaagaaacucuacacaugaaauguauuggaucaguaauggaaccggcaacaucguggccucgguuaauauggugagcaggcuguugcugaaccgcuuuacuaugacgcaccggagaccaacaauugagaaggacgucgaucucggugcugggacccgucaugugaacgcggaacccgagacuccgaauauggacguaauaggagagaggaucaaacggauuaaggaagaacacaacuccaccuggcacuacgacgaugaaaauccuuauaagacaugggccuaccauggcucuuaugaggugaaagcaacgggcucagcuagcuccaugaucaacgggguugucaaacuucugaccaaaccaugggacguggugcccauggucacucagauggccaugacagauaccacuccuuucggacaacagcgcguuuuuaaggaaaaaguggacacacgaaccccaagaaguaugcccgguacaaggcggguaaugggcauuacugcagagugguuauggcgcacccuggggagaaauaagaagccgagguugugcacgcgagaggaguucaccaaaaaggugcggacaaacgccgcuaugggagccgucuuuacugaggaaaaucagugggauucugcgaaagcagccguggaggacgaagauuucuggaagcucguugaccgugagagagagcugcacaaacuaggcaagugugguagcugcguguacaacaugauggggaaacgcgaaaagaaacuuggagaguuuggcaaagcuaagggcucaagggccaucugguacauguggcugggggcacgguaucucgaguucgaggcucugggauuuuugaaugaggaucauugguucuccagagaaaacaguuacagcggugucgagggcgaagggcugcacaaacucggauauauacuucgcgacaucucuaagauuccuggcggugccauguacgcugaugacaccgccgggugggacacaaggaucacugaggaugaccugcauaaugaagagaaaauuacccagcaaaugaaccccgagcaccgacaguuagcaaaugcgaucuuuaagcugacguaucagaacaaggugguaaaaguucagcggccaacaccuaccggaacugugauggauauaauuuccagaaaggaccaaaggggcucaggccaggucgggacauacggauugaauaccuucacuaacauggaagcccagcucauccgccagauggagggugaaggcgugcugagcaaagcugaucuagagaacccccaccuuccagaaaagaaaaucacccaauggcuggagacaaaggggguggagcgucucaagcggauggccauuucgggagacgauugcgucguuaaacccauagacgauagauuugcaaaugcucuguuggccuuaaacgacaugggcaaggugaggaaagauaucccucaguggcagccaucuaaggguuggcaugacuggcagcaaguaccguucuguagucaccauuuccacgaacugauuaugaaagaugggcgcaagcucgugguccccugccgaccucaggacgagcuuaucggacgggcaagaauuucccagggcgccggcuggagccugagggaaacggcgugucuagggaaggcuuaugcccaaauguggucacugauguacuuucaccgcagagaccuccgguuggcauccaaugccaucugcucugcugugccaguucauugggugcccaccagcaggacuacauggaguauacacgcccaucaccaguggaugaccacugaggauaugcugacagucuggaaccguguguggaucgaagacaauccuuggauggaggauaaaaccccaguaacgacaugggagaacguucccuaccuuggaaagcgagaagaccaguggugugguucccugauuggccucaccagccgcgcaacuugggcucagaauaucccuaccgccauucaacaggugagaucuuuaaucgggaacgaggaguuccuggauuauaugccgucaaugaaacgguuuaggaaggaggaggaaagugagggagcgauuugguga

SEQ ID NO: 15258 - RNA, 9873 nt, Artificial Sequence
  derived and/or modified CDS sequence (opt3) from DENV-3__FJ898441__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaaauggugcaguaugaaaaucugaaguacacagucauuaucacugugcauaccggugaccagcaccagguuggcaacgagacacaaggggugaccgcagaaauuacuccucaggcuuccaucacggaggccauccucccagaauauggaacacuuggccuggagugcucuccgcgaaccgguuuggacuucaaugagaugauucuacugacuaugaaaaacaaggcguggaugguccauagacagugguuuuucgaucucccccugccuuggaccagcggggccacaaccgaaacuccaacauggaauaggaaagagcuucuggugacguuuaagaacgcacacgcuaaaaagcaagaaguaguuguguugggcucccaggagggagccaugcacaccgcucucacuggcgccacagaaauacagaauucagggggaaccacaaucuucgcaggucaucugaagugucgguuaaaaauggacaagcuggagcuaaaaggcaugaguuacgccaugugcacuaacaccuuuguccucaagaaagaggugagcgaaacgcagcacgggaccauucugaucaaggucgaguacaagggagaagaugcucccuguaaaauaccuuucucuacagaggacggccaagguaaggcgcauaacgggcgucuuauuacugcaaauccagugguuaccaaaaaggaggaacccgugaacaucgaggccgaaccgccuuucggcgaguccaauaucguaauuggaaucggcgauaacgcuuugaaaauuaauugguauaagaaggggucaagcauaggaaaaauguuugaagccacagcacgcggugccagaaggauggcuauccugggcgacacugccugggauuucgggagugucggaggcgugcucaacucucuggguaagaugguucaccagguguuuggguccgcauacaccgcgcuuuucagcggcgucucgugggugaugaaaauuggaaucggcguacuguugacguggaucgggcucaauucuaagaacacauccaugucauuuaguugcauugcuauaggaaucauuacccuguauuuaggcgccgugguucaggcagacacugguugugucaucaauuggaaagggaaggagcugaagugcggaagcggcauuuucgugacaaacgaggugcauaccuggacugaacaguacaaauuucaagccgauucccccaagcggcuagcuaccgccaucgcaggugcuugggagaauggcgucugugggauacgaucuacaacgcgcauggaaaaccuccuguggaaacagaucgccaaugagcuuaacuauauuuugugggaaaauaacaucaagcugaccguuguggugggagacauuaucggcguacucgagcaggggaaaagaacucugacaccacagccuauggaguuaaaguacagcuggaaaaccuggggaaaggcgaagauagucacagccgaaacucaaaacucaaguuucauuaucgauggccccaauaccccagagugccccuccgcuagcagggcauggaacgugugggaaguugaggacuaugguuuugggguguucacgacaaauauuuggcugaaacuucgggaagucuacacccaguugugugaccaccgccucaugucugccgcugugaaggaugagagagccguucacgcagacaugggauacuggaucgagucacagaaaaacggcaguuggaagcuggaaaaagcgagccuaauagaggugaagacuugcaccuggccuaagucccauacacuguggucuaaugguguacucgaaucggauaugaucauuccaaaaagccuggccggcccgaucucccagcacaacuauaggcccggguaccauacucaaaccgcuggaccuuggcaccuuggcaaguuggagcuggacuuuaauuauugcgaggggacaacggucgugauuaccgaaaacuguggaacucguggcccaucauuacggacaaccacugugagugguaaacucauccacgaguggugcugucgaucuugcacacugcccccucuuagauacaugggggaagauggauguugguauggcauggagauaaggccaauuagcgaaaaggaggagaauauggucaaaucccugguuucagccgguagcggcaagguggacaacuucaccauggggguauugugccucgcaauccuguuugaagaggugaugcgcggaaaguucggcaaaaagcauaugaucgucgggguguucuuuacguucguucuacugcucucuggacagauuacuuggcgggauauggcucacacccugaucaugauuggcuccaaugccagugacagaauggguaugggggugacauaccuugcauugauagccaccuuuaaaauccagcccuuccuggcuuuaggauuuuuccucaggaagcugacuagccgcgaaaaccuucugcuaggcgucggccucgcgauggccacaacccugcaauugccggcagauauugagcagauggcuaaugggaucgcccugggauuaauggcccucaaacugauuacacaguuugaaacuuaucagcuuuggaccgcucugaucucuuugacguguuccaacacaauauucacccucacuguggcauggcgaaccgccacacugauccuagcggguguuucacugcuuccugugugccaaaguagcucgaugcggaagacugacuggcucccaaugaccgucgcugccaugggcguacagccccugccuuuguuuauuuucucccugaaggauacguuaaaacguagaucuuggccccucaaugagggggugauggcaguuggacuggugagcauccuugccucaagucuguugaggaacgacgucccaauggcuggcccucucguggcaggugggcugcuaauugccuguuacguaaucacaggaaccuccgcggaucugacuguggagaaggcugccgacgucacaugggaagaggaagcagagcagaccggcguuucucauaaccuuaugauaacuguggacgaugacggcacaaugcgcauuaaagaugacgaaaccgagaauauccucacggugcuguugaagacugccuuacugaucgucagcgggauuuuucccuacuccauaccagcuacccuccugguguggcacacauggcagaaacaaacccagcggucaggaguucuuugggauguaccgagcccucccgagacacagaaggccgaacuggaggaagguguguauagaaucaaacagcaaggcauuuucgggaagacucaggucggagugggcguucagaaggaggguguguuucauaccauguggcacgucacgaggggggcaguguugacauacaacggaaaacgacuagagccaaauugggcuaguguaaagaaagaccugaucucuuauggcggcggguggcgccucuccgcccaauggcagaagggagaagagguccaggugauugcgguugaacccgguaaaaacccuaagaauuuccagacuaugccaggcaccuuccaaacaaccacuggggagaucggagccauagcacuggauuuuaagcccggcaccagcgguucgccuaucauuaaccgggaagggaaaguggucggacuuuacggcaauggcgugguuacaaagaacgggggauaugugucagguaucgcucagacgaaugccgagccggacggcccaacucccgaguuagaagaggaaauguucaaaaagagaaaccugaccauuauggaucuccacccugggucuggaaaaacaaggaaguacuugccagcuaucguccgugaggcaauaaagcgccggcugagaacccucauucuggcccccacuagggugguagccgcugaaauggaggaggcgcuuaaaggccugccuauccgauaucagacaaccgcaacgaagagugaacauacuggucgggagaucguggacuugaugugccacgccacauuuaccaugcgccuacuguccccgguuagaguccccaauuacaaccucauuaucauggaugaagcucauuucaccgacccagccagcauagcagccaggggguacauuucuacucgggugggaaugggcgaggcugcggccaucuuuaugacagcaaccccucccggcacagcugaugccuucccacagagcaaugcaccuauucaagacgaagagcgagacauccccgagagauccuggaacucagggaaugaauggauaacugauuuugccggaaaaacggugugguucgucccaaguauuaaggcugguaacgacaucgccaacuguuuacgcaaaaauggcaagaagguaauccagcugagcaggaaaaccuuugauacagaguaucagaagacuaaacuuaacgacugggauuucgugguuaccacagacauuucugaaaugggggcgaauuuuaaggcagaucgugugaucgacccgcggagaugccugaaaccugucauucucaccgauggacccgagagggugauauuggccggcccaaugcccguuacugcugccuccgcugcacagcgccgagguagaguggggcggaacccucaaaaggagaaugaccaguacaucuucacgggccagccacugaacaaugaugaagaccacgcccauuggaccgaggcuaagaugcuccuggacaacauuaauacacccgaaggaaucaucccugcccuuuucgagccggaaagggagaaaucagcagcgauugauggcgaguaucgccuaaagggggaaagucguaaaacuuuugucgagcugaugagacggggagacuugccagugugguuagcccacaagguagcuagcgaagguauaaaauacaccgauaggaaguggugcuucgacggccagcgcaacaaucaaauccuggaggaaaacauggauguggagauuuggacaaaagagggggaaaagaagaaacuccgacccagauggcuggacgcccggaccuauuccgauccucuugcacugaaggaguuuaaagacuucgcugccggaaggaagucuaucgcacucgauuugguuacugaaauuggccgcguccccucgcaccuggcccauagaacaaggaaugcucuagacaaccuggugaugcuccacacgagcgagcauggugggcgggcguaccgucacgccguggaagagcuuccagagaccauggaaacucuguuauugcugggccucaugauccugcuuacaggaggcgcaaugcuguuucucauaucagggaaaggaaucgguaagaccuccauuggcuugaucugugucauugcuaguucugggaugcuguggauggccgagaucccuuuacaguggauagccagcgcaauuguucuagaauucuuuaugauggugcugcucauccccgagccagagaagcagcgcaccccucaagauaaucagcuugcuuauguagugauuggaauccugacauuggccgcgauaaucgcugccaacgaaaugggccugcucgagacuacgaaaaaggaccuggguauguccaaagaaccgggggucgugucaucuaccagcuaccuugauguugaccuccaccccgcaagugccuggacacuguacgcuguggcaacuaccgucauuacaccaauguugcgacauaccaucgagaauuccacugccaacguaagccuggcggcuauugccaaccaggcagugguuuuaaugggccuagacaagggauggccuaucucuaaaauggaucugggcgugccccuccuugcccuggggugcuauucacaggucaauccauugacgcugacagcugccgugcuccugcuuauaacccacuacgcaauuaucggaccuggcuuacaagcuaaggccacuagagaagcgcagaagaggaccgccgcagguaucaugaaaaaccccacagucgacgggauuaugacuaucgaucuggacccggugauauaugauuccaaguucgagaaacagcucggacagguuauguugcuggugcuaugugcuguacaacugcuccuuaugcggaccaguugggcccugugcgaggcauugacacuggcuacgggcccaauuaccacucucugggaagguagcccuggcaaguuuuggaauacaaccaucgccgugucgauggccaacauuuuccgcgggucuuaccuggcgggagcuggcuuagcauuuuccaucaugaaaagcgucgggacuggaaagagaggcacagguucacagggggagacccuuggagaaaaguggaaaaagaaacugaaucagcucaguaggaaggaguucgaccuauauaaaaagucuggcauaacggaaguugaucggaccgaggccaaagagggucugaagcgaggcgaaaucacacaucacgcuguguccagagggagcgccaaguugcagugguuugucgagcgcaacauggugauucccgaaggaaggguaaucgaccugggcugugggcggggaggcuggucauacuauugcgcaggucucaaaaaggugacugagguucguggguacaccaaaggaggcccaggccaugaagagcccgugccuaugaguacauacggguggaauauugucaagcuuaugacuggaaaagauguguucuaucugccgcccgagaagugugacaccuugcugugcgauaucggugaaagcuccccaucuccuacagucgaggaaagcagaaccauuagggugcucaagaugguugagcccugguuaaaaaacaaucaauucuguaucaagguacugaacccuuacaugccaacugugauagagcaccuugaacgccugcagcggaaacacggcgggaugcuaguccgaaauccccucuccagaaacucaacgcaugagauguauuggauuucuaauggaacaggcaacaucguggccaguguuaauauggugucgaggcuguugcugaaccgcuuuaccaugacucaccggagaccuaccaucgaacgugacgucgaucucggugcugggacaaggcaugugaacgcggagccagaaacgcccaauauggacguaauuggagagcggauaaagcgcaucaaagaggaacacaacagcaccuggcacuacgacgaugagaauccguauaagacuugggccuaccauggcuccuaugaagugaaggcaacaggcucugcuucaagcaugauuaacgggguugucaaacuucugaccaagccuugggacguggugccaauggucacucagauggccaugacagauaccacacccuucggacaacagcgaguuuuuaaagagaagguggacacuagaaccccuagguccaugccagguacgcggaaaguaaugggcaucaccgcagaaugguuauggcgcacacuggggagaaauaagaagcccagguugugcacucgagaggaguucaccaaaaaggugcggacaaacgccgcuaugggagccgucuuuacugaagagaaucagugggauagugcgaaagcagccguggaagacgaggauuucuggaagcucguugaccgugaaagagagcugcacaaacuaggcaagugugguucuugcguguacaacaugauggggaaacgcgagaagaagcuuggagaauuuggcaaagcuaagggcagcagggccauuugguacauguggcugggggcacgguaucucgaguucgaagcucugggauuuuugaaugaggaucauugguucucaagagagaacuccuacaguggugucgaaggcgaggggcugcacaaacucggauauauccuucgcgacauaagcaccaucccgggcggugccauguacgcugaugacacggccgggugggacacaaggauuaccgaagaugaccugcauaaugaggaaaagaucacucagcaaauggauccugagcaccgacaguuagcaaacgcgauuuuuaaacugacauaucagaauaaggugguaaagguucagcggcccaccccaacuggaaccgugauggacaucauaucuagaaaagaucaaaggggcuccggccaggucgggacauacggauugaacacguucaccaauauggaggcccagcucauucgccagauggaaggugagggcgugcugucaaaggcugaccuagaaaacccucaccuucccgagaaaaagaucacucaauggcuggaaacaaaagggguggagcgucucaagcggauggccaucagcggagaugacugcgucguuaagccaauugaugacagauuugcaaacgcucuguuggccuuaaaugauaugggcaaagugaggaaggacauaccccaguggcagccuucgaaagguuggcaugauuggcagcaaguaccauucuguucucaccauuuccacgagcugaucaugaaggacgggcgcaaacucguggucccgugccgaccccaggacgaacuuauuggacgggcaagaaucagucagggcgccggcuggucccugagggagaccgcgugucuagggaaggcuuaugcccaaauguggagccugauguacuuucaccgcagagaucuccgguuggcaucaaacgccauuugcuccgcugugccuguucauugggugccaacuucuaggacaaccuggagcauccacgcccaucaccaguggaugacgacagaagacaugcugaccgucuggaaucguguguggauagaggauaaccccuggauggaagacaagacuccuguaaccacaugggagaauguuccauaccuuggaaaacgagaggaucaguggugugguagucugaucggccucacuucccgcgcaaccugggcucagaacauucccacagccauccaacaggugagaagcuuaauugggaaugaagaguuccuggacuauaugccuucuaugaagcgguuuaggaaagaagaggagucagaaggagcgaucugguga

SEQ ID NO: 15259 - RNA, 9873 nt, Artificial Sequence
  derived and/or modified CDS sequence (opt3) from DENV-3__FJ898442__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaaauggugcaguaugaaaaucugaaguacacagucauuaucacugugcauaccggugaccagcaccagguuggcaacgagacacaaggggugaccgcagaaauuacuccucaggcuuccaucacggaggccauccucccagaauauggaacacuuggccuggagugcucuccgcgaaccgguuuggacuucaaugagaugauucuacugacuaugaaaaacaaggcguggaugguccauagacagugguuuuucgaucucccccugccuuggaccagcggggccacaaccgaaacuccaacauggaauaggaaagagcuucuggugacguuuaagaacgcacacgcuaaaaagcaagaaguaguuguguugggcucccaggagggagccaugcacaccgcucucacuggcgccacagaaauacagaauucagggggaaccacaaucuucgcaggucaucugaagugucgguuaaaaauggacaagcuggagcuaaaaggcaugaguuacgccaugugcacuaacaccuuuguccucaagaaagaggugagcgaaacgcagcacgggaccauucugaucaaggucgaguacaagggagaagaugcucccuguaaaauaccuuucucuacagaggacggccaagguaaggcgcauaacgggcgucuuauuacugcaaauccagugguuaccaaaaaggaggaacccgugaacaucgaggccgaaccgccuuucggcgaguccaauaucguaauuggaaucggcgauaacgcuuugaaaauuaauugguauaagaaggggucaagcauaggaaaaauguuugaagccacagcacgcggugccagaaggauggcuauccugggcgacacugccugggauuucgggagugucggaggcgugcucaacucucuggguaagaugguucaccagguguuuggguccgcauacaccgcgcuuuucagcggcgucucgugggugaugaaaauuggaaucggcguacuguugacguggaucgggcucaauucuaagaacacauccaugucauuuaguugcauugcuauaggaaucauuacccuguauuuaggcgccgugguucaggcagacacugguugugucaucaauuggaaagggaaggagcugaagugcggaagcggcauuuucgugacaaacgaggugcauaccuggacugaacaguacaaauuucaagccgauucccccaagcggcuagcuaccgccaucgcaggugcuugggagaauggcgucugugggauacgaucuacaacgcgcauggaaaaccuccuguggaaacagaucgccaaugagcuuaacuauauuuugugggaaaauaacaucaagcugaccguuguggugggagacauuaucggcguacucgagcaggggaaaagaacucugacaccacagccuauggaguuaaaguacagcuggaaaaccuggggaaaggcgaagauagucacagccgaaacucaaaacucaaguuucauuaucgauggccccaauaccccagagugccccuccgcuagcagggcauggaacgugugggaaguugaggacuaugguuuugggguguucacgacaaauauuuggcugaaacuucgggaagucuacacccaguugugugaccaccgccucaugucugccgcugugaaggaugagagagccguucacgcagacaugggauacuggaucgagucacagaaaaacggcaguuggaagcuggaaaaagcgagccuaauagaggugaagacuugcaccuggccuaagucccauacacuguggucuaaugguguacucgaaucggauaugaucauuccaaggagccuggccggcccgaucucccagcacaacuaucgucccggguaccauacucaaaccgcuggaccuuggcaccuuggcaaauuggagcuggacuuuaauuauugcgaggggacaacggucgugauuaccgaaaacuguggaacucggggcccaucauuacgaacaaccacugugagugguaagcucauccacgaguggugcuguagaucuugcacacugcccccucuuagguacaugggggaagauggauguugguauggcauggagauacgcccaauuagcgaaaaagaggagaauauggucaagucccugguuucagccgguagcggcaaaguggacaacuucaccauggggguauugugccucgcaauccuguuugaagaggugaugcggggaaaguucggcaagaaacauaugaucgcuggggucuucuuuacguucgugcuacugcucucuggacagauuacuuggagagauauggcccacacccugaucaugauuggcuccaaugcaagugacaggauggguauggggguuacauaccuugccuugauagcuaccuuuaagauccagcccuuccuggcguuaggauuuuuccuccgcaaacugacuagccgagaaaaccuucugcuaggcgugggccucgccauggcaacaacccugcaauugccggcugauauugagcagauggccaaugggaucgcccugggauuaauggcucucaagcugauuacacaguuugaaacuuaucagcuuuggaccgcacugaucucuuugacguguuccaacacaauauucacccucacugucgccuggcggaccgcgacacugauccuagcuggugugucacugcuuccuguuugccaaaguagcucgaugcguaaaacugacuggcucccaaugaccguggccgcaaugggcguccagccccugccuuuguuuauuuucucccugaaggauacguuaaagagaaggucuuggccccucaaugaggggguaauggccgugggacugguuagcauccuugcuucaagucuguugcgcaacgacgugccaauggcaggcccucucgucgccggugggcugcuaauugcguguuacgugaucacaggaaccuccgcugaucugacuguagagaaagccgcagacgugacaugggaagaggaagccgagcagaccggcgucucucauaaccuuaugauaacuguugacgaugacggcacaaugcggauuaaggaugacgaaaccgagaauauccucacggugcuguugaaaacugcuuuacugaucgugagcgggauuuuucccuacuccauaccagccacccuccuggucuggcacacauggcagaagcaaacccagagaucaggagugcuuugggauguuccgagcccucccgagacacagaaagcagaacuggaggaagguguauauaggaucaagcagcaaggcauuuucgggaaaacucaggugggagucggcgugcagaaggaggguguuuuucauaccauguggcacgugacgcgaggggcugucuugacauacaacggaaagcgccuagagccaaauugggccagugugaaaaaggaccugaucucuuauggcggcggguggcggcucuccgcgcaauggcagaaaggagaagagguacaggucauugccguggaacccgguaagaacccuaaaaauuuccagacuaugccaggcaccuuccaaacaaccacuggggagaucggagcaauagcucuggauuuuaagcccggcaccagcgguucgccuaucauuaacagagaagggaagguugugggacuuuacggcaauggcgucgugacaaaaaacgggggauauguuucagguaucgcccagacgaaugcugagccggacggcccaacucccgaguuagaagaggaaauguucaagaaaaggaaccugaccauuauggaucuccacccugggucuggaaagacacguaaauacuugccagcaaucgugcgcgaggccauaaagcggagacugaggacccucauucuggcccccacucgagucguggcugcggaaauggaggaggcacuuaagggccugccuauccgguaucagacaaccgccacgaaaagugaacauacuggucgcgagaucguagacuugaugugccacgcuacauuuaccaugagacuacuguccccggugaggguucccaauuacaaccucauuaucauggaugaagcccauuucaccgacccagcaagcauagccgcucggggguacauuucuacucgagucggaaugggcgaggcggccgcaaucuuuaugacagcuaccccucccggcacagccgaugcauucccacagagcaaugccccuauucaagacgaagagagagacauccccgagcgcuccuggaacucagggaaugaauggauaacugauuuugcuggaaagacggugugguucgugccaaguauuaaagccgguaacgacaucgcgaacuguuuaaggaagaauggcaaaaaggucauccagcugagccguaagaccuuugauacagaguaucagaaaacuaagcuuaacgacugggauuucguagugaccacagacauuucugaaaugggggcaaauuuuaaagccgaucggguuaucgacccgagaaggugccugaagccugugauucucaccgauggacccgagcgcgucauauuggcuggcccaaugcccgugacugccgcuuccgcagcccagcgaagaggucggguugggaggaacccucaaaaagagaaugaccaguacaucuucacgggccagccacugaacaaugaugaagaccacgcucauuggaccgaggccaagaugcuccuggacaacauuaauacacccgaaggaaucaucccugcacuuuucgagccggaacgcgagaagucagcggccauugauggcgaguaucgucuaaaaggggaaaguagaaagacuuuuguggagcugaugcggaggggagacuugccagucugguuagcucacaaaguggccagcgaagguauaaaguacaccgaucgcaaauggugcuucgacggccagcgaaacaaucaaauccuggaggaaaacauggauguagagauuuggacaaaggagggggaaaaaaagaagcucagaccccgguggcuggacgcaaggaccuauuccgauccucuugcucugaaagaguuuaaggacuucgccgcaggacgcaaaucuaucgcccucgauuuggugacugaaauuggcagaguucccucgcaccuggcucauaggacacggaaugcgcuagacaaccuggucaugcuccacacgagcgagcauggugggcgugccuaccgccacgcaguggaagagcuuccagagaccauggaaacucuguuauugcugggccucaugauccugcuuacaggaggcgcuaugcuguuucucauaucagggaagggaaucgguaaaaccuccauuggcuugaucugugugauugccaguucugggaugcuguggauggccgagaucccuuuacaguggauagcaagcgcuauuguccuagaauucuuuaugaugguucugcucauccccgagccagagaagcagcgaaccccucaagauaaucagcuugccuaugugguaauuggaauccugacauuggcggcuauaaucgccgcaaacgaaaugggccugcucgagacuacgaagaaagaccuggguauguccaaggaaccggggguggucucaucuaccagcuaccuugauguggaccuccaccccgccagugcuuggacacuguacgcaguugccacuaccgugauuacaccaauguugagacauaccaucgagaauuccacugcgaacgucagccuggcugccauugcaaaccaggccguaguguuaaugggccuagacaaaggauggccuaucucuaagauggaucugggcguuccccuccuugcucuggggugcuauucacaggugaauccauugacgcugacagccgcaguccuccugcuuauaacccacuacgcuauuaucggaccuggcuuacaagccaaagcgacuagggaagcccagaagcggaccgcagcugguaucaugaagaaccccacaguggacgggauuaugacuaucgaucuggacccggucauauaugauuccaaauucgagaagcagcucggacaggugauguugcugguucuaugugccgugcaacugcuccuuaugcgcaccaguugggcacugugcgaggcuuugacacuggccacgggcccaauuaccacucucugggaagguagcccuggcaaauuuuggaauacaaccaucgccguaucgauggcgaacauuuucagagggucuuaccuggcuggagcaggcuuagccuuuuccaucaugaagagcguggggacuggaaaaaggggcacagguucacagggggagacccuuggagaaaaguggaagaaaaagcugaaucagcucagucggaaagaguucgaccuauauaagaaaucuggcauaacggaagucgaucgaaccgaggcuaaggagggucugaaaagaggcgaaaucacacaucacgccguuucccgcgggagcgcaaaguugcagugguuuguggagaggaacauggucauucccgaaggacgggugaucgaccugggcugugggcguggaggcuggucauacuauugcgccggucucaagaaaguaacugaggugagaggguacaccaagggaggcccaggccaugaagagcccguuccuaugaguacauacggguggaauauugugaaacuuaugacuggaaaggaugucuucuaucugccgcccgagaaaugugacaccuugcugugcgauaucggugaaagcuccccaucuccuacaguggaggaaagcaggaccauucgcguccucaagaugguggagcccugguuaaagaacaaucaauucuguaucaaaguucugaacccuuacaugccaacuguaauagagcaccuugaacggcugcagcgaaagcacggcgggaugcuagugagaaauccccucuccaggaacucaacgcaugagauguauuggauuucuaauggaacaggcaacaucgucgcuagugugaauaugguuucgcgccuguugcugaaccgguuuaccaugacucacagacguccuaccaucgaaagggacguggaucucggugcggggacacggcaugucaacgccgagccagaaacgcccaauauggacgugauuggagagcgcauaaaacgaaucaaggaggaacacaacagcaccuggcacuacgacgaugagaauccguauaaaacuugggcauaccauggcuccuaugaaguaaaggcuacaggcucugccucaagcaugauuaacggggugguuaagcuucugaccaaaccuugggacgucgugccaauggugacucagauggcaaugacagauaccacacccuucggacaacagagagucuuuaaggagaaaguugacacuaggaccccucgguccaugccagguacgcgcaaggugaugggcaucaccgccgaaugguuauggagaacacuggggaggaauaaaaagccccgauugugcacucgggaggaguucaccaagaaaguacguacaaacgcugccaugggagcgguguuuacugaagagaaucagugggauagugcaaaggccgcugucgaagacgaggaauucuggaaacucguggauagagagcgcgagcugcacaagcuaggcaaaugugguucuugcguuuacaacaugauggggaagagggaaaaaaagcuuggagaguuuggcaaggccaaaggcagccgggcaauuugguacauguggcugggggcuagauaucucgaauucgaggcccugggauuuuugaaugaggaccauugguucucacgcgaaaacuccuacagugguguggagggcgaagggcugcacaagcucggauauauccuuagggauauaagcaccaucccgggcggugcuauguacgccgacgauacggcagggugggacacacgaauuaccgaggacgaucugcauaaugaagagaaaaucacucagcaaauggacccugagcaccggcaguuagcgaacgccauuuuuaagcugacauaucagaauaaagucgugaagguacagagacccaccccaacuggaaccguuauggauaucauaucuaggaaggaccaacgcggcuccggccagguggggacauacggauugaacacguucaccaauauggaagcucagcucauucgucagauggagggugaaggcguccugucaaaagccgaucuagagaacccucaccuucccgaaaagaaaaucacucaauggcuggagacaaaggggguggagcggcucaaaagaauggcaaucagcggagacgauugcguggucaagccaauugacgauagguuugcuaacgcccuguuggcauuaaaugacaugggcaagguucgcaaagauauaccccaguggcagccuucgaaggguuggcaugacuggcagcaagugccauucuguucucaccauuuccacgaacugaucaugaaagaugggcgaaagcucguagugccgugccggccccaggacgagcuuauuggaagagccaggaucagucagggcgcgggcuggucccugcgcgaaaccgcuugucuagggaaagccuaugcacaaauguggagccugauguacuuucacagacgggaccucagguuggccucaaacgcuauuugcuccgccgucccugugcauuggguuccaacuucucguacaaccuggagcauccacgcacaucaccaguggaugacgacagagaauaugcugaccguguggaaccgagucuggauagaagauaaucccuggauggaggacaagacuccugugaccacaugggagaacguaccauaccuuggaaagcgcgaagaucaguggugugguagucugaucggccucacuuccagagcuaccugggcccagaauauucccacagcgauccaacagguucggagcuuaauugggaacgaggaauuccuggacuauaugccuucuaugaaaagguuucgcaaggaggaggaaucagagggagcuaucugguga

SEQ ID NO: 15260 - RNA, 9873 nt, Artificial Sequence
  derived and/or modified CDS sequence (opt3) from DENV-3__FJ882575__SS-prME
accagccugugccucaugaugauccuucccgccacacuggcuuuccacuugacuuccagagacggcgagccuaggaugauuguggggaagaacgaacggggaaaaucuuuacuguuuaagacggcaucagguauaaauauguguacccuaaucgccauggaucucggcgagaugugcgacgauacagucacuuacaaauguccacauauuaccgaaguugagccggaagacaucgauugcugguguaaccugacaaguaccugggugacuuaugggacaugcaaucaggcgggagagcaccgccgagacaagcguagcguagcucuugccccccaugugggcaugggucuggauaccagaacgcaaacuuggauguccgcagagggggccuggaggcaggucgaaaaaguggagaccugggcuuugcggcacccuggauucacaauucucgcacuguuucuggcccauuacaucggcacuucucucacccagaagguugugauauucaucuuacugaugcuugucacaccaucgaugaccaugcgcugugugggcguagggaacagagacuuuguugaaggauugucaggugcuacguggguggaugucgugcuggagcacggcgggugcgugacuacaauggccaagaauaaacccacccuagacauugagcuccagaagacugaagcgacacaacuggcaacccuuaggaaacuguguaucgagggaaagauuacgaacaucaccacagauagccggugcccuacucagggcgaagccgucuugccagaggaacaggaccagaauuauguuuguaaacacaccuacguggaucgcgguugggggaacggaugcggccucuucggcaaggggagucugguaacaugcgcuaaguuucaauguuuagagcccauagagggaaaagugguccaguaugaaaaucugaaguacacugugauuaucaccguucauacaggugaccagcaccaggugggcaacgagacccaaggggucacugccgaaauuacgccucaggcauccacaaccgaggcuauccucccagaauauggaacucuuggccuggagugcucuccgcgaaccgguuuggacuucaaugagaugauccuacugacaaugaaaaacaaggccuggauggugcauagacagugguuuuucgaucucccccugccuuggaccagcggggcgacuacagaaacgccaaccuggaauaggaaagagcuucugguaacuuuuaagaacgcccacgcaaaaaagcaagaaguuguggucuugggcucccaggagggagcuaugcacacagcccucaccggcgcuacagaaauucagaauucagggggaacuaguauauucgccggucaucugaagugucgguuaaaaauggacaagcuggagcuaaaaggcaugagcuacgcaaugugcaccaacacguuugugcucaagaaagaggucucugaaacccagcacgggacaauccugauuaagguggaguacaagggagaagaugcccccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcauccucaacucccuggguaagaugguucaccagauuuuugggagcgccuacacggcacuuuucucgggcgugucuugggucaugaaaaucggaaucggcgugcuguugacauggauugggcucaauuccaagaacaccucaaugaguuuuagcugcauagcgaucggaauuaucacucuguauuuaggcgcuguagugcaggccgacauggguuguguuauuaauuggaaagggaaggagcugaagugcggauccggcaucuucgucacaaacgaggugcauaccuggacugaacaguacaaauuucaagcagauucucccaagcggcuagccaccgcuauagccggugcaugggagaauggcgugugugggauccgaagcacaacgcgcauggaaaaccuccuguggaaacagauugcuaaugagcuuaacuauaucuugugggaaaauaacauuaagcugaccgucguugugggagacacuaucggcgugcucgagcaggggaaaagaacacugaccccacagccuauggaguuaaaguacucauggaaaacauggggaaaggccaagauaguaacugcggaaacccaaaacaguuccuucauuaucgauggccccaauacgccagagugccccagcgccucuagggcuuggaacgucugggaaguggaggacuaugguuuugggguuuucacaaccaauauuuggcugaaacuucgggaaguguacacucaguugugugaccaccgccucaugucagcagccgucaaggaugagagagcugugcacgccgacaugggauacuggaucgagagucagaaaaacggcagcuggaagcuggaaaaagcaucccuaauagagguuaagaccugcacauggccuaagucucauacucuguggucgaauggugugcucgaaagcgauaugaucauuccaaaaucccuggcgggcccgaucucacagcacaacuauaggcccggguaccauacccaaacagccggaccuuggcaccuuggcaaguuggagcuggacuuuaauuauugcgaggggacgaccguagucauuacugaaaacuguggaacacguggcccaaguuuacggaccacuacagugucugguaaacucauccacgaguggugcugucgaagcugcacccugcccccucuuagauacaugggggaagauggauguugguauggcauggagauaaggccaauuuccgaaaaggaggagaauauggugaaaucacuggucagcgcugguucuggcaagguugacaacuucacgauggggguguugugccucgccauccuguuugaagagguaaugcgcggaaaguucggcaaaaagcauaugaucgcagggguguucuuuacuuucguccuacugcucuccggacagauuaccuggcgggauauggcucacacacugaucaugauuggcaguaaugccagcgacagaauggguaugggggugaccuaccuugcauugauagccacuuuuaaaauccagcccuuccuggcuuuaggauuuuuccucaggaagcugacaucucgcgaaaaccuucugcuaggcguuggccucgcgauggccaccacacugcaauugccggaggauauugaacagauggcaaaugggaucgcucugggauuaauggcccucaaacugauuacucaguuugagaccuaucagcuuuggacggcccugaucuccuugacauguucaaacaccauauucacucucaccguggcuuggcgaacagcaacucugauccuagccggugucagucugcuuccugugugccaaagcucguccaugcggaagaccgacuggcucccaaugacgguugcggcuaugggcgugcccccucugcccuuguuuauuuucucucugaaggauacauuaaaacguagaagcuggccacucaaugagggggucauggccguaggacuggugucaauccuugcaaguucccuguugaggaacgacguuccuauggccggcccccucguggcuggugggcugcuaauugcauguuacgucaucaccggaacuucugccgaucugacaguggaaaaggcggcugacguaaccugggaggaagaggccgaacagacuggcgugagccauaaccuuaugauaacagucgacgaugacggcaccaugcgcauuaaagaugacgagacggagaauauccucacuguucuguugaagaccgcauuacugaucguguccgggauuuuuccauacucaauaccggccacacuccugguguggcacaccuggcagaaacagacacaacggagcggaguccuuugggaugugccuagucccccagaaacucagaaggcugagcuggaagaggguguuuauagaaucaaacagcagggcauuuuggggaagacccaaguaggagugggcguccagaaggaggguguguuccauacgauguggcacguuacaaggggggccgugcuaacucacaacggaaaacgacuggaacccaauugggcaucugucaagaaagaccucaucuccuacggcggcggguggcgccugagcgcucaguggcaaaagggagaggaagugcagguaauugccgucgagccugguaaaaacccaaagaauuuucagaccaugcccggcacauuccagaccacuaccggggaaaucggagcgauagcccuugauuucaagccuggcacaucggguucaccgaucauuaaccgggaggggaaagugguuggauuauauggcaauggcguggucacgaagaacgggggauacgugucugguaucgcacaaacuaaugcugagccagacggccccaccccugaacuggaggaagagauguuuaaaaagagaaaccucacaauuauggauuugcauccagggaguggaaaaaccaggaaguaucugcccgccaucguucgugaagcuauaaagcgccggcucagaacucugauucuugcaccuacaaggguggucgccgccgagauggaggaagcucugaaaggcuugccgauccgauaccagaccacggcgacuaaguccgagcacacaggucgggaaaucguggaccuaaugugccaugcaaccuucaccaugcgccugcucagccccguaagagugccaaauuauaacuuaauuaucauggaugaggcccacuuuacugacccugcuucuauagccgcaaggggguacauuagcacacggguuggaaugggcgaagccgcugcgaucuucaugaccgccacacccccaggcacugcagaugcuuuuccucaguccaaugcccccauucaggacgaggagcgagacaucccagaaagaucauggaacagugggaaugaguggauaacggauuucgcaggaaaaaccgucugguuugugccgagcauuaaggccgguaacgacaucgcuaacugucugcgcaaaaauggcaagaaggugauccaacuuucuaggaaaacauucgauacugaauaccagaagaccaaacugaacgacugggauuuugucguaacaaccgacauuuccgagaugggggccaauuucaaggcggaucgugugaucgacccucggagaugccucaaacccguuauuuugacugauggaccagagagggugauacuggcaggccccaugccugucacggccgcuucagccgcucagcgccgagguagaguggggcggaacccacagaaggaaaaugaccaauauaucuuuaccggccagccccucaacaaugaugaggaccaugcacacuggacagaagccaagaugcugcuugacaacauuaauacuccugagggaaucaucccggcucuauucgaaccagagagggagaaaagugccgcaauugauggcgaauaccgccugaagggggagagccguaaaaccuucguugaauugaugagacggggagacuuacccguguggcuggcgcacaaggucgccuccgaggguauaaaauauacagauaggaaguggugcuuugacggccagcgcaacaaucagauccucgaagagaacauggauguggagauuuggaccaaagaaggggagaagaagaaacugcgaccuagauggcuugacgcucggacuuacucugauccccuggcccucaaggaauucaaagacuuugcagcuggaaggaagucgaucgccuuggaucugguaacagagauuggccgcgugccaagccaucuagcacacagaacgaggaaugcccuggacaaccucguuaugcuucauaccucagaacacggugggcgggcuuaucgucacgcggucgaggagcugccugaaacuauggagacauuauugcugcucggccugaugauccuucugaccggaggcgccaugcucuucuugauauccgggaaaggaaucgguaagaccaguauuggccugaucugugugauugcaucuagcgggauguuauggauggcugaaaucccccuacaauggauagccuccgccauugugcuggaguuuuucaugaugguccuccuuaucccagagccugaaaagcagcgcacaccgcaggauaaucaacuggcauacguugugauuggaaucuugacucuggcugccauaaucgcggcuaacgagaugggccuccuggaaacgaccaaacgagaccuugguaugucaaaggagcccgggguagugucuccaacaagcuaucucgaugucgaccugcauccugccagugcauggacuuuguacgccguggcuaccacaguuauuacccccaugcugagacacacuaucgaaaauuccacggcaaacgugagcuuagccgcgauugcuaaccaggccgucguacuaaugggccuggacaaaggauggccaaucucuaagauggaucucggcgugccucuucuggcauuggggugcuacucacagguuaauccccugacacucaccgccgcugugcugcuuuuaauaacucauuaugccauuaucggaccgggccugcaggcaaaagcuaccagggaggcccaaaagcggacagcggccgguaucaugaagaacccaacugucgacgggauuaugaccaucgaucucgacccugugauauacgauuccaaauuugagaagcaguugggacaggucaugcugcuagugcugugugcaguucagcuccuucugaugcgcacaaguugggcuuugugcgaagcccugacgcucgcaaccggccccauuacuacacugugggaggguagcccaggcaaauucuggaauaccacuaucgcugugucgauggccaacauuuuuagagggucuuauuuagccggagcgggccuugcuuucuccaucaugaagagcguagggacaggaaaaaggggcaccgguucacaaggggaaacgcugggagagaaguggaagaaaaagcucaaucagcuaagucggaaagaauuugaccuguacaagaaaucuggcauaaccgagguggaucgaacagaggcaaaggaagguuugaaaagaggcgagaucacucaccaugccgucucccgcgggagcgcuaagcugcagugguucguugaaaggaacauggugauucccgagggacgggucaucgaccucggcugugggcguggaggcuggucauauuacugcgccggucuuaagaaagugaccgaaguaagaggguauacaaagggaggcccuggccacgaggagccggugcccaugaguacuuacggguggaauauuguuaaacugaugagcggaaaggauguguuuuacuugccaccugaaaaaugugacacccugcucugcgauaucggugaguccucucccagcccuacagucgaagaguccaggaccauucgcguguuaaagauggucgagccauggcugaagaacaaucaguucuguaucaaagugcuuaaccccuauaugccuacuguuauagaacaccuggagcggcuacaacgaaagcauggcgggaugcucguaagaaauccacugucaaggaacucuacgcacgaaauguacuggauuaguaauggaacaggcaacaucgugucgagcgucaauauggugucccgcuugcugcucaaccgguucaccaugacucauagacgucccaccaucgagaaagacguugaucuuggugcagggacaaggcacguggacgccgaaccggagacgccuaacauggacgucauuggagagcggauaaagcgcaucaaagaagagcacaauucuaccuggcauuaugaugacgaaaacccauacaagacuugggcuuaucacggcucauacgaggugaaggcgacaggcagcgccuccaguaugauuaaugggguagugaaacuguuaaccaagcccugggauguugucccuauggugacucagauggcaaugacagacaccacaccauuuggacagcaacgaguguucaaagaaaaggucgauacuagaacccccaggccgaugccugguacgcggaaaguuaugggcaucaccgcugaguggcuguggcgcacauuggggagaaacaagaggccccgacucugcacucgggaggaauuuaccaagaaagugcguacaaaugccgcaaugggagccguauucacugaggaaaaccagugggacucugcuaaggccgcgguggaggaugaagaguuuuggaaacuggucgacagagagcgcgaacuacauaagcuuggcaaaugugguagcugcguguauaauaugauggggaagagggagaaaaagcugggagaauucggcaaggcaaaaggcucacgggccauuugguacauguggcucggggcuagauaccuggaguuugaggccuugggauuccugaacgaagaucacugguuuucccgcgagaauaguuauagcgguguugaaggcgaggggcuccauaagcuuggauacauccugagggacauaucuaaaaucccaggcggugcaauguaugcugaugacaccgccgggugggacacgcgaauuacagaagaugacuuacacaacgaggagaagaucacccagcagauggauccugaacaccggcaacuggcuaaugccauuuucaaauugacuuaccagaacaagguggucaaggugcagagacccacaccaaccggaacuguaauggacaucauauccaggaaagaucagcgcggcucaggccaaguugggaccuauggacucaauacauuuacgaacauggaggcacagcuggugcgucagauggaaggugagggcguccuaagcaaggcggaccuugaaaauccccaucugccugagaaaaagauuacccaguggcucgagacuaaagggguggaacggcugaagagaauggccaucucgggagaugacugcguggucaagccaaucgaugacagguucgcuaacgccuuguuagcacugaacgauaugggcaaaguucgcaaggacauuccgcaauggcagcccucuaaagguuggcacgauuggcagcaggugccuuuuuguagucaucacuuccacgagcucauaaugaaggacgggcgaaaacuuguagugccaugccggccccaagacgaacugaucggaagagcuaggauuucccagggcgccggcuggagccuacgcgagacagcaugucuggggaaggccuacgcgcagauguggucacucauguauuuccauagacgggauuugaggcuggcuuccaaugccaucugcucugcagucccugugcacuggguuccaaccagccguacuacauggaguauucaugcccaccaucaauggaugaccacggaagacaugcuuacaguguggaaccgagucuggaucgaggauaaucccuggauggaggacaagaccccugugacuaccugggaaaacguaccguaccugggaaaacgcgaggaucaguggugugguucccucauaggcuuaacaagcagagcuacuugggcccagaauaucccaaccgcaauucagcaaguucggucucugaucgggaacgaagaguuuuuggacuacaugcccucaaugaagagguuccgcaaagaggaagagagugaaggagcuauuugguga

SEQ ID NO: 15261 - RNA, 9873 nt, Artificial Sequence
  derived and/or modified CDS sequence (opt3) from DENV-3__GQ199886__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggauggggcucaauuccaagaacacaucaaugaguuuuagcugcaucgcgauuggaauaaucacccuguauuuaggcgcuguuguccaggccgacauggguugugugauuaauuggaaagggaaggagcugaagugcggauccggcaucuucgugacuaacgagguccauacauggaccgaacaguacaaauuucaagcagauucucccaagcggcuagccacugcuauugccggugcaugggagaauggcguuugugggauccgaagcaccacacgcauggaaaaccuccuguggaaacagauagcuaaugagcuuaacuauaucuugugggaaaauaacauuaagcugacgguggugguaggagacaccaucggcguccucgagcaggggaaaagaacucugacaccacagccuauggaguuaaaguacucauggaaaaccuggggaaaggccaagauugugacagcggaaacucaaaacaguuccuucaucauagauggccccaauaccccagagugccccagcgccucuagggcuuggaacguuugggaaguggaggacuaugguuuuggggucuucacgacaaauauuuggcugaaacuucgggaaguguacacccaguugugugaccaccgccucaugucagcagccguuaaggaugagagagcugugcacgccgacaugggauacuggaucgagagucagaaaaacggcagcuggaagcuggaaaaagcaucccuaauugagguaaagacuugcaccuggccuaagucucauacacuguggucgaaugguguccucgaaagcgauaugaucauaccaaaaucccuggcgggcccgaucucacagcacaacuauaggcccggguaccauacucaaaccgccggaccuuggcaccuuggcaaguuggagcuggacuuuaauuauugcgaggggacaacgguggugauuaccgaaaacuguggaacucguggcccaaguuuacggacaaccacugucucugguaaacucauccacgaguggugcugucgaagcugcacacugcccccucuuagauacaugggggaagauggauguugguauggcauggagauuaggccaaucuccgaaaaggaggagaauaugguuaaaucacuggugagcgcugguucuggcaagguagacaacuucaccauggggguguugugccucgccauacuguuugaagaggucaugcgcggaaaguucggcaaaaagcauaugauugcagggguguucuuuacguucguucuacugcucuccggacagaucacuuggcgggauauggcucacacccugaucaugauuggcaguaaugccagcgacagaauggguaugggggugacauaccuugcauugaucgccaccuuuaaaauucagcccuuccuggcuuuaggauuuuuccucaggaagcugacuucucgcgaaaaccuucugcuaggcgucggccucgcgauggccacaacccugcaauugccggaggauauagaacagauggcaaaugggaucgcucugggauuaauggcccucaaacugauuacacaguuugagacuuaucagcuuuggaccgcccugaucuccuugacguguucaaacacaauuuucacccucacuguggcuuggcgaaccgcaacacugauccuagccgguguuagucugcuuccugugugccaaagcucguccaugcggaagacugacuggcucccaaugaccgucgcggcuaugggcguacccccucugcccuuguuuauauucucucugaaggauacguuaaaacguagaagcuggccacucaaugagggggugauggccguuggacuggugucaauccuugcaaguucccuguugaggaacgacgucccuauggccggcccccucguggcuggugggcugcuaauugcauguuacguaaucacaggaaccucugccgaucugacuguggaaaaggcggcugacgucacaugggaggaagaggccgaacagaccggcguuagccauaaccuuaugauuacuguggacgaugacggcacaaugcgcaucaaagaugacgagaccgagaauauacucacggugcuguugaagacugcauuacugauugucuccgggaucuuuccauacucaaucccggccacccuccugguguggcacacauggcagaaacagacccaacggagcggaguucuuugggauguaccuagucccccagaaacacagaaggcugagcuggaagaggguguguauagaauuaaacagcagggcauauucgggaagacucaagucggagugggcguucagaaggaggguguguuucauaccauguggcacgucacgaggggggccguguugacauacaacggaaaacgacuagaacccaauugggcaucuguaaagaaagaccugaucuccuauggcggcggguggcgccucagcgcucaguggcaaaagggagaggaaguccaggugauugccguugagccugguaaaaacccaaagaauuuccagacuaugcccggcaccuuccagacaaccacuggggaaaucggagcgauugcccuggauuuuaagccuggcaccucggguucaccgaucauaaaccgggaggggaaaguggucggacuuuacggcaauggcgugguuacaaagaacgggggauaugugucugguaucgcacaaacgaaugcugagccagacggccccacuccugaauuagaggaagagauguucaaaaagagaaaccugaccauuauggaucuccacccagggaguggaaaaacaaggaaguacuugcccgccaucguccgugaagcuauuaagcgccggcugagaacccucauccuggcaccuacuagggugguagccgccgagauggaggaagcucuuaaaggccugccgauacgauaucagacaaccgcgacgaaguccgagcauacuggucgggaaauuguggacuugaugugccacgcaacauuuaccaugcgccuacugagccccguuagagucccaaauuacaaccucaucaucauggaugaggcccauuucaccgacccugcuucuauugccgcaaggggguacaucagcacucgggugggaaugggcgaagccgcugcgauauuuaugacagccacccccccaggcacagcagaugcuuucccucaguccaaugcccccauucaggacgaggagaaagacaucccagaacgaucauggaacagugggaaugaguggauuacugauuuugcaggaaagacggugugguucgucccgagcaucaaagccgguaacgacauagcuaacuguuuaagaaagaauggcaagaaaguaauucaacugucucgcaagaccuuugauacagaauaucagaaaacuaagcuuaacgacugggauuucgugguuaccacagacaucuccgagaugggggccaauuuuaaagcggauagggugaucgacccucgucggugccugaagcccgucauucucaccgauggaccagagagagugaucuuggcaggccccaugccuguuacugccgcuucagccgcucagaggcgcggucgaguggggagaaacccacagaaggaaaaugaccaauacauuuucacgggccagccccugaacaaugaugaggaccacgcacauuggaccgaagccaaaaugcuccuggacaacauaaauacaccugagggaaucauuccggcucuuuucgaaccagagcgggagaagagugccgcaaucgauggcgaauauaggcuaaaaggggagagccgcaagacuuuugucgaacugaugcguagaggagacuugcccgugugguuagcgcacaaaguagccuccgaggguaucaaguacaccgaucggaaauggugcuucgacggccagaggaacaaucagauucuggaagagaacauggauguggagauauggacaaaggaaggggagaagaaaaagcuccgcccucgauggcuggacgcuagaaccuauucugauccccuugcccugaaagaauuuaaggacuucgcagcuggacggaaaucgaucgcccucgauuugguuacugagauuggcagggucccaagccaccuggcacaucgcacaagaaaugcccuagacaaccuggugaugcuccacacgucagaacauggugggagggcuuaccggcacgcgguggaggagcuuccugaaaccauggagacucuguuauugcugggccucaugauccugcuuacaggaggcgccaugcuguuucucauuuccgggaagggaaucgguaagaccaguauaggcuugaucugugucauugcaucuagcgggaugcuguggauggcugaaauccccuuacaauggauugccuccgccaucguucuagaguucuuuaugauggugcugcucauaccagagccugaaaaacagcguaccccgcaggauaaucaacuugcauauguagugauuggaauccugacauuggcugccauuaucgcggcuaacgagaugggccugcucgaaacuacgaagcgcgaccuggguaugucaaaagagcccggggucgugucuccaaccagcuaccuugauguugaccuccacccugccagugcauggacacuguacgccguggcuacuaccgucauaacacccauguugcgacauaccaucgaaaauuccacugcaaacguaagccuggccgcgauugcuaaccaggccgugguuuuaaugggccuagacaagggauggccaaucucuaaaauggaucugggcgugccucuccuugcacuggggugcuauucacaggucaaucccuugacgcugacagccgcugugcuccugcuuauuacccacuacgccaucauaggaccgggcuuacaggcaaaggcuacuagagaggcccaaaagaggaccgcggccgguauuaugaaaaacccaacagucgacgggaucaugacuaucgaucuggacccugugauuuaugauuccaaguucgagaaacagcucggacagguuauguugcuggugcuaugugcaguacagcugcuccuuaugcggaccaguugggcucugugcgaagccuugacacuggcaacgggccccaucaccacucucugggaggguagcccaggcaaguuuuggaauacaaccauagcugugucgauggccaacauuuuccgcgggucuuaccuggccggagcgggcuuagcuuuuuccaucaugaaaagcgucgggacuggaaagagaggcacagguucacaaggggaaacccuuggagagaaguggaaaaagaaacugaaucagcucaguaggaaggaauucgaccuauauaaaaagucuggcauuacggagguugaucggaccgaggcaaaagaaggucugaagcgaggcgagaucacacaucacgccguguccagagggagcgcuaaguugcagugguuugucgaacgcaacauggugauacccgagggaaggguaaucgaccugggcugugggcggggaggcuggucauacuauugcgccggucucaaaaaggugacugaaguucguggguacaccaaaggaggcccuggccaugaggagccggugcccaugaguacauacggguggaauauugucaagcuuaugagcggaaaagauguguucuaucugccaccugaaaagugugacacuuugcugugcgauaucggugaguccucucccagcccuaccgucgaagaguccagaacaauuagggugcucaagaugguugagccaugguuaaaaaacaaucaguucuguaucaagguacugaaccccuacaugccuaccgugauugaacaccuugagcgccugcaacggaaacacggcgggaugcuaguccgaaauccacucucaagaaacucuacucaugaaauguauuggaucaguaauggaacgggcaacauaguggcaucgguuaauauggugagcaggcuguugcugaaccgcuuuacaaugacccaccggagacccacuauugagaaggacgucgaucucggugccgggacccgucaugugaacgcugaaccggagacaccuaauauggacguaaucggagagaggaucaaacggauuaaggaagagcacaacuccacguggcacuacgacgaugaaaauccauauaagaccugggcguaccauggcucuuaugaggugaaagccacuggcucagcaagcuccaugauaaacgggguugucaagcuucugacaaaacccugggacguggugccuauggucacccagauggcuaugacugauacaaccccauucggacagcaacgcguuuuuaaggaaaaaguggacacacgaacucccagaaguaugccggguaccaggcggguaaugggcaucacggccgagugguuauggcgcacccuggggagaaauaagaagccuagguugugcacacgagaggaauucacuaaaaaggugcggaccaacgcagccaugggagcugucuuuacagaggaaaaucagugggauucugccaaagcggcaguggaggacgaagauuucuggaagcucguugaccgugagagagagcugcacaaacuaggcaagugugguagcugcguguacaacaugauggggaaacgcgaaaagaagcuuggagaguuuggcaaagccaagggcucaagggcuauuugguacauguggcugggggcccgguaucucgaauucgaggcacugggauuuuugaaugaggaucauugguucuccagagaaaacaguuacagcggugucgagggcgaagggcugcacaaacucggauauauccuucgcgacauuucuaagauccccggcggugcuauguacgccgaugacacugcugggugggacaccaggauaacggaggaugaccugcauaaugaagagaaaaucacacagcagauggauccagagcaccgacaauuagccaacgcaauuuuuaagcugaccuaucagaauaaggugguaaaaguucagcggccuacucccacaggaaccgugauggacaucauuuccagaaaggaucagaggggcucaggccaagucgggacuuacggauugaacaccuucacaaauauggaagcgcagcucauccgccagauggagggugaaggcgugcugagcaaagccgaccuagagaacccacaccuucccgaaaagaaaauaacgcaguggcuggagaccaaggggguggagcgucucaagcggauggcuauuucgggagaugacugcgucguuaaaccuaucgaugacagauuugccaacgcacuguuggcuuuaaaugauaugggcaaggugaggaaagacaucccacaauggcagccgucuaaggguuggcaugauuggcagcagguacccuucuguagucaccauuuccacgaacugauuaugaaagacgggcgcaagcucguggucccuugccgaccacaagacgagcuuauaggacgggccagaaucucccagggcgcaggcuggagccugagggaaacugccugucuagggaaggcguaugcucagauguggucacugauguacuuucaccgcagagaucuccgguuggccuccaacgcaauuugcucugccgugcccguucauugggugccuacaagcaggaccacuuggaguauccacgcucaucaccaauggaugacaaccgaggacaugcugacggucuggaaucguguguggauugaagauaacccauggauggaggacaaaacacccguaaccacuugggagaauguuccuuaccuuggaaagcgagaagaucaguggugugguucccugaucggccucaccagccgcgccacaugggcacagaacauaccgacugcuauccagcaagugagaucuuuaauugggaaugaggaauuccuggacuauaugccaucaaugaaacgguuuaggaaggaggaggaaagugagggagccaucugguga

SEQ ID NO: 15262 - RNA, 9873 nt, Artificial Sequence
  derived and/or modified CDS sequence (opt3) from DENV-3__FJ882576__SS-prME
accagccugugccucaugaugauccuucccgcagcucuggcauuccacuugacauccagagacggcgagccuaggaugauuguggggaagaacgagcggggaaagucuuuacuguuuaagacugcaucagguauaaauauguguacgcuaaucgcgauggaucucggcgagaugugcgacgauaccgucaccuacaaguguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgauggccaugcgcugugugggcguagggaacagagacuuuguugaaggauugucaggugcgacauggguggaugucgugcuggagcacggcgggugcgugaccacgauggcaaagaauaaacccacucuagacauugagcuccagaagacagaagccacccagcuggcuacucuuaggaaacuguguaucgagggaaagauuacaaacaucaccacggauagccggugcccuacccagggcgaagccgucuugccagaggaacaggaccagaauuauguuuguaaacacacauacguggaucgcgguugggggaacggaugcggccucuucggcaaggggagucugguaacuugcgcaaaguuucaauguuuagagcccauagagggaaaagugguccaguaugaaaaucugaaguacaccgugauuaucacaguucauacuggugaccagcaccaggugggcaacgagacccaaggggucacagcugaaauuaccccucaggccuccacuacggaggcgauccucccagaauauggaacacuuggccuggagugcucuccgcgaaccgguuuggacuucaaugagaugauccuacugacuaugaaaaacaaggccuggauggugcauagacagugguuuuucgaucucccccugccuuggaccagcggggcaacaaccgaaacuccaacauggaauaggaaagagcuucugguaacguuuaagaacgcucacgccaaaaagcaagaaguuguggucuugggcucccaggagggagcuaugcacaccgcccucacuggcgcaacagaaauucaaaauucagggggaaccaguauauucgccggucaucugaagugucgguuaaaaauggacaagcuggagcuaaaaggcaugagcuacgcuaugugcacaaacacuuuugugcucaagaaagaggucucugaaacccagcacgggacgauccugauuaagguggaguacaagggagaagauguucccuguaaaaucccuuucuccaccgaggacggccaagguaaggcgcauaacgggcgucuuauaacagcaaauccagugguaacuaaaaaggaggaacccgucaacauugaggccgaaccgccuuucggcgagucaaauaucgugaucggaauuggcgauaacgcuuugaaaaucaauugguauaagaaggggagcaguauuggaaaaauguuugaagccaccgcacgcggugccagaaggauggcuauacugggcgacacagccugggauuucgggucuguuggaggcgugcucaacucccuggguaagaugguccaccagaucuuugggagcgcauacacugcgcuuuucucgggcgugucuuggguaaugaaaauuggaaucggcgugcuguugaccuggaucgggcucaauuccaagaacacgucaaugaguuuuagcugcauugcuauaggaaucauuacacuguauuuaggcgccguuguccaggcagacauggguugugugaucaauuggaaagggaaggagcugaagugcggauccggcauuuucgugaccaacgagguccauacuuggacagaacaguacaaauuucaagccgauucucccaagcggcuagcuaccgccaucgccggugcuugggagaauggcguuugugggauacgaagcacuacccgcauggaaaaccuccuguggaaacagaucgccaaugagcuuaacuauauuuugugggaaaauaacaucaagcugacaguggugguaggagacauuaucggcguccucgagcaggggaaaagaacgcugaccccacagccuauggaguuaaaguacucauggaaaacuuggggaaaggcgaagauagugacagccgaaacccaaaacaguuccuucauuaucgauggccccaauacaccagagugccccagcgcuucuagggcauggaacguuugggaaguggaggacuaugguuuuggggucuucacuaccaauauuuggcugaaacuucgggaaguguacacgcaguugugugaccaccgccucaugucagccgcuguuaaggaugagagagccgugcacgcagacaugggauacuggaucgagagucagaaaaacggcagcuggaagcuggaaaaagcgucccuaauagagguaaagacaugcaccuggccuaagucucauacucuguggucgaaugguguccucgaaagcgauaugaucauuccaaaaucccuggccggcccgaucucacagcacaacuauaggcccggguaccauacccaaacagcuggaccuuggcaccuuggcaaguuggagcuggacuuuaauuauugcgaggggacuaccguggugauuacagaaaacuguggaacgcguggcccaaguuuacggaccacuacagucucugguaaacucauccacgaguggugcugucgaagcugcacccugcccccucuuagauacaugggggaagauggauguugguauggcauggagauaaggccaauuuccgaaaaggaggagaauaugguuaaaucacuggugagcgccgguucuggcaagguagacaacuucacuauggggguguugugccucgcaauccuguuugaagaggucaugcgcggaaaguucggcaaaaagcauaugaucgcugggguguucuuuacauucguucuacugcucuccggacagauuaccuggcgggauauggcccacacgcugaucaugauuggcaguaaugcaagcgacagaauggguaugggggugacuuaccuugccuugauagcuaccuuuaaaauccagcccuuccuggcguuaggauuuuuccucaggaagcugacaucucgcgaaaaccuucugcuaggcgucggccucgccauggcaaccacucugcaauugccggaggauauugaacagauggcuaaugggaucgcccugggauuaauggcccucaaacugauuacacaguuugagaccuaucagcuuuggacagcucugaucuccuugacuuguucaaacaccauauucacgcucacaguggcauggcgaaccgccacucugauccuagcggguguuagucugcuuccugugugccaaagcucguccaugcggaagaccgacuggcucccaaugacagucgcugccaugggcguacccccucugcccuuguuuauuuucucucugaaggauacuuuaaaacguagaagcuggccacucaaugagggggugauggcaguuggacuggugucaauccuugccaguucccuguugaggaacgacgucccuauggcuggcccccucguggccggugggcugcuaauugccuguuacguaaucaccggaacgucugcggaucugacaguggaaaaggcugccgacgucaccugggaggaagaggcagaacagacuggcguuagccauaaccuuaugauaacaguggacgaugacggcaccaugcgcauuaaagaugacgagacugagaauauccucacagugcuguugaagaccgccuuacugaucgucuccgggauuuuuccauacucaauaccggcuacgcuccugguguggcacacuuggcagaaacagacccaacggagcggaguucuuugggauguaccuagucccccagaaacacagaaggccgagcuggaagaggguguguauagaaucaaacagcagggcauuuucgggaagacccaagucggagugggcguucagaaggaggguguguuucauacaauguggcacgucacuagaggggcaguguuggcuuacaacggaaaacgacuagaacccaauugggccucuguaaagaaagaccugaucuccuauggcggcggguggcgccucagcgcgcaguggcaaaagggagaggaaguccaggugauugccguugagccugguaaaaacccaaagaauuuccagaccaugcccggcacguuccagacaacuaccggggaaaucggagcaauagcucuggauuuuaagccuggcacaucggguucaccgaucauuaaccgggaggggaaaguggucggacuuuacggcaauggcgugguuaccaagaacgggggauaugugucugguaucgcccaaacuaaugcugagccagacggccccaccccugaauuagaggaagagauguucaaaaagagaaaccugacaauuauggaucuccacccagggaguggaaaaacgaggaaguacuugcccgcaaucguccgugaagccauaaagcgccggcugagaacucucauucuggccccuaccagggugguagcugcggagauggaggaagcacuuaaaggccugccgauccgauaucagacaaccgccacuaaguccgagcauacaggucgggaaaucguggacuugaugugccacgcuaccuuuacgaugcgccuacugagccccguuagagucccaaauuacaaccucauuaucauggaugaggcccauuucacugacccugcaucuauagccgcuaggggguacauuagcacacgggugggaaugggcgaagcggccgcaaucuuuaugaccgcuacacccccaggcacugccgaugcauucccucaguccaaugcccccauucaggacgaggagcgagacaucccagaaagaucauggaacagugggaaugaguggauaacagauuuugcuggaaaaaccgugugguucgucccgagcauuaaggccgguaacgacaucgcgaacuguuuacgcaaaaauggcaagaagguaauccaacugucuaggaaaacauuugauacugaauaucagaagacgaaacuuaacgacugggauuucgugguuaccacagacauuuccgagaugggggcaaauuuuaaggccgaucgugugaucgacccucggagaugccugaaacccgucauucucacugauggaccagagagggugauauuggcuggccccaugccuguuaccgccgcuucagcagcccagcgccgagguagaguggggcggaacccacagaaggaaaaugaccaauacaucuucacaggccagccccugaacaaugaugaggaccacgcucauuggaccgaagccaagaugcuccuggacaacauuaauacuccugagggaaucaucccggcacuuuucgaaccagagagggagaaaagugcggccauugauggcgaauaucgccuaaagggggagagccguaaaacguuugucgaacugaugagacggggagacuugcccgugugguuagcucacaagguagccuccgaggguauaaaauacaccgauaggaaguggugcuucgacggcgaacgcaacaaucagauccuggaggagaacauggauguggaaauuuggacaaaagagggggaaaagaagaaacuccgaccuagauggcuggacgcacggacuuauucugauccccuugcucugaaggaguuuaaagacuucgccgcaggaaggaagucgaucgcccucgauuugguuaccgaaauuggccgcgucccaagccaccuggcucauagaacaaggaaugcgcuagacaaccuggugaugcuccacaccucagagcauggugggcgggccuaccgucacgcaguggaggaacuuccugagacuauggaaacacuguuauugcugggccucaugauccugcuuacgggaggcgcuaugcuguuucucauauccgggaaaggaaucgguaagaccaguauuggcuugaucugugucauugccucuagcgggaugcuguggauggccgagauccccuuacaguggauagcauccgcuauuguucuagaguucuuuaugauggugcugcucaucccagaaccugagaagcaacgcacuccgcaggauaaucagcuugccuauguagugauuggaauccugacauuggcggcuauaaucgccgcaaacgaaaugggccugcucgagaccaccaaacgagaccuggguaugucaaaggaacccggggucgugucuccaacaagcuaccuugauguugaccuccacccugccagugcuuggacucuguacgcaguggccacgaccgucauuacacccauguugagacauacuaucgaaaauuccaccgcgaacguaagccuggcugccauugcaaaccaagccgugguuuuaaugggccuagacaaaggauggccaaucucuaagauggaucugggcgugccucuccuugcucuggggugcuauucacaggucaaucccuugacacugaccgccgcagugcuccugcuuauaacucacuacgcuauuaucggaccgggcuuacaggccaaagcgacgagggaggcccagaagcggacagcagcugguaucaugaagaacccaaccgucgacgggauuaugacuaucgaucuggacccugugauauaugauuccaaauucgaaaagcaacucggacagguuauguugcuggugcuaugugccguacagcugcuccuuaugcgcaccaguugggcacugugcgaggcuuugacacuggccacuggccccauuaccacacucugggaagguagcccaggcaaauuuuggaauacgaccaucgccgugucgauggcgaacauuuucagagggucuuaccuggcuggagcaggcuuagccuuuuccaucaugaaaagcgucgggacuggaaaaaggggcacagguucacagggggagacccuuggagaaaaguggaagaaaaagcugaaucaacucagucggaaagaguucgaccuauauaagaaaucuggcauaacugagguugaucgaacagaagcuaaggagggucugaaaagaggcgaaaucacccaucacgccgugucccgcgggagcgcaaaguugcagugguuugucgagaggaacauggugauucccgaaggacggguaaucgaccugggcugugggcguggaggcuggucauacuauugcgccggucucaagaaagugacggagguuagaggguacaccaagggaggcccuggccaugaggaaccggugcccaugaguacauacggguggaauauugucaaacuuaugagcggaaaggauguguucuaucugccaccugagaaaugugacacuuugcugugcgauaucggugaauccucucccagcccuaccgucgaggaguccaggacaauucgcgugcucaagaugguugaaccaugguuaaagaacaaucaguucuguaucaaaguacugaaccccuacaugccuacugugauagagcaccuugaacggcugcagcgaaagcacggcgggaugcuagucagaaauccacucucaaggaacucuacccaugagauguauuggauuaguaauggaacaggcaacaucgugucgagcguuaauauggugucccgccuguugcugaaccgguuuaccaugacucacagacgucccacgaucgaaaaagacgucgaucucggugcugggacaaggcaugugaacgcggagccggagaccccuaauauggacguaauuggagaacggauaaagcgcaucaaagaggaacacaacucuacuuggcacuacgacgaugagaauccauauaagaccugggccuaccauggcucauaugaagugaaggcaacaggcagcgcuuccaguaugauuaacgggguugucaaacuucugacgaagcccugggacguggugccuauggucacccaaauggccaugacugauacaaccccauucggacagcagcgaguuuuuaaagagaagguggacacuagaacacccaggucuaugccggguacccggcgcguaaugggcaucacagcagagugguuauggagaacucuggggaggaauaaaaagccucgauugugcacccgggaagaguucacgaagaaagugcguaccaacgccgcuaugggagccgucuuuacagaagagaaucaaugggauagcgcgaaggcagccguggaagacgaggauuucuggaaacucguugacagagagcgcgaacugcacaagcuaggcaaaugugguucaugcguguacaacaugauggggaagagggagaagaaacuuggagaauuuggcaaagcuaaaggcucccgggccauuugguacauguggcugggggcaagauaucucgaguucgaggcucugggauuuuugaaugaagaucauugguucagucgcgagaacagcuacucuggugucgaaggcgaggggcugcacaagcucggauauauccuuagggacauauccaaaauccccggcggugccauguacgcugaugacacugccgggugggacacccgaauuacagaagaugaccugcauaaugaggagaagaucacucagcagauggauccagaacaccggcaguuagcaaacgcgauuuuuaaacugaccuaucaaaauaaggugguaaagguucagagaccuacgcccacaggaaccgugauggacaucauaucaaggaaagaucagcgcggcagcggccaggucgggacuuacggauugaacacauucaccaauauggaggcccaacucauucgucagauggaaggugagggcgugcugucgaaggcugaccuagaaaacccacaccuucccgagaaaaagaucacucaguggcuggagaccaaagggguggaacggcucaagagaauggccaucucuggagaugacugcgucguuaagccuauugaugacagguuugcaaacgcucuguuggccuuaaaugauaugggcaaagugcgcaaggacauaccacaguggcaaccgaguaaagguuggcaugauuggcagcagguacccuucuguucccaccauuuccacgagcugaucaugaaggacgggcgaaaacucguggucccuugccggccacaggacgaacuuauuggaagggcaaggaucagccaaggcgccggcuggucacugcgcgagacagcgugucuagggaaggcuuaugcccagauguggucccugauguacuuucacagacgggaucucagguuggcaucuaacgccauuugcagcgcugugcccguucauugggugccuacgagucguaccacuugguccauccacgcccaucaccaguggaugacaaccgaagacaugcugacugucuggaaucgaguguggauagaggauaacccauggauggaggacaagacacccguaaccacgugggaaaauguuccuuaccuuggaaaacgcgaggaucaauggugugguagccugaucggccucacaucuagagcaaccugggcucagaacauuccgacugccauccaacaggugcggucauuaauugggaaugaagaguuccuggacuauaugccaaguaugaagagguuucgcaaagaggaagaguccgaaggagcgaucugguga

SEQ ID NO: 15263 - RNA, 9873 nt, Artificial Sequence
  derived and/or modified CDS sequence (opt3) from DENV-3__FJ850052__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauaugggggaagauggauguugguacggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcacaugaucgccgggguguucuuuacguucguucuacugcucuccggacagauuacuuggcgggauauggcacauacccugaucaugauuggcaguaaugcuagcgacagaauggguaugggggugacauaucuugccuugauagcaaccuuuaaaauccagcccuuccuggccuuaggauuuuuccucaggaagcugacuucucgcgaaaaccuucugcuaggcgucggccucgcuauggcgacaacccugcaauugccggaggauauugaacagauggccaaugggaucgcacugggauuaauggcucucaaacugauuacacaguuugagacuuaccagcuuuggaccgcccugaucuccuugacguguucaaacacaauauucacccucacuguggccuggcgaaccgcuacacugauccuagcagguguuagucugcuuccugugugccaaagcucguccaugcggaagacugacuggcucccaauggccgucgcggcuaugggcguacccccucugcccuuguuuauuuucgggcugaaggauaccuuaaaacguagaucuuggccacucaaugagggagugauggccguuggccuggugagcauccuugcaucaagucuguugaggaacgacgucccuauggccgguccccucguggcugggggacugcuaauugcauguuauguaaucacgggcacauccgccgaucugaccguggaaaaggcggcugacauaacuugggaggaagaggccgaacagacaggcgucucucacaaccuuaugauuaccguugacgaugacgggacuaugcgcaucaaagaugacgagacagagaauauccucaccgugcuguugaagacggcauuacugauugugagcggaauauuuccauacuccaucccggccacucuccuggucuggcauaccuggcagaaacagacacaacggucaggugugcuuugggauguuccuagccccccagaaacccagaaggcugagcuggaagagggcguauacagaauuaaacagcaggggaucuucggaaagacacaagugggcgucggugugcagaaggaggggguuuuucacacuauguggcacgugaccaggggagccgucuugacguauaacggcaaacgacuagaacccaauugggcaagugugaagaaagaccugauuucuuacggcgggggauggcgccucuccgcucaguggcaaaagggugaggaaguacaggucaucgccguggagccuggcaaaaacccaaagaauuuccagacaaugcccgggacuuuccagaccacaaccggagaaauaggcgcgaucgcccuggauuuuaagccugguacuagcgggucgccgauuaucaaccgggagggaaaaguugugggccuuuauggcaauggggucgugaccaagaacggagguuacguuucaggcauugcacaaacaaaugcugagccagacgggcccacgccugaauuagaggaagagauguucaaaaagagaaaccugacuaucauggaucuccauccaggaucuggcaaaaccaggaaguauuugcccgccauagugcgugaagcuauuaagcgccggcugagaacacucauccuggcaccuaccagggucguggccgccgagauggaggaagcucuuaaaggucugccgauccgauaccagacuacagcgaccaagagugagcacacggggcgggaaauuguagacuugaugugccaugcaacuuuuacaaugcgccuacugucccccgugagaguuccaaauuauaaccucaucauaauggaugaggcccacuucaccgacccugcuagcauugccgcaaggggauacaucucuacccgggucggcaugggcgaagccgcugcgauuuuuaugacugccacacccccagggaccgcagaugcuuucccucagagcaaugcccccauccaggacaaagagcgagacauaccagagagauccuggaacucaggaaaugaauggauuacagauuuugcagguaagacugugugguucgugccgaguaucaaagccggcaacgacaucgcuaacuguuuacgcaagaaugggaagaaagucauucaacugagcaggaagacguuugauaccgaguaccagaaaacaaagcuuaacgacugggauuucguagugacuaccgacaucucugaaaugggagccaauuuuaaagcggaucguguuauugacccucggagaugccugaagcccgugauacucacagauggcccagagagggucaucuuggcaggucccaugccugugaccgccgcuuccgccgcucagcgccgagggagaguuggccggaacccacagaaggagaaugaccaauauauuuucacuggacagccccugaacaaugaugaagaccaugcacacuggacggaggccaaaaugcuccuggacaacaucaauaccccugaaggcaucauuccggcucuuuucgagccagaaagggagaagucagccgcaauagauggggaguaccgccuaaaaggagaaagucguaagacauuuguggagcugaugagacggggugacuugcccgucugguuagcgcacaaaguggccagcgaaggcaucaaguauacugauaggaaauggugcuucgacgggcagcgcaacaaucagauucuggaggaaaacauggauguagagaucuggaccaaggagggagaaaagaaaaagcuccgaccuagauggcuggacgcucggacauacuccgauccccuugcccugaaagaguuuaaggaauucgcagcuggcaggaaaucuauugcccucgacuuggugaccgagaucggucgcguuccaucgcaucuggcacacagaacuaggaaugcccuagauaaccuggucaugcuccauacaagcgaacacgggggccgggcuuaucgucacgcgguggaggagcuuccugaaacgauggagacccuguuauugcugggacucaugauacugcuuacuggcggggccaugcuguuucucaucucaggaaaggguauuggcaagacauccaucggguugauuugugugaucgcaaguucuggaaugcuguggauggcugaaauacccuuacaauggauugccagcgccaucguccuagaguucuuuaugaugguucugcucauuccagagccugaaaaacagcgcaccccgcaggacaaucaacuugcauacgugguaaucggcauacugaccuuggcugccaucauugcggcuaacgagaugggucugcucgaaacaacuaagcgagaucuggggauguccaaagagcccggcguggucucaccaacgucuuaucuugacguggaucuccauccugccagcgcauggacccuguacgccguugcuacaacugugaucacccccauguugagacacacaauugaaaauaguaccgcaaacgucucccuggccgcgaucgcuaaccaggccguaguguuaaugggacuagacaagggcuggccaauaagcaaaauggaccuggggguuccucuccuugcacugggaugcuacucucaggugaaucccuugacucugacggccgcuguccuccugcuuauuacacauuaugccaucaucggcccggguuuacaggcaaaggcuaccagggaggcccaaaagcggacugcggccgggauuaugaaaaacccaaccguggauggaaucaugacaauagaccuggauccugucauuuacgacucaaaguucgagaaacagcucggccaggugauguugcugguucuaugugcagugcagcugcuccuuaugcgcacuuccugggcucugugcgaagccuugacccuggcaacaggucccaucacgacccucugggagggcaguccagggaaguuuuggaauacuacaauugcuguaagcauggccaacaucuucagaggaucguaucuggccggcgcgggguuagcuuuuucuauaaugaaauccgugggaaccggcaagagggguacugggagccaaggagaaacacuuggcgagaaguggaaaaagaaacugaaucagcucucacggaaggauuucgaccuauacaaaaagagugguaucaccgaagucgaucgaacggaggcaaaagagggccugaagagaggggaaauuacccaccaugccguuucucgcggauccgcuaaguugcagugguuuguggagaggaacauggucauccccgaaggccgggugauugaccugggguguggacguggcgguuggagcuauuacugcgccgggcucaaaaagguaacagaggugagaggauauacuaaaggcggcccugggcacgaagagccgguucccaugucaaccuacggauggaauaucgugaagcuuaugagugguaaagaugucuucuaccugccaccugagaagugugacacauugcugugcgauauuggcgaaagcucccccucuccuacuguggaggaaagcaggaccauccgcguccucaagaugguggagccaugguuaaaaaacaaucaguucuguauaaagguucugaaccccuauaugccuacaguaauugagcaccuugaacggcugcaacgaaaacaugggggaaugcuagugagaaauccacucuccaggaacucaacccacgagauguacuggaucucuaauggcacugguaacaucgucgcaagugugaauaugguuucgcgccuguugcugaaccgguuuacgaugacacauagacgucccaccauugaaaaggacguggaucucggggccggaacuaggcacgucaacgcugagccggaaaccccuaauauggacgugauaggcgagcggaucaaacgcauuaaggaggaacacaacagcacauggcauuaugacgaugagaauccauacaagacgugggcguaucacggcuccuacgaaguaaaagccaccgggucugcaucaagcaugaucaacggagugguuaagcuucugacuaaacccugggacgucgugccuauggugacacagauggcuaugaccgauacuacaccauucggucagcaacgagucuuuaaggagaaaguugacaccagaacacccagguccaugccgggcacucggcgcgugauggggauuaccgccgaaugguuauggagaacgcugggaaggaauaagaagccucgauugugcacccgggaggaguucacaaaaaagguacguacuaacgcagccaugggcgcuguguuuaccgaagagaaucagugggauagugccaaagcggcagucgaagacgaggauuucuggaagcucguggacagagaacgcgagcugcauaaacuagguaagugugggucuugcguuuauaacaugaugggaaaaagggagaagaagcuuggcgaauuuggcaaagccaaggggagccgggcuaucugguacauguggcugggagccagauaccucgaguucgaagcacuggguuuuuugaaugaggaucacugguucucacgcgagaacuccuauaguggcguggaaggggagggacugcauaaacucggcuacauacuuagggacaucagcaagauucccgguggggcuauguaugccgaugacacagcuggaugggacacucgaaucaccgaagaugaccugcacaaugaggaaaaaauuacgcagcagauggauccagagcaccggcaauuagccaacgcaaucuuuaagcugacauaccagaauaaggucgugaaaguacagagaccuacccccacuggcacaguuauggacauaauuucuaggaaggaucagcgcggcuccgggcaagugggaaccuaugguuugaacacuuucaccaauauggaggcgcagcucauccgucagauggaaggcgaggggguccugucaaaagccgaccuagaaaacccacaucuucccgagaagaaaaucacacaguggcuggaaacgaagggaguggagcggcucaagagaauggcuauuagcggcgaugacugcguggucaaaccuauagaugacagguuugccaacgcacuguuggcuuuaaaugauauggguaagguucgcaaagacaucccacaauggcagccgucgaagggguggcacgauuggcagcaggugcccuucuguucucaucacuuccacgagcugauuaugaaagacggacgaaagcucguagugccuugccggccacaagacgaacuuaucggcagagccaggauuagucagggcgcaggguggucccugaaggagaccgccugucuaggaaaagcguacgcucagauguggagccugauguauuuucaucgcagagaucuccgguuggccucaaacgcaaucugcuccgccguccccgugcacuggguuccuacuucuaggacaaccuggagcauacaugcucaccaucaauggaugacuacagaagacaugcugaccguguggaaucgugucuggaucgaggauaacccauggauggaagacaagacgcccgugacaaccugggagaauguaccuuaccuugguaaacgagaggaucagugguguggcagucugauugggcucacuucccgcgccaccugggcacagaacaucccgacagcuauucagcaaguuagaagcuuaaucggaaaugaagaguuccuggacuacaugccaucuaugaagcgguuuaggaaagaagaggagucagaaggcgccauuugguga

SEQ ID NO: 15264 - RNA, 9873 nt, Artificial Sequence
  derived and/or modified CDS sequence (opt3) from DENV-3__FJ873812__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucucaaaugagcuuaacuauauuuugugggaaaauaacaucaagcugaccguuguggugggagacauuaucggcguacucgagcaggggaaaagaacucugacaccacagccuauggaguuaaaguacaguuggaaaaccuggggaaaggcuaagauagucacagccgaaacucaaaacuccagcuucauuaucgauggccccaauaccccagagugccccucugugucaagggcguggaacguuugggaaguggaggacuaugguuuuggggucuucacgacaaauauuuggcugaaacuucgggaaguguacacccaguugugugaccaccgccucaugagugccgcuguuaaggaugagagagcagugcacgccgacaugggauacuggaucgagagccagaaaaacggcuccuggaagcuggaaaaagcuucucuaauagagguaaagacuugcaccuggccuaagucgcauacacuguggagcaaugguguccucgaauccgauaugaucauuccaaaaucacuggccggcccgaucagucagcacaaccauaggcccggguaucacacucaaaccgcaggaccuuggcaccuuggcaaguuggagcuggacuuuaauuacugcgaggggacaacgguggugauuaccgaaaacuguggaacucguggcccaucuuuacggacaaccacugucagcgguaaacucauccaugaguggugcugucgauccugcacacugcccccucuuagauauaugggggaagauggauguugguacggcauggagauaaggccaauuucagaaaaggaggagaauaugguuaaaagccuggugucugcggguuccggcaagguagacaacuucaccauggggguguugugccucgccauccuguuugaagaggucaugcgcggaaaguucggcaaaaagcacaugaucgcugggguguuccuaacguuuguucugcuccugaguggacagauuacuuggcgggauauggcccauacccuuaucaugauuggcagcaaugcaucugacagaauggguaugggggugacauauuuggcucugauagccaccuucaaaauccagcccuuuuuagcacucggauucuuucugaggaagcuuacuucccgcgaaaaccugcuacucggcgucggccuggccauggcuacaaccuugcaacugccggaggauauugaacagauggcgaaugggaucgccuuaggacucauggcacugaaacuuauuacacaguucgagacuuaccagcuguggaccgcuuugaucucacucacguguaguaacacaauauuuacccugacuguggccuggcgaaccgccacacuaauccuggcugguguuagccuucucccugugugccaaucguccucuaugcggaagacugacuggcugccaauggcagucgccgcgaugggcguacccccuuugccccuguucauuuuuagcuuaaaggauacccucaaacguagaucauggccacugaaugagggggugauggcuguuggacuugugaguauccuggccuccucuuugcucaggaacgacgucccuauggcaggcccccugguggccggugggcuacugauugcuuguuauguaaucacgggaacaagcgcagaucuuaccguggaaaaggccgcggacauaacuugggaggaagaggcugaacagacaggcgucucccacaaccucaugauuaccguugacgaugacggcacuaugcgcaucaaagaugacgagacagagaauauccugaccguguuguuaaagacggcccugcucauugugucagggauauucccauacagcaucccggcaacucugcuugucuggcauaccuggcagaaacagacacaacggaguggagugcugugggauguuccuucucccccagaaacccagaaggccgaguuggaagaggguguauacagaauuaaacagcagggcaucuuugggaagacacaagugggagucggcgugcagaaggaggguguuuuccacacuauguggcacgugaccaggggggcuguccuaacguauaacggaaaacgacuggaacccaauugggccuccgugaagaaagaccucauuagcuacggcggcggguggcgccugucggcacaguggcaaaagggagaggaaguacaggucaucgcuguggagccugguaaaaacccaaagaauuuucagacaaugcccggcacuuuccagaccacaaccggggaaauaggagccaucgcgcuugauuucaagccuggcacuucagguucuccgauuaucaaccgggaggggaaaguugugggauuauauggcaauggcgucgugaccaagaacgggggauacguuagugguauugcccaaacaaaugcagagccagacggccccacgccugaacuggaggaagagauguuuaaaaagagaaaccucacuaucauggauuugcauccaggguccggaaaaaccaggaaguaucugcccgcuauagugcgugaagccauuaagcgccggcucagaacacugauccuugcuccuaccagggucguggcagccgagauggaggaagcccugaaaggcuugccgauccgauaccagacuacagcuaccaagagcgagcacacgggucgggaaauuguagaccuaaugugccaugcgacuuucacaaugcgccugcucucucccgugagaguuccaaauuauaacuuaaucauaauggaugaggcacacuuuaccgacccugccagcauugcugccaggggguacaucuccacccgggucggaaugggcgaagcagccgcuauuuucaugacugcgacacccccaggcaccgccgaugcauuuccucagucaaaugcucccauccaggacgaggagcgagacauaccagaaagaaguuggaacagcgggaaugaguggauuacagauuucgccggaaaaacugugugguuugugccgucuaucaaggcagguaacgacaucgccaacugucugcgcaaaaauggcaagaaggucauucaacuuuccaggaaaacguucgauaccgaauaccagaagacaaaacugaacgacugggauuuuguagugacuaccgacaucucagagaugggggcuaauuucaaggccgaucguguuauugacccucggagaugccucaaacccgugauauugacagauggaccagagagggucauccuggcgggccccaugccugugaccgcagccagugcugcccagcgccgagguagaguugggcggaacccacagaaggaaaaugaccaauauauuuuuacuggccagccccucaacaaugaugaggaccaugcucacuggacggaagcaaagaugcugcuugacaacaucaauaccccugagggaaucauuccggcccuauucgaaccagagagggagaaaagcgcugccauagauggcgaauaccgccugaagggggagucccguaaaacauucguggaauugaugagacggggagacuuacccgucuggcuggcacacaagguggcgucugaggguaucaaauauacugauaggaaguggugcuuugacggccagcgcaacaaucagauucucgaagagaacauggauguagagaucuggaccaaagaaggggagaagaagaaacugcgaccuagauggcuugacgcccggacauacucggauccccuggcucucaaggaauucaaagaguuugccgcaggaaggaagagcauugcuuuggaccuggugaccgaaaucggccgcguuccaucacaucuagcccacagaacuaggaaugcacuggauaaccucgucaugcuucauacauccgagcacggugggcgggccuaucgucacgcuguggaggaacugccugagacgauggaaaccuuauugcugcucggccugaugauacuucugacuggaggcgcgaugcucuucuugaucagugggaaaggaauugguaagacaucuaucggccugauuugugugaucgccagcuccgggauguuauggauggcagagauaccccuacaauggauugcuucagccaucguccuggaguuuuucaugaugguucuccuuauuccagaaccugagaagcagcgcaccccgcaggacaaucaacuggccuacgugguaaucggaauauugacccuggcagcuaucauugccgcgaacgaaaugggccuccuggagacaacuaaacgagaucuugguaugucuaaggaacccgggguggucagcccaacgaguuaucucgacguggaucugcauccugcuuccgccuggaccuuguacgcaguugccacaacugugaucacccccaugcugagacacacaauugagaauagcaccgcuaacgucucuuuagcagccaucgcgaaccaggcuguagugcuaaugggccuggacaaaggauggccaauaucaaagauggaccucggcguuccucuucuggccuuggggugcuacucccaggugaauccccugacucucacggcagccguccugcuuuuaauuacacauuaugcuaucaucggaccgggccugcaggccaaagcaaccagggaggcucaaaagcggacugccgcggguauuaugaagaacccaaccguggaugggaucaugacaauagaccucgauccugucauuuacgacaguaaauuugaaaagcaguugggacaggugaugcugcuaguucugugugccgugcagcuccuucugaugcgcacuagcugggcauugugcgaggcucugacccucgccacaggccccaucacgacccugugggaagguucgccaggcaaauucuggaauacuacaauugcaguaucuauggcuaacaucuuuagaggguccuauuuagccggagccggccuugcguucagcauaaugaagucaguggggaccggaaaaaggggcacugguagucaaggggagacacugggagaaaaguggaagaaaaagcucaaucagcuaucucggaaagauuuugaccuguacaagaaauccggcaucaccgaggucgaucgaacggaggcuaaggaagguuugaaaagaggcgagauuacccaccaugcaguuagccgcgggucagccaagcugcagugguucguggaaaggaacauggucauccccgagggacgggugauugaccucggcugugggcguggaggcuggaguuauuacugcgcuggucuuaagaaaguaacagaagugagaggguauacuaagggaggcccuggccacgaggagccgguucccaugagcaccuacggguggaauaucgugaaacugauguccggaaaggaugucuuuuacuugccaccugaaaaaugugacacacugcucugcgauauuggugagucuagccccuccccuacuguggaagagucaaggaccauccgcgucuuaaagaugguggagccauggcugaagaacaaucaguucuguauaaaaguucuuaaccccuauaugccuacaguaauugaacaccuggagcggcuacaacgaaagcauggcgggaugcucgugagaaauccacugucuaggaacaguacccacgaaauguacuggaucucgaauggaacuggcaacaucgucgccagcgugaauaugguuucccgcuugcugcucaaccgguucacgaugacacauagacgucccaccauugagaaagacguggaucuuggugcagggacuaggcacgucaacgccgaaccggagaccccuaauauggacgugauaggagagcggaucaagcgcauuaaagaagagcacaacucuacauggcauuaugacgaugaaaauccauacaagacgugggcuuaucacggcucauacgagguaaaggcgaccggcagcgccuccaguaugaucaacggggugguuaaacuguuaacuaagcccugggacgucgugccuauggugacacagauggcaaugaccgauacuacaccauuuggacagcaacgagucuucaaagaaaagguugacaccagaacacccaggucuaugccggguacucggcgcgugaugggcauuaccgcugaguggcuguggagaacguuggggaggaauaaaaagccucgacucugcacccgggaggaauuuacaaagaaaguacguacuaacgccgcaaugggagccguguucaccgaggaaaaucagugggauagcgcuaaggccgcggucgaggacgaagauuuuuggaaacugguggacagagagcgcgagcuacauaagcuuggcaaaugugguucaugcguuuauaacaugauggggaagagggaaaaaaagcugggagaguucggcaaggcaaaaggcucccgggccaucugguacauguggcucggggcuagauaccuggaauuugaggccuugggauuccugaaugaggaucacugguuuagucgcgaaaacagcuauucugguguggagggcgaagggcuccauaagcuuggauacauacugagggacaucuccaaaauucccggcggugcaauguaugcugaugacacagccgggugggacacucgaaucaccgaggaugacuuacacaaugaagagaagauuacgcagcagauggauccagagcaccggcaacuggcuaacgccaucuucaaauugacauaccagaauaaggucgugaagguacagagaccuacccccacuggaacaguuauggacauaauuucaaggaaagaucagcgcggcagcggccaaguggggaccuauggacucaacacuuuuaccaauauggaagcacagcugauccgucagauggagggugaaggcguccuaucgaaggcggaccuugagaacccacaucugcccgaaaaaaagaucacacaguggcucgagacgaaagggguggagcggcugaagagaauggccauuucuggagaugacugcguggucaagccuauagaugacagguucgcuaacgccuuguuagcacugaaugauaugggcaaaguucgcaaggacaucccacaauggcagccgaguaaagguuggcacgauuggcagcaggugcccuuuuguucccaucacuuccacgaacucauuaugaaggacgggcgaaaacuuguagugccuugccggccacaagacgagcugaucggaagagcuaggauuagccagggcgccggcuggucacuaaaggaaaccgcaugucuggggaaggccuacgcgcagauguggucccucauguauuuccaucgcagagauuugcggcuggcuucuaacgccaucugcagcgcaguccccgugcacuggguuccuacuaguaggacaaccugguccauacaugcccaccaucaauggaugacuacagaggacaugcuuaccguguggaaucgugucuggaucgaagauaacccauggauggaggacaaaacgcccgugacaaccugggagaauguaccuuaccugggaaagcgagaagaucaguggugugguagccucauuggcuuaacuucucgcgcuaccugggcccagaacaucccgacagcaauucagcaaguuagaucacugaucgggaaugaggaauuuuuggacuacaugccaaguaugaaacgguucaggaaggaggaggaauccgagggagcuauuugguga

SEQ ID NO: 15265 - RNA, 9873 nt, Artificial Sequence
  derived and/or modified CDS sequence (opt3) from DENV-3__FJ873813__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcagcaugaaaaucugaaguauacugucauuaucaccgugcacacaggugaccagcaucagguuggcaacgagacccaaggggugacugcagaaauuacgccucaggcuuccacaaccgaggccauccucccagaauacggaacucuuggccuggagugcucuccgcgaaccgguuuggacuucaaugagaugauccuacugacaaugaaaaacaaggcguggaugguccacagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcauacagcucucaccggcgccacagaaauucagaauucagggggaacuaguauauucgcaggucaccugaagugucgguuaaaaauggacaagcuggagcuaaaaggcaugagcuaugccaugugcaccaacacguuuguccucaagaaagaggugucugaaacccagcaugggacaauccugauuaaggucgaguacaagggagaagaugugcccuguaaaaucccuuucuccacugaggacggccaagguaaggcucacaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguacaagaaggggagcaguauuggaaaaauguuugaagcuacugcccgcggugcaagaaggauggccauacugggcgacaccgcuugggauuucgggucugugggaggcguucucaacucccuggguaagauggugcaucagaucuuugggagcgccuauacggcacuuuucucgggcgucucuugggugaugaaaauuggaaucggcguacuguugacauggaucgggcucaauuccaagaacaccucaaugaguuuuagcugcauugcgauaggaaucauuacucuguacuuaggcgcugugguucaggccgacauggguugugucaucaauuggaaagggaaggagcugaagugcggauccggcauuuucgugacaaacgaggugcacaccuggacugaacaguauaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuacauuuugugggaaaauaacaucaagcugaccguuguggugggagacauuaucggcguacucgagcaggggaaaagaacucugacaccacagccuauggaguuaaaguauucauggaaaaccuggggaaaggccaagauagucacagcggaaacucaaaacaguuccuucauuaucgauggccccaauaccccagagugccccagcgugucuagggccuggaacguuugggaaguggaggacuacgguuuuggggucuucacgacaaauauuuggcugaaacuucgggaaguguauacccaguugugugaccaccgccucaugucagcugcaguuaaggaugagagagccgugcaugcugacaugggauacuggaucgagagucagaaaaacggcagcuggaagcuggaaaaagccucccuaauagagguaaagacuugcaccuggccuaagucucacacacuguggucgaaugguguccucgaaagcgauaugaucauuccaaaaucccuggcaggcccgaucucacagcauaaccacaggcccggguaccacacucaaaccgcgggaccuuggcaucuuggcaaguuggagcuggacuuuaauuauugcgaggggacaacgguggugauuaccgaaaacuguggaacucguggcccaaguuuacggacaaccacugucucugguaaacucauccacgaguggugcugucgaagcugcacacugcccccucuuagauacaugggggaagauggauguugguauggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcauaugaucgccgggguguucuuuacguucguucuacugcucuccggacagauuacuuggcgggauauggcacacacccugaucaugauuggcaguaaugcuagcgacagaauggguaugggggugacauaccuugccuugauagcaaccuuuaaaauccagcccuuccuggccuuaggauuuuuccucaggaagcugacuucucgcgaaaaccuucugcuaggcgucggccucgcuauggcgacaacccugcaauugccggaggauauugaacagauggccaaugggaucgcacugggauuaauggcucucaaacugauuacacaguuugagacuuaucagcuuuggaccgcccugaucuccuugacguguucaaacacaauauucacccucacuguggccuggcgaaccgcuacacugauccuagcagguguuagucugcuuccugugugccaaagcucguccaugcggaagacugacuggcucccaauggccgucgcggcuaugggcguacccccucugcccuuguuuauuuucucucugaaggauaccuuaaaacguagaagcuggccacucaaugagggggugauggccguuggacuggugucaauccuugcaaguucccuguugaggaacgacgucccuauggccggcccccucguggcuggugggcugcuaauugcauguuacguaaucacgggaacaucugccgaucugaccguggaaaaggcggcugacauaacuugggaggaagaggccgaacagacaggcgucagccauaaccuuaugauuaccguugacgaugacggcacuaugcgcaucaaagaugacgagacagagaauauccucaccgugcuguugaagacggcauuacugauuguguccgggauauuuccauauucaaucccggccacucuccuggucuggcacaccuggcagaaacagacacaacggagcggagugcuuugggauguuccuagucccccagaaacccagaaggcugagcuggaagaggguguauacagaauuaaacagcagggcaucuucgggaagacacaagugggagucggcgugcagaaggaggguguuuuucacacuauguggcaugugaccaggggggccgucuugacguacaacggaaaacgacuagaacccaauugggcaucugugaagaaagaccugauuuccuauggcggcggguggcgccucagcgcucaguggcaaaagggagaggaaguacaggucaucgccguggagccugguaaaaacccaaagaauuuccagacaaugcccggcacuuuccagaccacaaccggggaaauaggagcgaucgcccuggauuuuaagccuggcacuucggguucaccgauuaucaaccgggaggggaaaguugugggacuuuacggcaauggcgucgugaccaagaacgggggauauguuucugguauugcacaaacaaaugcugagccagacggccccacgccugaauuagaggaagagauguucaaaaagagaaaccugacuaucauggaucuccacccagggaguggaaaaaccaggaaguacuugcccgccauagugcgugaagcuauuaagcgccggcugagaacacucauccuggcaccuaccagggucguggccgccgagauggaggaagcucuuaaaggccugccgauccgauaucagacuacagcgaccaaguccgagcauacgggucgggaaauuguagacuugaugugccacgcaacuuuuacaaugcgccuacugagccccgugagaguuccaaauuacaaccucaucauaauggaugaggcccauuucaccgacccugcuucuauugccgcaaggggguauaucagcacccgggucggaaugggcgaagccgcugcgauuuuuaugacugccacacccccaggcaccgcagaugcuuucccucaguccaaugcccccauccaggacgaggagcgagacauaccagaaagaucauggaacagugggaaugaguggauuacagauuuugcaggaaaaacugugugguucgugccgagcaucaaggccgguaacgacaucgcuaacuguuuacgcaaaaauggcaagaaggucauucaacugucuaggaaaacguuugauaccgaauaccagaagacaaaacuuaacgacugggauuucguagugacuaccgacaucuccgagaugggggccaauuuuaaggcggaucguguuauugacccucggagaugccugaaacccgugauacucacagauggaccagagagggucaucuuggcaggccccaugccugugaccgccgcuucagccgcucagcgccgagguagaguugggcggaacccacagaaggaaaaugaccaauacauuuucacuggccagccccugaacaaugaugaggaccacgcacacuggacggaagccaagaugcuccuggacaacaucaauaccccugagggaaucauuccggcucuuuucgaaccagagagggagaaaagugccgcaauagauggcgaauaucgccuaaagggggagagccguaaaacauuuguggaacugaugagacggggagacuugcccgucugguuagcgcauaagguggccuccgaggguaucaaauacacugauaggaaguggugcuucgacggccagcgcaacaaucagauucuggaagagaacauggauguagagaucuggaccaaagaaggggagaagaagaaacuccgaccuagauggcuggacgcucggacauauucugauccccuugcccugaaggaauuuaaagaguucgcagcuggaaggaagucgauugcccucgacuuggugaccgaaaucggccgcguuccaagccaccuggcacauagaacuaggaaugcccuagauaaccuggucaugcuccacacaucagagcacggugggcgggcuuaccgucaugcgguggaggaacuuccugagacgauggaaacccuguuauugcugggccucaugauacugcuuacuggaggcgccaugcuguuucucaucuccgggaaaggaauugguaagacaaguaucggcuugauuugugugaucgcaucuagcgggaugcuguggauggcugagauacccuuacaauggauugccuccgccaucguccuagaguucuuuaugaugguucugcucauuccagaaccugagaagcagcgcaccccgcaggacaaucaacuugcauaugugguaaucggaauacugaccuuggcugccaucauugcggcuaacgaaaugggccugcucgagacaacuaaacgagaucuggguaugucaaaggaacccgggguggucucuccaacgagcuaccuugacguggaucuccacccugccagugcauggacccuguaugccguugcuacaacugugaucacccccauguugagacauacaauugagaauuccaccgcaaacgucagccuggccgcgaucgcuaaccaggccguaguguuaaugggccuagacaaaggauggccaauaucuaagauggaccugggcguuccucuccuugcacuggggugcuacucacaggugaaucccuugacucugacggccgcuguccuccugcuuauuacacacuacgccaucaucggaccgggcuuacaggcaaaagcuaccagggaggcccaaaagcggacugcggccgguauuaugaagaacccaaccguggaugggaucaugacaauagaccuggauccugucauuuaugacuccaaauucgaaaagcagcucggacaggugauguugcugguucuaugugcagugcagcugcuccuuaugcgcacuaguugggcucugugcgaggccuugacccuggcaacaggccccaucacgacccucugggaagguagcccaggcaaauuuuggaauacuacaauugcuguaucgauggccaacaucuucagagggucuuaccuggccggagcgggcuuagcuuuuuccauaaugaagagcguggggaccggaaaaaggggcacugguucacaaggggagacacuuggagaaaaguggaagaaaaagcugaaucagcucagucggaaagauuucgaccuauauaagaaaucuggcaucaccgaggucgaucgaacggaggcaaaggaaggucugaaaagaggcgagauuacccaucacgccguuucccgcgggagcgcuaaguugcagugguuuguggaaaggaacauggucauccccgagggacgggugauugaccugggcugugggcguggaggcuggucauacuauugcgccggucucaagaaaguaacagaagugagaggguacacuaagggaggcccuggccacgaggagccgguucccaugaguaccuauggguggaauaucgugaaacuuaugagcggaaaggaugucuucuaccugccaccugaaaaaugugacacauugcugugcgauauuggugaguccucucccagcccuacuguggaagaguccaggaccauccgcguccucaagaugguggagccaugguuaaagaacaaucaguucuguauaaaaguucugaaccccuacaugccuacaguaauugaacaucuugagcggcugcaacgaaagcacggcgggaugcuagugagauauccacucucaaggaauucuacccaugaaauguacuggaucaguaacggaacuggcaauaucgucgcaucggugaacaugguuagccgccuguugcugaaucgguuuacgaugacacacagacgucccaccauugagaaagacguggaucucggugccgggacuaggcacgucaacgcugaaccggagaccccuaacauggacgugauaggagagcggaucaagcgcauuaaagaagagcauaauuccacauggcacuaugacgaugaaaacccauacaagacgugggcguaucauggcucuuacgagguaaaggccaccggcucagcaagcuccaugaucaauggggugguuaaacuucugacuaagcccugggacgucgugccuauggugacacagauggcuaugaccgauacuacaccauucggacagcaacgagucuuuaaagaaaagguugacaccagaacacccaggaguaugccggguacucggcgcgugaugggcauuaccgccgagugguuauggagaacgcuggggaggaacaaaaagccucgauugugcacccgggaggaauucacaaagaaaguacguacuaaugcagccaugggagcuguguuuaccgaggaaaaccagugggauucugccaaggcggcagucgaggacgaagauuucuggaaacucguggacagagagcgcgagcugcacaagcuaggcaaaugugguagcugcguuuauaauaugauggggaagagggaaaaaaagcuuggagaguuuggcaaggccaaaggcucacgggcuaucugguacauguggcugggggccagauaccucgaauucgaggcacugggauuuuugaacgaggaucauugguucucccgcgaaaauaguuauagcgguguggagggcgaagggcugcacaagcucggauacauacuuagggacaucucuaaaauucccggcggugcuauguaugccgaugacacagcugggugggacacucgaaucaccgaggaugaccugcacaacgaagagaagauuacgcagcagauggauccagagcaucggcaauuagccaaugcaaucuuuaaacugacauaccagaacaaggucgugaagguacagagaccuacccccacuggaacaguuauggacauaauuuccaggaaagaucagcgcggcucaggccaaguggggaccuauggauugaauacuuucaccaacauggaagcgcagcucauccgucagauggagggugaaggcguccugagcaaggccgaccuagagaauccacaccuucccgaaaaaaagaucacacaguggcuggagacgaaagggguggagcggcucaagagaauggcuauuucgggagaugacugcguggucaagccuauagaugacagguuugccaacgcacuguuggcuuuaaacgauaugggcaaaguucgcaaggacaucccacaauggcagccgucuaaagguuggcaugauuggcagcaggugcccuucuguagucaccacuuccaugaacugauuaugaaggacgggcgaaaacucguagugccuugccggccacaagacgagcuuaucggaagagccaggauuucccagggcgcaggcuggagccugaaggaaaccgccugucuagggaaggcguacgcucagauguggucacugauguauuuucaccgcagagaucuccgguuggccuccaaugcaaucugcucugccguccccgugcauuggguuccuacuagcaggacaaccuggaguauacacgcucaucaccaauggaugacuacagaggacaugcugaccguguggaaccgugucuggaucgaagauaauccauggauggaggacaaaacgcccgugacaaccugggagaacguaccuuaccuuggaaagcgagaagaucaguggugugguucccugauuggccucacuagccgcgccaccugggcacagaauaucccgacagcuauucagcaaguuagaucuuuaaucgggaacgaggaauuccuggacuacaugccaucaaugaaacgguuuaggaaggaggaggaaagugagggagccauuugguga

SEQ ID NO: 15266 - RNA, 9873 nt, Artificial Sequence
  derived and/or modified CDS sequence (opt3) from DENV-3__FJ850048__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauaugggggaagauggauguugguacggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcacaugaucgccgggguguucuuuacguucguucuacugcucuccggacagauuacuuggcgggauauggcacauacccugaucaugauuggcaguaaugcuagcgacagaauggguaugggggugacauaucuugccuugauagcaaccuuuaaaauccagcccuuccuggccuuaggauuuuuccucaggaagcugacuucucgcgaaaaccuucugcuaggcgucggccucgcuauggcgacaacccugcaauugccggaggauauugaacagauggccaaugggaucgcacugggauuaauggcucucaaacugauuacacaguuugagacuuaccagcuuuggaccgcccugaucuccuugacguguucaaacacaauauucacccucacuguggccuggcgaaccgcuacacugauccuagcagguguuagucugcuuccugugugccaaagcucguccaugcggaagacugacuggcucccaauggccgucgcggcuaugggcguacccccucugcccuuguuuauuuucucucugaaggauaccuuaaaacguagaagcuggccacucaaugagggggugauggccguuggacuggugucaauccuugcaaguucccuguugaggaacgacgucccuauggccggcccccucguggcuggugggcugcuaauugcauguuauguaaucacgggaacaucugccgaucugaccguggaaaaggcggcugacauaacuugggaggaagaggccgaacagacaggcgucagccacaaccuuaugauuaccguugacgaugacggcacuaugcgcaucaaagaugacgagacagagaauauccucaccgugcuguugaagacggcauuacugauuguguccgggauauuuccauacucaaucccggccacucuccuggucuggcauaccuggcagaaacagacacaacggagcggagugcuuugggauguuccuagucccccagaaacccagaaggcugagcuggaagaggguguauacagaauuaaacagcagggcaucuucgggaagacacaagugggagucggcgugcagaaggaggguguuuuucacacuauguggcacgugaccaggggggccgucuugacguauaacggaaaacgacuagaacccaauugggcaucugugaagaaagaccugauuuccuacggcggcggguggcgccucagcgcucaguggcaaaagggagaggaaguacaggucaucgccguggagccugguaaaaacccaaagaauuuccagacaaugcccggcacuuuccagaccacaaccggggaaauaggagcgaucgcccuggauuuuaagccuggcacuucggguucaccgauuaucaaccgggaggggaaaguugugggacuuuauggcaauggcgucgugaccaagaacgggggauacguuucugguauugcacaaacaaaugcugagccagacggccccacgccugaauuagaggaagagauguucaaaaagagaaaccugacuaucauggaucuccauccagggaguggaaaaaccaggaaguauuugcccgccauagugcgugaagcuauuaagcgccggcugagaacacucauccuggcaccuaccagggucguggccgccgagauggaggaagcucuuaaaggccugccgauccgauaccagacuacagcgaccaaguccgagcacacgggucgggaaauuguagacuugaugugccaugcaacuuuuacaaugcgccuacugagccccgugagaguuccaaauuauaaccucaucauaauggaugaggcccacuucaccgacccugcuucuauugccgcaaggggguacaucagcacccgggucggaaugggcgaagccgcugcgauuuuuaugacugccacacccccaggcaccgcagaugcuuucccucaguccaaugcccccauccaggacgaggagcgagacauaccagaaagaucauggaacagugggaaugaguggauuacagauuuugcaggaaaaacugugugguucgugccgagcaucaaggccgguaacgacaucgcuaacuguuuacgcaaaaauggcaagaaggucauucaacugucuaggaaaacguuugauaccgaauaccagaagacaaaacuuaacgacugggauuucguagugacuaccgacaucuccgagaugggggccaauuuuaaggcggaucguguuauugacccucggagaugccugaaacccgugauacucacagauggaccagagagggucaucuuggcaggccccaugccugugaccgccgcuucagccgcucagcgccgagguagaguugggcggaacccacagaaggaaaaugaccaauauauuuucacuggccagccccugaacaaugaugaggaccaugcacacuggacggaagccaagaugcuccuggacaacaucaauaccccugagggaaucauuccggcucuuuucgaaccagagagggagaaaagugccgcaauagauggcgaauaccgccuaaagggggagagccguaaaacauuuguggaacugaugagacggggagacuugcccgucugguuagcgcacaagguggccuccgaggguaucaaauauacugauaggaaguggugcuucgacggccagcgcaacaaucagauucuggaagagaacauggauguagagaucuggaccaaagaaggggagaagaagaaacuccgaccuagauggcuggacgcucggacauacucugauccccuugcccugaaggaauuuaaagaguucgcagcuggaaggaagucgauugcccucgacuuggugaccgaaaucggccgcguuccaagccaucuggcacacagaacuaggaaugcccuagauaaccuggucaugcuccauacaucagagcacggugggcgggcuuaucgucacgcgguggaggaacuuccugagacgauggaaacccuguuauugcugggccucaugauacugcuuacuggaggcgccaugcuguuucucaucuccgggaaaggaauugguaagacaaguaucggcuugauuugugugaucgcaucuagcgggaugcuguggauggcugagauacccuuacaauggauugccuccgccaucguccuagaguucuuuaugaugguucugcucauuccagaaccugagaagcagcgcaccccgcaggacaaucaacuugcauacgugguaaucggaauacugaccuuggcugccaucauugcggcuaacgaaaugggccugcucgagacaacuaaacgagaucuggguaugucaaaggaacccgggguggucucuccaacgagcuaucuugacguggaucuccauccugccagugcauggacccuguacgccguugcuacaacugugaucacccccauguugagacacacaauugagaauuccaccgcaaacgucagccuggccgcgaucgcuaaccaggccguaguguuaaugggccuagacaaaggauggccaauaucuaagauggaccugggcguuccucuccuugcacuggggugcuacucacaggugaaucccuugacucugacggccgcuguccuccugcuuauuacacauuaugccaucaucggaccgggcuuacaggcaaaagcuaccagggaggcccaaaagcggacugcggccgguauuaugaagaacccaaccguggaugggaucaugacaauagaccuggauccugucauuuacgacuccaaauucgaaaagcagcucggacaggugauguugcugguucuaugugcagugcagcugcuccuuaugcgcacuaguugggcucugugcgaggccuugacccuggcaacaggccccaucacgacccucugggaagguagcccaggcaaauuuuggaauacuacaauugcuguaucgauggccaacaucuucagagggucuuaucuggccggagcgggcuuagcuuuuuccauaaugaagagcguggggaccggaaaaaggggcacugguucacaaggggagacacuuggagaaaaguggaagaaaaagcugaaucagcucagucggaaagauuucgaccuauacaagaaaucuggcaucaccgaggucgaucgaacggaggcaaaggaaggucugaaaagaggcgagauuacccaccaugccguuucccgcgggagcgcuaaguugcagugguuuguggaaaggaacauggucauccccgagggacgggugauugaccugggcugugggcguggaggcuggucauauuacugcgccggucucaagaaaguaacagaagugagaggguauacuaagggaggcccuggccacgaggagccgguucccaugaguaccuacggguggaauaucgugaaacuuaugagcggaaaggaugucuucuaccugccaccugaaaaaugugacacauugcugugcgauauuggugaguccucucccagcccuacuguggaagaguccaggaccauccgcguccucaagaugguggagccaugguuaaagaacaaucaguucuguauaaaaguucugaaccccuauaugccuacaguaauugaacaccuugagcggcugcaacgaaagcauggcgggaugcuagugagaaauccacucucaaggaacucuacccacgaaauguacuggaucaguaauggaacuggcaacaucgucgcaucggugaauaugguuagccgccuguugcugaaccgguuuacgaugacacauagacgucccaccauugagaaagacguggaucucggugccgggacuaggcacgucaacgcugaaccggagaccccuaauauggacgugauaggagagcggaucaagcgcauuaaagaagagcacaacuccacauggcauuaugacgaugaaaauccauacaagacgugggcguaucacggcucuuacgagguaaaggccaccggcucagcaagcuccaugaucaacggggugguuaaacuucugacuaagcccugggacgucgugccuauggugacacagauggcuaugaccgauacuacaccauucggacagcaacgagucuuuaaagaaaagguugacaccagaacacccaggaguaugccggguacucggcgcgugaugggcauuaccgccgagugguuauggagaacgcuggggaggaauaaaaagccucgauugugcacccgggaggaauucacaaagaaaguacguacuaacgcagccaugggagcuguguuuaccgaggaaaaucagugggauucugccaaggcggcagucgaggacgaagauuucuggaaacucguggacagagagcgcgagcugcauaagcuaggcaaaugugguagcugcguuuauaacaugauggggaagagggaaaaaaagcuuggagaguuuggcaaggccaaaggcucacgggcuaucugguacauguggcugggggccagauaccucgaauucgaggcacugggauuuuugaaugaggaucacugguucucccgcgaaaacaguuauagcgguguggagggcgaagggcugcauaagcucggauacauacuuagggacaucucuaaaauucccggcggugcuauguaugccgaugacacagcugggugggacacucgaaucaccgaggaugaccugcacaaugaagagaagauuacgcagcagauggauccagagcaccggcaauuagccaacgcaaucuuuaaacugacauaccagaauaaggucgugaagguacagagaccuacccccacuggaacaguuauggacauaauuuccaggaaagaucagcgcggcucaggccaaguggggaccuauggauugaacacuuucaccaauauggaagcgcagcucauccgucagauggagggugaaggcguccugagcaaggccgaccuagagaacccacaucuucccgaaaaaaagaucacacaguggcuggagacgaaagggguggagcggcucaagagaauggcuauuucgggagaugacugcguggucaagccuauagaugacagguuugccaacgcacuguuggcuuuaaaugauaugggcaaaguucgcaaggacaucccacaauggcagccgucuaaagguuggcacgauuggcagcaggugcccuucuguagucaucacuuccacgaacugauuaugaaggacgggcgaaaacucguagugccuugccggccacaagacgagcuuaucggaagagccaggauuucccagggcgcaggcuggagccugaaggaaaccgccugucuagggaaggcguacgcucagauguggucacugauguauuuucaucgcagagaucuccgguuggccuccaacgcaaucugcucugccguccccgugcacuggguuccuacuagcaggacaaccuggaguauacaugcucaccaucaauggaugacuacagaggacaugcugaccguguggaaucgugucuggaucgaagauaacccauggauggaggacaaaacgcccgugacaaccugggagaauguaccuuaccuuggaaagcgagaagaucaguggugugguucccugauuggccucacuagccgcgccaccugggcacagaacaucccgacagcuauucagcaaguuagaucuuuaaucgggaaugaggaauuccuggacuacaugccaucaaugaaacgguuuaggaaggaggaggaaagugagggagccauuugguga

SEQ ID NO: 15267 - RNA, 9873 nt, Artificial Sequence
  derived and/or modified CDS sequence (opt3) from DENV-3__FJ850049__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcagcaugaaaaucugaaguauacugucauuaucaccgugcacacaggugaccagcaucagguuggcaacgagacccaaggggugacugcagaaauuacgccucaggcuuccacaaccgaggccauccucccagaauacggaacucuuggccuggagugcucuccgcgaaccgguuuggacuucaaugagaugauccuacugacaaugaaaaacaaggcguggaugguccacagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcauacagcucucaccggcgccacagaaauucagaauucagggggaacuaguauauucgcaggucaccugaagugucgguuaaaaauggacaagcuggagcuaaaaggcaugagcuaugccaugugcaccaacacguuuguccucaagaaagaggugucugaaacccagcaugggacaauccugauuaaggucgaguacaagggagaagaugugcccuguaaaaucccuuucuccacugaggacggccaagguaaggcucacaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguacaagaaggggagcaguauuggaaaaauguuugaagcuacugcccgcggugcaagaaggauggccauacugggcgacaccgcuugggauuucgggucugugggaggcguucucaacucccuggguaagauggugcaucagaucuuugggagcgccuauacggcacuuuucucgggcgucucuugggugaugaaaauuggaaucggcguacuguugacauggaucgggcucaauuccaagaacaccucaaugaguuuuagcugcauugcgauaggaaucauuacucuguacuuaggcgcugugguucaggccgacauggguugugucaucaauuggaaagggaaggagcugaagugcggauccggcauuuucgugacaaacgaggugcacaccuggacugaacaguauaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuacauuuugugggaaaauaacaucaagcugaccguuguggugggagacauuaucggcguacucgagcaggggaaaagaacucugacaccacagccuauggaguuaaaguauucauggaaaaccuggggaaaggccaagauagucacagcggaaacucaaaacaguuccuucauuaucgauggccccaauaccccagagugccccagcgugucuagggccuggaacguuugggaaguggaggacuacgguuuuggggucuucacgacaaauauuuggcugaaacuucgggaaguguauacccaguugugugaccaccgccucaugucagcugcaguuaaggaugagagagccgugcaugcugacaugggauacuggaucgagagucagaaaaacggcagcuggaagcuggaaaaagccucccuaauagagguaaagacuugcaccuggccuaagucucacacacuguggucgaaugguguccucgaaagcgauaugaucauuccaaaaucccuggcaggcccgaucucacagcauaaccacaggcccggguaccacacucaaaccgcgggaccuuggcaucuuggcaaguuggagcuggacuuuaauuauugcgaggggacaacgguggugauuaccgaaaacuguggaacucguggcccaaguuuacggacaaccacugucucugguaaacucauccacgaguggugcugucgaagcugcacacugcccccucuuagauacaugggggaagauggauguugguauggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcauaugaucgccgggguguucuuuacguucguucuacugcucuccggacagauuacuuggcgggauauggcacacacccugaucaugauuggcaguaaugcuagcgacagaauggguaugggggugacauaccuugccuugauagcaaccuuuaaaauccagcccuuccuggccuuaggauuuuuccucaggaagcugacuucucgcgaaaaccuucugcuaggcgucggccucgcuauggcgacaacccugcaauugccggaggauauugaacagauggccaaugggaucgcacugggauuaauggcucucaaacugauuacacaguuugagacuuaucagcuuuggaccgcccugaucuccuugacguguucaaacacaauauucacccucacuguggccuggcgaaccgcuacacugauccuagcagguguuagucugcuuccuaugugccaaagcucguccaugcggaagacugacuggcucccaauggccguggcggcuaugggcguccccccucugcccuuguuuauuuucucucugaaggauaccuuaaaacguagaagcuggccacucaaugaggggguaauggccgugggacugguuucaauccuugcaaguucccuguugaggaacgacgugccuauggccggcccccucgucgcuggugggcugcuaauugcauguuacgugaucacgggaacaucugccgaucugaccguagaaaaggcggcuaacauaacuugggaggaagaggccgaacagacaggcgugagccauaaucuuaugauuaccgucgacgacgauggcacuaugcgcaucaaagacgaugagacagagaacauccucaccguucuguugaagacggcauuacugauuguguccgggauauuuccauauucaaucccggccacucuccugguguggcacaccuggcagaaacagacacaacggagcggaguccuuugggacgugccuagucccccagaaacccagaaggcugagcuggaagaggguguuuacagaauuaaacagcagggcaucuucgggaagacacaaguaggagugggcguccagaaggaggguguguuucacacuauguggcauguuaccaggggggccguguugacguacaauggaaaacgacuagaacccaacugggcaucugucaagaaagaucugauuuccuauggcggcggguggcgccucagcgcucaguggcaaaagggagaggaagugcagguaaucgccgucgagccugguaaaaauccaaagaacuuccagacaaugcccggcacuuuccagaccacaaccggggaaauaggagcgaucgcccuggacuuuaagccuggcacuucggguucaccgauuaucaaucgggaggggaaagugguuggacuuuacggcaacggcguggucaccaagaaugggggauaugugucugguauugcacaaacaaacgcugagccagauggccccacgccugaauuagaggaagagauguucaaaaagagaaaucugacuaucauggaccuccacccagggaguggaaaaaccaggaaguacuugcccgccauaguucgugaagcuauuaagcgccggcugagaacacucauccuggcaccuaccaggguggucgccgccgagauggaggaagcucuuaaaggccugccgauccgauaucagacuacagcgaccaaguccgagcauacgggucgggaaauuguggauuugaugugccacgcaacuuuuacaaugcgccuacugagccccguaagagugccaaacuacaaucucaucauaauggacgaggcccauuucaccgauccugcuucuauugccgcaaggggguauaucagcacccggguuggaaugggcgaagccgcugcgauuuuuaugacugccacacccccaggcaccgcagacgcuuucccucaguccaacgcccccauccaggaugaggagcgagacauaccagaaagaucauggaauagugggaacgaguggauuacagacuuugcaggaaaaacugucugguucgugccgagcaucaaggccgguaacgauaucgcuaauuguuuacgcaaaaacggcaagaaggugauucaacugucuaggaaaacguuugacaccgaauaccagaagacaaaacuuaaugauugggacuucgucguaacuaccgauaucuccgagaugggggccaacuuuaaggcggaccgugugauugauccucggagaugccugaaacccguuauacucacagacggaccagagagggugaucuuggcaggccccaugccugucaccgccgcuucagccgcucagcgccgagguagaguggggcggaauccacagaaggaaaacgaucaauacauuuucacuggccagccccugaauaacgacgaggaucacgcacacuggacggaagccaagaugcuccuggacaauaucaacaccccugagggaaucauuccggcucuuuucgaaccagagagggagaaaagugccgcaauagacggcgaauaucgccuaaagggggagagccguaaaacauuuguugaacugaugagacggggagauuugcccgugugguuagcgcauaaggucgccuccgaggguaucaaauacacugacaggaaguggugcuucgauggccagcgcaauaaccagauucuggaagagaauauggacguggagaucuggaccaaagaaggggagaagaagaaacuccgaccuagauggcuggaugcucggacauauucugacccccuugcccugaaggaauuuaaagaguucgcagcuggaaggaagucgauugcccucgauuugguaaccgaaaucggccgcgugccaagccaccuggcacauagaacuaggaacgcccuagacaaucugguuaugcuccacacaucagagcacggugggcgggcuuaccgucaugcggucgaggaacuuccugagacgauggaaacccuguuauugcugggccucaugauacugcuuacuggaggcgccaugcuguuucucaucuccgggaaaggaauugguaagacaaguaucggcuugauuugugugaucgcaucuagcgggaugcuguggauggcugagauacccuuacaauggauugccuccgccaucgugcuagaguucuuuaugaugguccugcucauuccagaaccugagaagcagcgcaccccgcaggauaaccaacuugcauauguugugaucggaauacugaccuuggcugccaucauugcggcuaaugaaaugggccugcucgagacaacuaaacgagaccuggguaugucaaaggaacccgggguagugucuccaacgagcuaccuugaugucgaccuccacccugccagugcauggacccuguaugccguggcuacaacuguuaucacccccauguugagacauacaauugagaacuccaccgcaaacgugagccuggccgcgaucgcuaaucaggccgucguauuaaugggccuagauaaaggauggccaauaucuaagauggaccugggcgugccucuccuugcacuggggugcuacucacagguuaaccccuugacucugacggccgcugugcuccugcuuauuacacacuacgccaucaucggaccgggcuuacaggcaaaagcuaccagggaggcccaaaagcggacugcggccgguauuaugaagaauccaaccgucgacgggaucaugacaauagaucuggacccugugauuuaugauuccaaauucgaaaagcagcucggacaggucauguugcuggugcuaugugcaguucagcugcuccuuaugcgcacuaguugggcucugugcgaggccuugacccuggcaacaggccccaucacgacccucugggaagguagcccaggcaaauuuuggaacacuacaauugcugugucgauggccaauaucuucagagggucuuaccuggccggagcgggcuuagcuuuuuccauaaugaagagcguagggaccggaaaaaggggcacugguucacaaggggagacacuuggagaaaaguggaagaaaaagcugaaccagcucagucggaaagacuucgaucuauauaagaaaucuggcaucaccgagguggaccgaacggaggcaaaggaaggucugaaaagaggcgagauuacccaucacgccgucucccgcgggagcgcuaaguugcagugguuuguugaaaggaauauggugauccccgagggacgggucauugaucugggcugugggcguggaggcuggucauacuauugcgccggucucaagaaagugacagaaguaagaggguacacuaagggaggcccuggccacgaggagccggugcccaugaguaccuauggguggaacaucguuaaacuuaugagcggaaaggacguguucuaccugccaccugaaaaaugugauacauugcugugcgacauuggugaguccucucccagcccuacugucgaagaguccaggaccauccgcgugcucaagauggucgagccaugguuaaagaauaaccaguucuguauaaaagugcugaaucccuacaugccuacaguuauugaacaucuugagcggcugcaacgaaagcacggcgggaugcuaguaagaaacccacucucaaggaauucuacccaugaaauguauuggaucaguaacggaacuggcaauaucguggcaucggucaacauggugagccgccuguugcugaaccgguuuacgaugacacacagacgucccaccauugagaaagauguugaccucggugccgggacuaggcacgugaaugcugaaccggagaccccuaacauggaugucauaggagagcggaucaagcgcauuaaagaagagcauaauuccacauggcacuacgacgacgaaaacccauauaagacgugggcguaccauggcucuuaugaggugaaggccaccggcucagcaagcuccaugaucaaugggguagugaaacuucugacuaagcccugggauguugucccuauggugacacagauggcuaugaccgacacuacaccauucggacagcaacgaguguuuaaagaaaaggucgauaccagaacacccaggaguaugccggguacucggcgcguuaugggcauuaccgccgagugguuauggagaacgcuggggaggaacaaaaagccucgauugugcacccgggaggaauucacaaagaaagugcguacuaaugcagccaugggagcuguauuuaccgaggaaaaccagugggacucugccaaggcggcaguggaggaugaagacuucuggaaacucgucgauagagagcgcgagcugcacaagcuaggcaaaugugguagcugcguguacaauaugauggggaagagggaaaaaaagcuuggagaguuuggcaaggccaaaggcucacgggcuaucugguauauguggcugggggccagauaccucgaauucgaggcacugggauuuuugaacgaggaccauugguucucccgcgaaaauaguuacagcgguguugagggcgaagggcugcacaagcucggauauauacuuagggauaucucuaaaauucccggcggugcuauguacgccgacgauacagcugggugggacacucgaaucaccgaggacgaucugcacaacgaagagaagauuacgcagcagauggacccagagcaucggcaauuagccaaugcaaucuuuaaacugacauaucagaacaagguggucaaggugcagagaccuacccccacuggaacaguaauggauauaauuuccaggaaagaccagcgcggcucaggccaaguugggaccuacggauugaauacuuucaccaacauggaagcgcagcucauccgucagauggagggugaaggcgugcugagcaaggccgaucuagagaacccacaccuucccgaaaaaaagaucacacaguggcuggagacgaaaggggucgagcggcucaagagaauggcuauuucgggagacgauugcguggugaagccuauagacgauagguuugccaaugcacuguuggcuuuaaacgacaugggcaaaguccgcaaggauaucccacaauggcagccgucuaaagguuggcaugacuggcagcagguucccuucuguagucaccacuuccaugaacugauuaugaaggaugggcgaaaacucgugguaccuugccggccacaagacgagcuuaucggaagagccaggauuucccagggcgcaggcuggagccugaaggaaaccgccugucuagggaaggcguaugcucagauguggucacugauguacuuucaccgcagagaccuccgguuggccuccaaugcaaucugcucugccgugcccguccauugggugccuacuagcaggacaaccuggaguauacacgcucaucaccaauggaugacuacagaggauaugcugaccguuuggaaccguguguggaucgaagacaauccauggauggaggauaaaacgcccgucacaaccugggagaacgugccuuaucuuggaaagcgagaagaccaguggugugguucccugauuggccucacuagccgcgccaccugggcacagaauaucccgacagcuauucagcaaguaagaucuuuaaucgggaacgaggaauuccuggauuacaugccaucaaugaaacgguuuaggaaggaggaggaaagugagggagccauuugguga

SEQ ID NO: 15268 - RNA, 9873 nt, Artificial Sequence
  derived and/or modified CDS sequence (opt3) from DENV-3__FJ898476__SS-prME
accagccugugccucaugaugauccuucccgcagcucuggcauuccacuugacauccagagacggcgaaccuagaaugauuguggggaagaacgaacgggguaaaucuuuacuguuuaagacugccucagguauaaauauguguacgcuaaucgcgauggaucucggcgaaaugugcgacgauaccgucacauacaaauguccacauauuacugaaguugaaccggaagacaucgauugcugguguaaccugaccaguacaugggugaccuaugggacuugcaaucaggcuggagaacaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucaaaauucagggggaacaagcauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacuaagaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauaugggggaagauggauguugguacggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcacaugaucgccgggguguucuuuacguucguucuacugcucuccggacagauuacuuggcgggauauggcacauacccugaucaugauuggcaguaaugcuagcgacagaauggguaugggggugacauaucuugccuugauagcaaccuuuaaaauccagcccuuccuggccuuaggauuuuuccucaggaagcugacuucucgcgaaaaccuucugcuaggcgucggccucgcuauggcgacaacccugcaauugccggaggauauugaacagauggccaaugggaucgcacugggauuaauggcucucaaacugauuacacaguuugagacuuaccagcuuuggaccgcccugaucuccuugacguguucaaacacaauauucacccucacuguggccuggcgaaccgcuacacugauccuagccgguguuagucugcuuccugugugccaaagcucguccaugcggaagacugacuggcucccaauggccgucgcggcuaugggcguacccccucugcccuuguuuauuuucgggcugaaggauaccuuaaaacguagaucuuggccacucaaugagggagugauggccguuggccuggugagcauccuugcaucaagucuguugaggaacgacgucccuauggccgguccccucguggcugggggacugcuaauugcauguuauguaaucacgggcacauccgccgaucugaccguggaaaaggcggcugacauaacuugggaggaagaggccgaacagacaggcgucucucacaaccuuaugauuaccguugacgaugacgggacuaugcgcaucaaagaugacgagacagagaauauccucaccgugcuguugaagacggcauuacugauugugagcggaauauuuccauacuccaucccggccacucuccuggucuggcauaccuggcagaaacagacacaacggucaggugugcuuugggauguuccuagucccccagaaacccagaaggcugagcuggaagagggcguauacagaauuaaacagcaggggaucuucggaaagacacaagugggcgucggugugcagaaggaggggguuuuucacacuauguggcacgugaccaggggagccgucuugacguauaacggcaaacgacuagaacccaauugggcaagugugaagaaagaccugauuucuuacggcgggggauggcgccucuccgcucaguggcaaaagggugaggaaguacaggucaucgccguggagccuggcaaaaacccaaagaauuuccagacaaugcccgggacuuuccagaccacaaccggagaaauaggcgcgaucgcccuggauuuuaagccugguacuagcgggucgccgauuaucaaccgggagggaaaaguugugggccuuuauggcaauggggucgugaccaagaacggagguuacguuucaggcauugcacaaacaaaugcugagccagacgggcccacgccugaauuagaggaagagauguucaaaaagagaaaccugacuaucauggaucuccauccaggaucuggcaaaaccaggaaguauuugcccgccauagugcgugaagcuauuaagcgccggcugagaacacucauccuggcaccuaccagggucguggccgccgagauggaggaagcucuuaaaggucugccgauccgauaccagacuacagcgaccaagagugagcacacggggcgggaaauuguagacuugaugugccaugcaacuuuuacaaugcgccuacugucccccgugagaguuccaaauuauaaccucaucauaauggaugaggcccacuucaccgacccugcuagcauugccgcaaggggauacaucucuacccgggucggcaugggcgaagccgcugcgauuuuuaugacugccacacccccagggaccgcagaugcuuucccucagagcaaugcccccauccaggacgaggagcgagacauaccagaaagauccuggaacucaggaaaugaguggauuacagauuuugcagguaaaacugugugguucgugccgaguaucaaggccggcaacgacaucgcuaacuguuuacgcaaaaaugggaagaaggucauucaacugagcaggaaaacguuugauaccgaauaccagaagacaaaacuuaacgacugggauuucguagugacuaccgacaucucugagaugggagccaauuuuaaggcggaucguguuauugacccucggagaugccugaaacccgugauacucacagauggcccagagagggucaucuuggcaggucccaugccugugaccgccgcuuccgccgcucagcgccgagggagaguuggccggaacccacagaaggaaaaugaccaauauauuuucacuggacagccccugaacaaugaugaggaccaugcacacuggacggaagccaagaugcuccuggacaacaucaauaccccugagggcaucauuccggcucuuuucgaaccagagagggagaaaucagccgcaauagauggggaauaccgccuaaagggagagagucguaaaacauuuguggaacugaugagacggggugacuugcccgucugguuagcgcacaagguggccagcgagggcaucaaauauacugauaggaaguggugcuucgacgggcagcgcaacaaucagauucuggaagagaacauggauguagagaucuggaccaaagaaggagagaagaagaaacuccgaccuagauggcuggacgcucggacauacuccgauccccuugcccugaaggaauuuaaagaguucgcagcuggcaggaagucuauugcccucgacuuggugaccgaaaucggucgcguuccaucgcaucuggcacacagaacuaggaaugcccuagauaaccuggucaugcuccauacaagcgagcacgggggccgggcuuaucgucacgcgguggaggaacuuccugagacgauggaaacccuguuauugcugggacucaugauacugcuuacuggcggggccaugcuguuucucaucucaggaaaagguauuggcaagacauccaucggguugauuugugugaucgcaaguucuggaaugcuguggauggcugagauacccuuacaauggauugccagcgccaucguccuagaguucuuuaugaugguucugcucauuccagaaccugagaagcagcgcaccccgcaggacaaucaacuugcauacgugguaaucggcauacugaccuuggcugccaucauugcggcuaacgaaaugggucugcucgagacaacuaaacgagaucuggggauguccaaggaacccggcguggucucaccaacgucuuaucuugacguggaucuccauccugccagcgcauggacccuguacgccguugcuacaacugugaucacccccauguugagacacacaauugagaauaguaccgcaaacgucucccuggccgcgaucgcuaaccaggccguaguguuaaugggacuagacaaaggcuggccaauaagcaagauggaccuggggguuccucuccuugcacugggaugcuacucucaggugaaucccuugacucugacggccgcuguccuccugcuuauuacacauuaugccaucaucggcccggguuuacaggcaaaagcuaccagggaggcccaaaagcggacugcggccgggauuaugaagaacccaaccguggauggaaucaugacaauagaccuggauccugucauuuacgacucaaaauucgaaaagcagcucggccaggugauguugcugguucuaugugcagugcagcugcuccuuaugcgcacuuccugggcucugugcgaggccuugacccuggcaacaggucccaucacgacccucugggaaggcaguccagggaaauuuuggaauacuacaauugcuguaagcauggccaacaucuucagaggaucguaucuggccggcgcgggguuagcuuuuucuauaaugaaguccgugggaaccggcaaaagggguacugggagccaaggagagacacuuggcgaaaaguggaagaaaaagcugaaucagcucucacggaaagauuucgaccuauacaagaaaagugguaucaccgaggucgaucgaacggaggcaaaggaaggccugaaaagaggggagauuacccaccaugccguuucucgcggauccgcuaaguugcagugguuuguggaaaggaacauggucauccccgagggccgggugauugaccugggguguggacguggcgguuggagcuauuacugcgccgggcucaagaaaguaacagaagugagaggauauacuaagggcggcccugggcacgaggagccgguucccaugucaaccuacggauggaauaucgugaaacuuaugagugguaaggaugucuucuaccugccaccugaaaaaugugacacauugcugugcgauauuggcgagagcucccccucuccuacuguggaagagagcaggaccauccgcguccucaagaugguggagccaugguuaaagaacaaucaguucuguauaaaaguucugaaccccuauaugccuacaguaauugaacaccuugagcggcugcaacgaaagcaugggggaaugcuagugagaaauccacucuccaggaacucaacccacgaaauguacuggaucucuaauggcacugguaacaucgucgcaagugugaauaugguuucgcgccuguugcugaaccgguuuacgaugacacauagacgucccaccauugagaaagacguggaucucggggccggaacuaggcacgucaacgcugaaccggagaccccuaauauggacgugauaggcgagcggaucaagcgcauuaaagaagaacacaacagcacauggcauuaugacgaugaaaauccauacaagacgugggcguaucacggcuccuacgagguaaaggccaccgggucugcaucaagcaugaucaacggagugguuaaacuucugacuaagcccugggacgucgugccuauggugacacagauggcuaugaccgauacuacaccauucggucagcaacgagucuuuaaagaaaagguugacaccagaacacccagguccaugccgggcacucggcgcgugauggggauuaccgccgagugguuauggagaacgcugggaaggaauaaaaagccucgauugugcacccgggaggaguucacaaagaaaguacguacuaacgcagccaugggcgcuguguuuaccgaggaaaaucagugggauagugccaaggcggcagucgaggacgaagauuucuggaaacucguggacagagagcgcgagcugcauaagcuagguaaaugugggucuugcguuuauaacaugaugggaaagagggagaagaaacuuggcgaguuuggcaaagccaaagggagccgggcuaucugguacauguggcugggagccagauaccucgaguucgaggcacugggauuuuugaaugaggaucacugguucucacgcgaaaacuccuauaguggcguggagggggaaggacugcauaagcucggcuacauacuuagggacaucagcaaaauucccgguggggcuauguaugccgaugacacagcuggaugggacacucgaaucaccgaggaugaccugcacaaugaagagaagauuacgcagcagauggauccagagcaccggcaauuagccaacgcaaucuuuaaacugacauaccagaauaaggucgugaagguacagagaccuacccccacuggcacaguuauggacauaauuucuaggaaagaucagcgcggcuccgggcaagugggaaccuaugguuugaacacuuucaccaauauggaagcgcagcucauccgucagauggagggcgaagggguccugucaaaggccgaccuagagaacccacaucuucccgagaaaaagaucacacaguggcuggagacgaaaggaguggagcggcucaagagaauggcuauuagcggcgaugacugcguggucaagccuauagaugacagguuugccaacgcacuguuggcuuuaaaugauauggguaaaguucgcaaggacaucccacaauggcagccgucgaaaggguggcacgauuggcaacaggugcccuucuguucucaucacuuccacgaacugauuaugaaggacggacgaaaacucguagugccuugccggccacaagacgagcuuaucggcagagccaggauuagucagggcgcaggguggucccugaaggaaaccgccugucuaggaaaggcguacgcucagauguggagccugauguauuuucaucgcagagaucuccgguuggccucaaacgcaaucugcuccgccguccccgugcacuggguuccuacuucuaggacaaccuggagcauacaugcucaccaucaauggaugacuacagaggacaugcugaccguguggaaucgugucuggaucgaagauaacccauggauggaggacaaaacgcccgugacaaccugggagaauguaccuuaccuugguaagcgagaagaucagugguguggcagucugauugggcucacuucccgcgccaccugggcacagaacaucccgacagcuauucagcaaguuaggagcuuaaucggaaaugaggaguuccuggacuacaugccaucuaugaaacgguuuaggaaggaggaggaaucagagggcgccauuugguga

SEQ ID NO: 15269 - RNA, 9873 nt, Artificial Sequence
  derived and/or modified CDS sequence (opt3) from DENV-3__FJ898475__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauaugggggaagauggauguugguacggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcacaugaucgccgggguguuccuaacguuuguucugcuccuguccggacagauuacuuggcgggauauggcacauacccuuaucaugauuggcaguaaugcuagcgacagaauggguaugggggugacauauuuggcccugauagcaaccuucaaaauccagcccuuuuuagcccucggauucuuucugaggaagcuuacuucucgcgaaaaccugcuacucggcgucggccuggcuauggcgacaaccuugcaacugccggaggauauugaacagauggccaaugggaucgcauuaggacucauggcucugaaacuuauuacacaguucgagacuuaccagcuguggaccgccuugaucucccucacguguucaaacacaauauuuacccugacuguggccuggcgaaccgcuacacuaauccuggcagguguuagucuucucccugugugccaaagcucguccaugcggaagacugacuggcugccaauggccgucgcggcuaugggcguacccccuuugccccuguucauuuuuucuuuaaaggauacccucaaacguagaagcuggccacugaaugagggggugauggccguuggacuugugucaauccuggcaaguuccuugcucaggaacgacgucccuauggccggcccccugguggcuggugggcuacugauugcauguuauguaaucacgggaacaucugccgaucuuaccguggaaaaggcggcugacauaacuugggaggaagaggccgaacagacaggcgucagccacaaccucaugauuaccguugacgaugacggcacuaugcgcaucaaagaugacgagacagagaauauccugaccguguuguuaaagacggcacugcucauuguguccgggauauucccauacucaaucccggccacucugcuugucuggcauaccuggcagaaacagacacaacggagcggagugcugugggauguuccuagucccccagaaacccagaaggcugaguuggaagaggguguauacagaauuaaacagcagggcaucuuugggaagacacaagugggagucggcgugcagaaggaggguguuuuccacacuauguggcacgugaccaggggggccguccuaacguauaacggaaaacgacuggaacccaauugggcaucugugaagaaagaccucauuuccuacggcggcggguggcgccugagcgcucaguggcaaaagggagaggaaguacaggucaucgccguggagccugguaaaaacccaaagaauuuucagacaaugcccggcacuuuccagaccacaaccggggaaauaggagcgaucgcccuugauuucaagccuggcacuucggguucaccgauuaucaaccgggaggggaaaguugugggauuauauggcaauggcgucgugaccaagaacgggggauacguuucugguauugcacaaacaaaugcugagccagacggccccacgccugaacuggaggaagagauguuuaaaaagagaaaccucacuaucauggauuugcauccagggaguggaaaaaccaggaaguaucugcccgccauagugcgugaagcuauuaagcgccggcucagaacacugauccuugcaccuaccagggucguggccgccgagauggaggaagcucugaaaggcuugccgauccgauaccagacuacagcgaccaaguccgagcacacgggucgggaaauuguagaccuaaugugccaugcaacuuucacaaugcgccugcucagccccgugagaguuccaaauuauaacuuaaucauaauggaugaggcccacuuuaccgacccugcuucuauugccgcaaggggguacaucagcacccgggucggaaugggcgaagccgcugcgauuuucaugacugccacacccccaggcaccgcagaugcuuuuccucaguccaaugcccccauccaggacgaggagcgagacauaccagaaagaucauggaacagugggaaugaguggauuacagauuucgcaggaaaaacugugugguuugugccgagcaucaaggccgguaacgacaucgcuaacugucugcgcaaaaauggcaagaaggucauucaacuuucuaggaaaacguucgauaccgaauaccagaagacaaaacugaacgacugggauuuuguagugacuaccgacaucuccgagaugggggccaauuucaaggcggaucguguuauugacccucggagaugccucaaacccgugauauugacagauggaccagagagggucauccuggcaggccccaugccugugaccgccgcuucagccgcucagcgccgagguagaguugggcggaacccacagaaggaaaaugaccaauauauuuuuacuggccagccccucaacaaugaugaggaccaugcacacuggacggaagccaagaugcugcuugacaacaucaauaccccugagggaaucauuccggcucuauucgaaccagagagggagaaaagugccgcaauagauggcgaauaccgccugaagggggagagccguaaaacauucguggaauugaugagacggggagacuuacccgucuggcuggcgcacaagguggccuccgaggguaucaaauauacugauaggaaguggugcuuugacggccagcgcaacaaucagauucucgaagagaacauggauguagagaucuggaccaaagaaggggagaagaagaaacugcgaccuagauggcuugacgcucggacauacucugauccccuggcccucaaggaauucaaagaguuugcagcuggaaggaagucgauugccuuggaccuggugaccgaaaucggccgcguuccaagccaucuagcacacagaacuaggaaugcccuggauaaccucgucaugcuucauacaucagagcacggugggcgggcuuaucgucacgcgguggaggaacugccugagacgauggaaaccuuauugcugcucggccugaugauacuucugacuggaggcgccaugcucuucuugaucuccgggaaaggaauugguaagacaaguaucggccugauuugugugaucgcaucuagcgggauguuauggauggcugagauaccccuacaauggauugccuccgccaucguccuggaguuuuucaugaugguucuccuuauuccagaaccugagaagcagcgcaccccgcaggacaaucaacuggcauacgugguaaucggaauauugacccuggcugccaucauugcggcuaacgaaaugggccuccuggagacaacuaaacgagaucuugguaugucaaaggaacccgggguggucucuccaacgagcuaucucgacguggaucugcauccugccagugcauggaccuuguacgccguugcuacaacugugaucacccccaugcugagacacacaauugagaauuccaccgcaaacgucagcuuagccgcgaucgcuaaccaggccguagugcuaaugggccuggacaaaggauggccaauaucuaagauggaccucggcguuccucuucuggcauuggggugcuacucacaggugaauccccugacucucacggccgcuguccugcuuuuaauuacacauuaugccaucaucggaccgggccugcaggcaaaagcuaccagggaggcccaaaagcggacugcggccgguauuaugaagaacccaaccguggaugggaucaugacaauagaccucgauccugucauuuacgacuccaaauuugaaaagcaguugggacaggugaugcugcuaguucugugugcagugcagcuccuucugaugcgcacuaguugggcuuugugcgaggcccugacccucgcaacaggccccaucacgacccugugggaagguagcccaggcaaauucuggaauacuacaauugcuguaucgauggccaacaucuuuagagggucuuauuuagccggagcgggccuugcuuucuccauaaugaagagcguggggaccggaaaaaggggcacugguucacaaggggagacacugggagaaaaguggaagaaaaagcucaaucagcuaagucggaaagauuuugaccuguacaagaaaucuggcaucaccgaggucgaucgaacggaggcaaaggaagguuugaaaagaggcgagauuacccaccaugccguuucccgcgggagcgcuaagcugcagugguucguggaaaggaacauggucauccccgagggacgggugauugaccucggcugugggcguggaggcuggucauauuacugcgccggucuuaagaaaguaacagaagugagaggguauacuaagggaggcccuggccacgaggagccgguucccaugaguaccuacggguggaauaucgugaaacugaugagcggaaaggaugucuuuuacuugccaccugaaaaaugugacacacugcucugcgauauuggugaguccucucccagcccuacuguggaagaguccaggaccauccgcgucuuaaagaugguggagccauggcugaagaacaaucaguucuguauaaaaguucuuaaccccuauaugccuacaguaauugaacaccuggagcggcuacaacgaaagcauggcgggaugcucgugagaaauccacugucaaggaacucuacccacgaaauguacuggaucaguaauggaacuggcaacaucgucgcaucggugaauaugguuagccgcuugcugcucaaccgguucacgaugacacauagacgucccaccauugagaaagacguggaucuuggugccgggacuaggcacgucaacgcugaaccggagaccccuaauauggacgugauaggagagcggaucaagcgcauuaaagaagagcacaacuccacauggcauuaugacgaugaaaauccauacaagacgugggcguaucacggcucuuacgagguaaaggccaccggcucagcaagcuccaugaucaacggggugguuaaacuguuaacuaagcccugggacgucgugccuauggugacacagauggcuaugaccgauacuacaccauuuggacagcaacgagucuucaaagaaaagguugacaccagaacacccaggaguaugccggguacucggcgcgugaugggcauuaccgccgaguggcuguggagaacguuggggaggaauaaaaagccucgacucugcacccgggaggaauuuacaaagaaaguacguacuaacgcagccaugggagcuguguucaccgaggaaaaucagugggauucugccaaggcggcagucgaggacgaagauuuuuggaaacugguggacagagagcgcgagcuacauaagcuuggcaaaugugguagcugcguuuauaacaugauggggaagagggaaaaaaagcugggagaguucggcaaggccaaaggcucacgggcuaucugguacauguggcucggggccagauaccuggaauuugaggcauugggauuccugaaugaggaucacugguuuucccgcgaaaacaguuauagcgguguggagggcgaagggcuccauaagcuuggauacauacugagggacaucucuaaaauucccggcggugcuauguaugccgaugacacagcugggugggacacucgaaucaccgaggaugacuuacacaaugaagagaagauuacgcagcagauggauccagagcaccggcaacuggccaacgcaaucuucaaauugacauaccagaauaaggucgugaagguacagagaccuacccccacuggaacaguuauggacauaauuuccaggaaagaucagcgcggcucaggccaaguggggaccuauggacucaacacuuuuaccaauauggaagcgcagcugauccgucagauggagggugaaggcguccuaagcaaggccgaccuugagaacccacaucugcccgaaaaaaagaucacacaguggcucgagacgaaagggguggagcggcugaagagaauggcuauuucgggagaugacugcguggucaagccuauagaugacagguucgccaacgcauuguuagcucugaaugauaugggcaaaguucgcaaggacaucccacaauggcagccgucuaaagguuggcacgauuggcagcaggugcccuuuuguagucaucacuuccacgaacucauuaugaaggacgggcgaaaacuuguagugccuugccggccacaagacgagcugaucggaagagccaggauuucccagggcgcaggcuggagccuaaaggaaaccgccugucuggggaaggcguacgcucagauguggucacucauguauuuccaucgcagagauuugcggcuggccuccaacgcaaucugcucugccguccccgugcacuggguuccuacuagcaggacaaccuggaguauacaugcucaccaucaauggaugacuacagaggacaugcuuaccguguggaaucgugucuggaucgaagauaacccauggauggaggacaaaacgcccgugacaaccugggagaauguaccuuaccugggaaagcgagaagaucaguggugugguucccucauuggcuuaacuagccgcgccaccugggcacagaacaucccgacagcuauucagcaaguuagaucucugaucgggaaugaggaauuuuuggacuacaugccaucaaugaaacgguucaggaaggaggaggaaagugagggagccauuugguga

SEQ ID NO: 15270 - RNA, 9873 nt, Artificial Sequence
  derived and/or modified CDS sequence (opt3) from DENV-3__GQ199861__SS-prME
accagccugugccucaugaugauccuucccgccgcucuggcauuccacuugacauccagagacggcgaaccuaggaugauuguggggaagaaugaacggggaaaaucuuuacuguuuaagacugccucagguauaaauauguguacgcuaaucgcgauggaucucggcgaaaugugcgacgauaccgucacauacaaauguccacauauuacugaaguugaaccggaagacaucgauugcugguguaaccugaccaguacaugggugaccuaugggacuugcaaucaggcuggagaacaccgccgagacaagcguagcgucgcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcagcaugaaaaucugaaguauacugucauuaucaccgugcacacaggugaccagcaucagguuggcaacgagacccaaggggugacugcagaaauuacgccucaggcuuccacaaccgaggccauccucccagaauacggaacucuuggccuggagugcucuccgcgaaccgguuuggacuucaaugagaugauccuacugacaaugaaaaacaaggcguggaugguccacagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcauacagcucucaccggcgccacagaaauucaaaauucagggggaacaaguauauucgcaggucaccugaagugucgguuaaaaauggacaagcuggagcuaaaaggcaugagcuaugccaugugcaccaacacguuuguccucaagaaagaggugucugaaacccagcaugggacaauccugauuaaggucgaguacaagggagaagaugugcccuguaaaaucccuuucuccacugaggacggccaagguaaggcucacaacgggcgucuuauaaccgcgaauccaguugugacuaagaaggaggaacccguaaacauugaggcagaaccgccuuucggcgagucaaauaucgucaucggaauuggcgauaacgccuugaaaaucaauugguacaagaaggggagcaguauuggaaaaauguuugaagcuacugcccgcggugcaagaaggauggccauacugggcgacaccgcuugggauuucgggucugugggaggcguucucaacucccuggguaagauggugcaucagaucuuugggagcgccuauacggcacuuuucucgggcgucucuugggugaugaaaauuggaaucggcguacuguugacauggaucgggcucaauuccaagaacaccucaaugaguuuuagcugcauugcgauaggaaucauuacucuguacuuaggcgcugugguucaggccgacauggguugugucaucaauuggaaagggaaggagcugaagugcggauccggcauuuucgugacaaacgaggugcacaccuggacugaacaguauaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuacauuuugugggaaaauaacaucaagcugaccguuguggugggagacauuaucggcguacucgagcaggggaaaagaacucugacaccacagccuauggaguuaaaguauucauggaaaaccuggggaaaggccaagauagucacagcggaaacucaaaacaguuccuucauuaucgauggccccaauaccccagagugccccagcgugucuagggccuggaacguuugggaaguggaggacuacgguuuuggggucuucacgacaaauauuuggcugaaacuucgggaaguguauacccaguugugugaccaccgccucaugucagcugcaguuaaggaugagagagccgugcaugcugacaugggauacuggaucgagagucagaaaaacggcagcuggaagcuggaaaaagccucccuaauagagguaaagacuugcaccuggccuaagucucacacacuguggucgaaugguguccucgaaagcgauaugaucauuccaaaaucccuggcaggcccgaucucacagcauaaccacaggcccggguaccacacucaaaccgcgggaccuuggcaucuuggcaaguuggagcuggacuuuaauuauugcgaggggacaacgguggugauuaccgaaaacuguggaacucguggcccaaguuuacggacaaccacugucucugguaaacucauccacgaguggugcugucgaagcugcacacugcccccucuuagauacaugggggaagauggauguugguauggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcauaugaucgccgggguguucuuuacguucguucuacugcucuccggacagauuacuuggcgggauauggcacacacccugaucaugauuggcaguaaugcuagcgacagaauggguaugggggugacauaccuugccuugauagcaaccuuuaaaauccagcccuuccuggccuuaggauuuuuccucaggaagcugacuucucgcgaaaaccuucugcuaggcgucggccucgcuauggcgacaacccugcaauugccggaggauauugaacagauggccaaugggaucgcacugggauuaauggcucucaaacugauuacacaguuugagacuuaucagcuuuggaccgcccugaucuccuugacguguucaaacacaauauucacccucacuguggccuggcgaaccgcuacacugauccuagccgguguuagucugcuuccuaugugccaaagcucguccaugcggaagacugacuggcucccaauggccguggcggcuaugggcguacccccucugcccuuguuuauuuucucucugaaggauaccuuaaaacguagaagcuggccacucaaugaggggguaauggccgugggacugguuucaauccuugcaaguucccuguugaggaacgacgugccuauggccggcccccucgucgcuggugggcugcuaauugcauguuacgugaucacgggaacaucugccgaucugaccguagaaaaggcggcugacauaacuugggaggaagaggccgaacagacaggcgugagccauaaccuuaugauuaccgucgacgaugacggcacuaugcgcaucaaagaugacgagacagagaauauccucaccguucuguugaagacggcauuacugauuguguccgggauauuuccauauucaaucccggccacucuccugguguggcacaccuggcagaaacagacacaacggagcggaguccuuugggaugugccuagucccccagaaacccagaaggcugagcuggaagaggguguuuacagaauuaaacagcagggcaucuucgggaagacacaaguaggagugggcguccagaaggaggguguguuucacacuauguggcauguuaccagaggggcaguguugacguacaacggaaaacgacuagaacccaauugggcaaacgucaagaaagaccugauuucuuauggcggcggguggcgccucuccgcucaguggcaaaagggagaggaagugcagguaaucgccgucgagccugguaaaaauccaaagaacuuccagacaaugcccggcacuuuccagaccacaaccggggaaauaggagcgaucgcccuggauuuuaagccuggcacuagcgguucgccgauuaucaaucgggaggggaaagugguuggacuuuacggcaacggcguggucaccaagaaugggggauaugugucagguauugcacaaacaaacgcugagccagacggccccacgccugaauuagaggaagagauguucaaaaagagaaaucugacuaucauggaucuccacccagggucuggaaaaaccaggaaguacuugcccgccauaguucgugaagcuauuaagcgccggcugagaacacucauccuggcaccuaccaggguggucgccgccgagauggaggaagcucuuaaaggccugccgauccgauaucagacuacagcgaccaagagugagcauacgggucgggaaauuguggacuugaugugccacgcaacuuuuacaaugcgccuacugucccccguaagagugccaaacuacaaucucaucauaauggaugaggcccauuucaccgacccugcuagcauugccgcaaggggguauaucucuacccggguuggaaugggcgaagccgcugcgauuuuuaugacugccacacccccaggcaccgcagaugcuuucccucagagcaacgcccccauccaggacgaggagcgagacauaccagaaagauccuggaacucagggaacgaguggauuacagauuuugcaggaaaaacugucugguucgugccgaguaucaaggccgguaacgacaucgcuaauuguuuacgcaaaaacggcaagaaggugauucaacugagcaggaaaacguuugauaccgaauaccagaagacaaaacuuaaugacugggauuucgucguaacuaccgacaucucugagaugggggccaacuuuaaggcggaucgugugauugacccucggagaugccugaaacccguuauacucacagauggaccagagagggugaucuuggcaggccccaugccugucaccgccgcuuccgccgcucagcgccgagguagaguggggcggaauccacagaaggaaaacgaccaauacauuuucacuggccagccccugaauaacgaugaggaccacgcacacuggacggaagccaagaugcuccuggacaauaucaacaccccugagggaaucauuccggcucuuuucgaaccagagagggagaaaucagccgcaauagauggcgaauaucgccuaaagggggagagucguaaaacauuuguugaacugaugagacggggagacuugcccgugugguuagcgcauaaggucgccagcgaggguaucaaauacacugauaggaaguggugcuucgacggccagcgcaauaaccagauucuggaagagaauauggauguggagaucuggaccaaagaaggggagaagaagaaacuccgaccuagauggcuggacgcucggacauauuccgauccccuugcccugaaggaauuuaaagaguucgcagcuggaaggaagucuauugcccucgacuugguaaccgaaaucggccgcgugccaucgcaccuggcacauagaacuaggaacgcccuagauaaucugguuaugcuccacacaagcgagcacggugggcgggcuuaccgucaugcggucgaggaacuuccugagacgauggaaacccuguuauugcugggccucaugauacugcuuacuggaggcgccaugcuguuucucaucucagggaaaggaauugguaagacauccaucggcuugauuugugugaucgcaaguucugggaugcuguggauggcugagauacccuuacaauggauugccagcgccaucgugcuagaguucuuuaugaugguccugcucauuccagaaccugagaagcagcgcaccccgcaggacaaccaacuugcauauguugugaucggaauacugaccuuggcugccaucauugcggcuaaugaaaugggccugcucgagacaacuaaacgagaucuggguauguccaaggaacccgggguagugucaccaacgucuuaccuugacgucgaucuccacccugccagcgcauggacccuguaugccguggcuacaacuguuaucacccccauguugagacauacaauugagaacaguaccgcaaacgugucccuggccgcgaucgcuaaucaggccgucguauuaaugggccuagacaaaggauggccaauaagcaagauggaccugggcgugccucuccuugcacuggggugcuacucucagguuaaccccuugacucugacggccgcugugcuccugcuuauuacacacuacgccaucaucggaccgggcuuacaggcaaaagcuaccagggaggcccaaaagcggacugcggccgguauuaugaagaauccaaccgucgaugggaucaugacaauagaccuggauccugugauuuaugacucaaaauucgaaaagcagcucggacaggucauguugcuggugcuaugugcaguucagcugcuccuuaugcgcacuuccugggcucugugcgaggccuugacccuggcaacaggccccaucacgacccucugggaagguaguccaggcaaauuuuggaacacuacaauugcugugagcauggccaauaucuucagagggucguaccuggccggagcgggcuuagcuuuuucuauaaugaaguccguagggaccggaaaaaggggcacugguagccaaggggagacacuuggagaaaaguggaagaaaaagcugaaccagcucucacggaaagauuucgaccuauauaagaaaaguggcaucaccgagguggaucgaacggaggcaaaggaaggucugaaaagaggcgagauuacccaucacgccgucucucgcggguccgcuaaguugcagugguuuguugaaaggaauauggugauccccgagggacgggucauugaccugggcugugggcguggaggcuggagcuacuauugcgccggucucaagaaagugacagaaguaagaggguacacuaagggaggcccuggccacgaggagccggugcccaugucaaccuauggguggaacaucguuaaacuuaugaguggaaaggauguguucuaccugccaccugaaaaaugugacacauugcugugcgauauuggugagagcucccccucuccuacugucgaagagagcaggaccauccgcgugcucaagauggucgagccaugguuaaagaauaaccaguucuguauaaaagugcugaaucccuacaugccuacaguuauugaacaucuugagcggcugcaacgaaagcacggcgggaugcuaguaagaaacccacucuccagaaauucaacccaugaaauguauuggaucucuaacggaacuggcaauaucguggcaagugucaacauggugucgcgccuguugcugaaccgguuuacgaugacacacagacgucccaccauugagaaagacguugaucucggugccgggacuaggcacgugaaugcugaaccggagaccccuaacauggacgucauaggagagcggaucaagcgcauuaaagaagaacauaauagcacauggcacuacgacgaugaaaacccauauaagacgugggcguaccauggcuccuaugaggugaaggccaccggcucugcaucaagcaugaucaaugggguagugaaacuucugacuaagcccugggacguugucccuauggugacacagauggcuaugaccgauacuacaccauucggacagcaacgaguguuuaaagaaaaggucgacaccagaacacccagguccaugccggguacucggcgcguuaugggcauuaccgccgagugguuauggagaacgcuggggaggaacaaaaagccucgauugugcacccgggaggaguucacaaagaaagugcguacuaaugcagccaugggagcuguauuuaccgaggaaaaccagugggauagugccaaggcggcaguggaggacgaagauuucuggaaacucgucgacagagagcgcgagcugcacaagcuaggcaaaugugguucuugcguguacaauaugauggggaagagggagaagaaacuuggagaguuuggcaaagccaaaggcagccgggcuaucugguauauguggcugggggccagauaccucgaguucgaggcacugggauuuuugaacgaggaucauugguucucacgcgaaaauuccuacagugguguugagggcgaagggcugcacaagcucggauauauacuuagggacaucagcaaaauucccggcggugcuauguacgccgaugacacagcugggugggacacucgaaucaccgaggaugaccugcacaacgaagagaagauuacgcagcagauggauccagagcaucggcaauuagccaaugcaaucuuuaaacugacauaucagaacaagguggucaaggugcagagaccuacccccacuggaacaguaauggacauaauuucuaggaaagaucagcgcggcuccggccaaguugggaccuacggauugaauacuuucaccaacauggaagcgcagcucauccgucagauggagggugaaggcgugcugucaaaggccgaccuagagaacccacaccuucccgagaaaaagaucacacaguggcuggagacgaaaggggucgagcggcucaagagaauggcuauuagcggagaugacugcguggugaagccuauagaugacagguuugccaaugcacuguuggcuuuaaacgauaugggcaaaguccgcaaggacaucccacaauggcagccgucgaaagguuggcaugauuggcagcagguucccuucuguucucaccacuuccaugaacugauuaugaaggacgggcgaaaacucgugguaccuugccggccacaagacgagcuuaucggaagggccaggauuagucagggcgcaggcuggucccugaaggaaaccgccugucuagggaaggcguaugcucagauguggagccugauguacuuucaccgcagagaucuccgguuggccucaaaugcaaucugcuccgccgugcccguccauugggugccuacuucuaggacaaccuggagcauacacgcucaucaccaauggaugacuacagaggacaugcugaccguuuggaaccguguguggaucgaagauaauccauggauggaggacaaaacgcccgucacaaccugggagaacgugccuuaucuuggaaagcgagaagaucaguggugugguagucugauuggccucacuucccgcgccaccugggcacagaauaucccgacagcuauucagcaaguaaggagcuuaaucgggaacgaggaguuccuggacuacaugccaucuaugaaacgguuuaggaaggaggaggaaucagagggagccauuugguga

SEQ ID NO: 15271 - RNA, 9873 nt, Artificial Sequence
  derived and/or modified CDS sequence (opt3) from DENV-3__GQ199862__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauaugggggaagauggauguugguacggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcacaugaucgccgggguguucuuuacguucguucuacugcucuccggacagauuacuuggcgggauauggcacauacccugaucaugauuggcaguaaugcuagcgacagaauggguaugggggugacauaucuugccuugauagcaaccuuuaaaauccagcccuuccuggccuuaggauuuuuccucaggaagcugacuucucgcgaaaaccuucugcuaggcgucggccucgcuauggcgacaacccugcaauugccggaggauauugaacagauggccaaugggaucgcacugggauuaauggcucucaaacugauuacacaguuugagacuuaccagcuuuggaccgcccugaucuccuugacguguucaaacacaauauucacccucacuguggccuggcgaaccgcuacacugauccuagcagguguuagucugcuuccugugugccaaagcucguccaugcggaagacugacuggcucccaauggccgucgcggcuaugggcguacccccucugcccuuguuuauuuucucucugaaggauaccuuaaaacguagaagcuggccacucaaugagggggugauggccguuggacuggugucaauccuugcaaguucccuguugaggaacgacgucccuauggccggcccccucguggcuggugggcugcuaauugcauguuauguaaucacgggaacaucugccgaucugaccguggaaaaggcggcugacauaacuugggaggaagaggccgaacagacaggcgucagccacaaccuuaugauuaccguugacgaugacggcacuaugcgcaucaaagaugacgagacagagaauauccucaccgugcuguugaagacggcauuacugauuguguccgggauauuuccauacucaaucccggccacucuccuggucuggcauaccuggcagaaacagacacaacggagcggagugcuuugggauguuccuagucccccagaaacccagaaggcugagcuggaagaggguguauacagaauuaaacagcagggcaucuuggggaagacacaagugggagucggcgugcagaaggaggguguuuuccacacuauguggcacgugaccaggggggccguccuaacguauaacggaaaacgacuggaacccaauugggcaucugugaagaaagaccucauuuccuacggcggcggguggcgccugagcgcucaguggcaaaagggagaggaaguacaggucaucgccguggagccugguaaaaacccaaagaauuuucagacaaugcccggcacuuuccagaccacaaccggggaaauaggagcgaucgcccuugauuucaagccuggcacuucggguucaccgauuaucaaccgggaggggaaaguugugggauuauauggcaauggcgucgugaccaagaacgggggauacguuucugguauugcacaaacaaaugcugagccagacggccccacgccugaacuggaggaagagauguuuaaaaagagaaaccucacuaucauggauuugcauccagggaguggaaaaaccaggaaguaucugcccgccauagugcgugaagcuauuaagcgccggcucagaacacugauccuugcaccuaccagggucguggccgccgagauggaggaagcucugaaaggcuugccgauccgauaccagacuacagcgaccaaguccgagcacacgggucgggaaauuguagaccuaaugugccaugcaacuuucacaaugcgccugcucagccccgugagaguuccaaauuauaacuuaaucauaauggaugaggcccacuuuaccgacccugcuucuauugccgcaaggggguacaucagcacccgggucggaaugggcgaagccgcugcgauuuucaugacugccacacccccaggcaccgcagaugcuuuuccucaguccaaugcccccauccaggacgaggagcgagacauaccagaaagaucauggaacagugggaaugaguggauuacagauuucgcaggaaaaacugugugguuugugccgagcaucaaggccgguaacgacaucgcuaacugucugcgcaaaaauggcaagaaggucauucaacuuucuaggaaaacguucgauaccgaauaccagaagacaaaacugaacgacugggauuuuguagugacuaccgacaucuccgagaugggggccaauuucaaggcggaucguguuauugacccucggagaugccucaaacccgugauauugacagauggaccagagagggucauccuggcaggccccaugccugugaccgccgcuucagccgcucagcgccgagguagaguugggcggaacccacagaaggaaaaugaccaauauauuuuuacuggccagccccucaacaaugaugaggaccaugcacacuggacggaagccaagaugcugcuugacaacaucaauaccccugagggaaucauuccggcucuauucgaaccagagagggagaaaagugccgcaauagauggcgaauaccgccugaagggggagagccguaaaacauucguggaauugaugagacggggagacuuacccgucuggcuggcgcacaagguggccuccgaggguaucaaauauacugauaggaaguggugcuuugacggccagcgcaacaaucagauucucgaagagaacauggauguagagaucuggaccaaagaaggggagaagaagaaacugcgaccuagauggcuugacgcucggacauacucugauccccuggcccucaaggaauucaaagaguuugcagcuggaaggaagucgauugccuuggaccuggugaccgaaaucggccgcguuccaagccaucuagcacacagaacuaggaaugcccuggauaaccucgucaugcuucauacaucagagcacggugggcgggcuuaucgucacgcgguggaggaacugccugagacgauggaaaccuuauugcugcucggccugaugauacuucugacuggaggcgccaugcucuucuugaucuccgggaaaggaauugguaagacaaguaucggccugauuugugugaucgcaucuagcgggauguuauggauggcugagauaccccuacaauggauugccuccgccaucguccuggaguuuuucaugaugguucuccuuauuccagaaccugagaagcagcgcaccccgcaggacaaucaacuggcauacgugguaaucggaauauugacccuggcugccaucauugcggcuaacgaaaugggccuccuggagacaacuaaacgagaucuugguaugucaaaggaacccgggguggucucuccaacgagcuaucucgacguggaucugcauccugccagugcauggaccuuguacgccguugcuacaacugugaucacccccaugcugagacacacaauugagaauuccaccgcaaacgucagcuuagccgcgaucgcuaaccaggccguagugcuaaugggccuggacaaaggauggccaauaucuaagauggaccucggcguuccucuucuggcauuggggugcuacucacaggugaauccccugacucucacggccgcuguccugcuuuuaauuacacauuaugccaucaucggaccgggccugcaggcaaaagcuaccagggaggcccaaaagcggacugcggccgguauuaugaagaacccaaccguggaugggaucaugacaauagaccucgauccugucauuuacgacuccaaauuugaaaagcaguugggacaggugaugcugcuaguucugugugcagugcagcuccuucugaugcgcacuaguugggcuuugugcgaggcccugacccucgcaacaggccccguaacgacccugugggaagguagcccaggcaaauucuggaauacuacaaucgcugugucgauggccaacauuuuuagagggucuuauuuagccggagcgggccuugcuuucuccaucaugaagagcgucgggaccggaaaaaggggcacugguucacaaggggagacacugggagaaaaguggaagaaaaagcucaaucagcuaagucggaaagauuuugaccuguacaagaaaucuggcauaaccgagguugaucgaacggaggcaaaggaagguuugaaaagaggcgagaucacccaccaugccgugucccgcgggagcgcuaagcugcagugguucgucgaaaggaacauggugauucccgagggacggguaaucgaccucggcugugggcguggaggcuggucauauuacugcgccggucuuaagaaagugacagaaguuagaggguauacuaagggaggcccuggccacgaggagccggugcccaugaguaccuacggguggaauauugucaaacugaugagcggaaaggauguguuuuacuugccaccugaaaaaugugacacacugcucugcgauaucggugaguccucucccagcccuacugucgaagaguccaggaccauucgcguguuaaagaugguugagccauggcugaagaacaaucaguucuguaucaaaguacuuaaccccuauaugccuacagugauagaacaccuggagcggcuacaacgaaagcauggcgggaugcucgucagaaauccacugucaaggaacucuacccacgaaauguacuggauuaguaauggaacuggcaacaucguggcaucgguuaauauggugagccgcuugcugcucaaccgguucacgaugacacauagacgucccaccaucgagaaagacgucgaucuuggugccgggacuaggcacgugaacgcugaaccggagaccccuaauauggacguaauuggagagcggauaaagcgcaucaaagaagagcacaacuccacauggcauuaugacgaugaaaauccauacaagacgugggcguaucacggcucuuacgaggugaaggccaccggcucagcaagcuccaugauuaacgggguugucaaacuguuaacuaagcccugggacguggugccuauggucacacagauggcuaugaccgauacuacaccauuuggacagcaacgaguuuucaaagaaaagguggacaccagaacacccaggaguaugccggguacucggcgcguaaugggcaucaccgccgaguggcuguggagaacguuggggaggaauaaaaagccucgacucugcacccgggaggaauuuacaaagaaagugcguacuaacgcagccaugggagcugucuucaccgaggaaaaucagugggauucugccaaggcggcaguggaggacgaagauuuuuggaaacugguugacagagagcgcgagcuacauaagcuuggcaaaugugguagcugcguguauaacaugauggggaagagggaaaaaaagcugggagaguucggcaaggccaaaggcucacgggcuauuugguacauguggcucggggccagauaccuggaauuugaggcauugggauuccugaaugaggaucacugguuuucccgcgaaaacaguuauagcggugucgagggcgaagggcuccauaagcuuggauacauccugagggacauaucuaaaauccccggcggugcuauguaugccgaugacacagcugggugggacacucgaauuaccgaggaugacuuacacaaugaagagaagaucacgcagcagauggauccagagcaccggcaacuggccaacgcaauuuucaaauugacauaccagaauaaggugguaaagguucagagaccuacccccacuggaacagugauggacaucauauccaggaaagaucagcgcggcucaggccaagucgggaccuauggacucaacacuuuuaccaauauggaagcgcagcugauucgucagauggagggugaaggcgugcuaagcaaggccgaccuugagaacccacaucugcccgaaaaaaagaucacacaguggcucgagacgaaagggguggagcggcugaagagaauggcuaucucgggagaugacugcgucguuaagccuauugaugacagguucgccaacgcauuguuagcucugaaugauaugggcaaagugcgcaaggacauaccacaauggcagccgucuaaagguuggcacgauuggcagcagguacccuuuuguagucaucacuuccacgaacucaucaugaaggacgggcgaaaacuuguggucccuugccggccacaagacgagcugauuggaagagccaggaucucccagggcgcaggcuggagccuaaaggaaaccgccugucuggggaaggcguacgcucagauguggucacucauguauuuccaucgcagagauuugcggcuggccuccaacgcaauuugcucugccgugcccguucacugggugccuacuagcaggacaaccuggaguauccaugcucaccaucaauggaugacuacagaggacaugcuuaccgucuggaaucguguguggauagaagauaacccauggauggaggacaaaacgcccguaacaaccugggagaauguuccuuaccugggaaagcgagaagaucaguggugugguucccucaucggcuuaacuagccgcgccaccugggcacagaacauuccgacagcuauccagcaagugagaucucugauugggaaugaggaauuuuuggacuacaugccaucaaugaaacgguucaggaaggaggaggaaagugagggagccaucugguga

SEQ ID NO: 15272 - RNA, 9873 nt, Artificial Sequence
  derived and/or modified CDS sequence (opt3) from DENV-3__GQ199863__SS-prME
accagccugugccucaugaugauccuucccgcagcucuggcauuccacuugacuuccagagacggcgaaccuaggaugauuguggggaagaacgaacggggaaaaucuuuacuguuuaagacugccucagguauaaauauguguacgcuaaucgcgauggaucucggcgaaaugugcgacgauaccgucacauacaaauguccacauauuacugaaguugaaccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggucauccucccagaauauggaacucuuggccuggagugcucuccgcgaaccgguuuggacuucaaugagaugauccuacugacaaugaaaaacaaggccuggauggugcauagacagugguuuuucgaucucccccugccuuggaccagcggggcgacuacagaaacgccaaccuggaauaggaaagagcuucugguaacuuuuaagaacgcccacgccaagaaacaagaaguuguggucuugggcucccaggagggagcuaugcacacagcccucaccggcgcuacagaaauucaaaauucagggggaacaaguauauucgccggucaucugaagugucgguuaaaaauggacaagcuggagcuaaaaggcaugagcuacgcaaugugcaccaacacguuugugcucaagaaagaggucucugaaacccagcacgggacaauccugauuaagguggaguacaagggagaagauguucccuguaaaaucccuuucuccacugaggacggccaagguaaggcccauaacgggcgucuuauaaccgcuaauccagugguaacuaagaaggaggaacccgucaacauugaggcggaaccgccuuucggcgagucaaauaucgugaucggaauuggcgauaacgcauugaaaaucaauugguauaagaaggggagcaguauuggaaaaauguuugaagccacugcucgcggugccagaaggauggcaauacugggcgacaccgccugggauuucgggucuguuggaggcgugcucaacucccuggguaagaugguccaccagaucuuugggagcgcuuacacggcccuuuucucgggcgugucuuggguaaugaaaauuggaaucggcgugcuguugacauggaucgggcucaauuccaagaacaccucaaugaguuuuagcugcauugcaauaggaaucauuacucuguauuuaggcgcgguuguccaggcugacauggguugugugaucaauuggaaagggaaggagcugaagugcggauccggcauuuucgugacaaacgagguccauaccuggacugaacaguacaaauuucaagccgauucucccaagcggcuagcaaccgccaucgcuggugccugggagaauggcguuugugggauacgaagcacaacgcgcauggaaaaccuccuguggaaacagaucgcaaaugagcuuaacuauauuuugugggaaaauaacaucaagcugaccguggugguaggagacauuaucggcguccucgagcaggggaaaagaacucugacaccacagccuauggaguuaaaguacucauggaaaaccuggggaaaggcuaagauagugacagccgaaacucaaaacaguuccuucauuaucgauggccccaauaccccagagugccccagcguuucuagggcguggaacgugugggaagucgaggacuaugguuuugggguguucacgacaaauauuuggcugaaacuucgggaaguuuacacccaguugugugaccaccgccucaugucagccgcugugaaggaugagagagcaguacacgccgacaugggauacuggaucgagagucagaaaaacggcagcuggaagcuggaaaaggcuucccuaauagaggucaagacuugcaccuggccuaagucucauacacuguggucgaauggugugcucgaaagcgauaugaucauuccaaaaucccuggccggcccgaucucacagcacaaccauaggcccggguaucacacucaaaccgcaggaccuuggcaccuuggcaaguuggagcuggacuuuaauuacugcgaggggacaacgguggucauuaccgaaaacuguggaacucguggcccaaguuuacggacaaccacuguuucugguaaacucauccaugaguggugcugucgaagcugcacacugcccccucuuagauauaugggggaagauggauguugguacggcauggagauaaggccaauuuccgaaaaggaggagaauauggugaaaucacugguaagcgcggguucuggcaagguggacaacuucaccaugggggucuugugccucgccauccuguuugaagaggugaugcgcggaaaguucggcaaaaagcacaugaucgcugggguuuucuuuacguucgugcuacugcucuccggacagauuacuuggcgggauauggcccauacccugaucaugauuggcaguaaugcaagcgacagaauggguaugggggucacauaucuugcuuugauagccaccuuuaaaauccagcccuuccuggcauuaggauuuuuccucaggaagcugacuucucgcgaaaaccuucugcuaggcgugggccucgccauggcuacaacccugcaauugccggaggauauugaacagauggcgaaugggaucgcccugggauuaauggcacucaaacugauuacacaguuugagacuuaccagcuuuggaccgcucugaucuccuugacguguucaaacacaauauucacccucacuguugccuggcgaaccgccacacugauccuagcuggugugagucugcuuccugucugccaaagcucguccaugcggaagacugacuggcucccaauggcaguagccgcgaugggcgugcccccucugcccuuguuuauuuucucucugaaggauaccuuaaaacguagaagcuggccacucaaugaggggguuauggcugugggacuggucucaauccuugccaguucccuguugaggaacgacgugccuauggcaggcccccucguagccggugggcugcuaauugcuuguuaugugaucacgggaacaucugcagaucugaccgucgaaaaggccgcggacauaacuugggaggaagaggcugaacagacaggcguuagccacaaccuuaugauuaccguggacgaugacggcacuaugcgcaucaaagaugacgagacagagaauauccucaccgugcuguugaagacggccuuacugauugucuccgggauauuuccauacucaaucccggcaacucuccugguguggcauaccuggcagaaacagacacaacggagcggaguucuuugggauguaccuagucccccagaaacccagaaggccgagcuggaagaggguguguacagaauuaaacagcagggcaucuucgggaagacacaagucggagugggcguucagaaggaggguguguuucacacuauguggcacgucaccagaggggcuguguugacguauaacggaaaacgacuagaacccaauugggccucuguaaagaaagaccugauuuccuacggcggcggguggcgccucagcgcacaguggcaaaagggagaggaaguccaggugaucgcuguugagccugguaaaaacccaaagaauuuccagacaaugcccggcacuuuccagaccacaaccggggaaauaggagccaucgcgcuggauuuuaagccuggcacuucggguucaccgauuaucaaccgggaggggaaaguggucggacuuuauggcaauggcgugguuaccaagaacgggggauacgugucugguauugcccaaacaaaugcagagccagacggccccacgccugaauuagaggaagagauguucaaaaagagaaaccugacuaucauggaucuccauccagggaguggaaaaaccaggaaguauuugcccgcuauaguccgugaagccauuaagcgccggcugagaacacucauccuggcuccuaccagggugguagcagccgagauggaggaagcccuuaaaggccugccgauccgauaccagacuacagcuaccaaguccgagcacacgggucgggaaauuguggacuugaugugccaugcgacuuuuacaaugcgccuacugagccccguuagagucccaaauuauaaccucaucauaauggaugaggcacacuucaccgacccugccucuauugcugccaggggguacaucagcacccgggugggaaugggcgaagcagccgcuauuuuuaugacugcgacacccccaggcaccgccgaugcauucccucaguccaaugcucccauccaggacgaggagcgagacauaccagaaagaucauggaacagugggaaugaguggauuacagauuuugccggaaaaacugugugguucgucccgagcaucaaggcagguaacgacaucgccaacuguuuacgcaaaaauggcaagaagguaauucaacugucuaggaaaacguuugauaccgaauaccagaagacaaaacuuaacgacugggauuucgugguuacuaccgacaucuccgagaugggggcuaauuuuaaggccgaucgugugauugacccucggagaugccugaaacccgucauacucacagauggaccagagagggugaucuuggcgggccccaugccuguuaccgcagccucagcugcccagcgccgagguagaguggggcggaacccacagaaggaaaaugaccaauauauuuucacuggccagccccugaacaaugaugaggaccaugcucacuggacggaagcaaagaugcuccuggacaacaucaauaccccugagggaaucauuccggcccuuuucgaaccagagagggagaaaagugcugccauagauggcgaauaccgccuaaagggggagagccguaaaacauuugucgaacugaugagacggggagacuugcccgugugguuagcacacaagguagcguccgaggguaucaaauauacugauaggaaguggugcuucgacggccagcgcaacaaucagauucuggaagagaacauggauguggagaucuggaccaaagaaggggagaagaagaaacuccgaccuagauggcuggacgcccggauuuacucugauccccuugcucugaaggaauuuaaagaguucgccgcaggaaggaagucgaucgcucucgacuugguuacagaaauaggccgcgucccaagccaucuggcccacagaaccaggaaugcacuagauaaccuggugaugcuccauacuucagagcacggugggcgggccuaucgucacgcuguggaggaacuuccugagacaauggaaacgcuguuauugcugggccucaugauccugcuuaccggaggcgcgaugcuguuucucauuuccgggaaaggaaucgguaagacaaguauuggcuugaucugugucauagccucuagcgggaugcuguggauggcagagauucccuuacaauggaucgcuuccgccauuguucuagaguucuuuaugauggugcugcucaucccagaaccugagaagcagcgcacaccgcaggacaaucaacuugccuacguagugauaggaauccugaccuuggcagcuauuaucgccgcgaacgaaaugggccugcucgagaccacaaaacgagaucuggguaugucaaaggaacccggggucgugucuccaacuagcuaucuugacguugaucuccauccugcuagugccuggacgcuguacgcaguggccaccacagucauuacucccauguugagacacaccaucgaaaauuccacagcuaacguaagccuggcagccauagcgaaccaggcugugguuuuaaugggccuagacaaaggauggccaauuucuaagauggaccugggcgugccucuccuugcccuggggugcuacucacaggucaaucccuugacccugacugcagccgugcuccugcuuaucacgcauuaugcuaucauuggaccgggcuuacaggccaaagcaacaagggaggcucaaaagcggaccgccgcggguaucaugaagaacccaacugucgaugggauaaugaccauugaccuggauccugugaucuacgacuccaaauucgaaaagcagcucggacagguuauguugcuggugcuaugugccguacagcugcuccuuaugcgcacaaguugggcacugugcgaggcuuugacucuggccaccggccccauuacaacgcucugggaagguagcccaggcaaauuuuggaauaccacuaucgcagugucgauggcuaacauauucagagggucuuaucuggccggagccggcuuagcguuuuccaucaugaaaagcgucgggacaggaaaaaggggcaccgguucacaaggggagacucuuggagaaaaguggaagaaaaagcugaaucagcucagucggaaagauuucgaccuauacaagaaaucuggcauuacagagguugaucgaaccgaggcuaaggaaggucugaaaagaggcgagaucacgcaccaugcagugucccgcgggagcgccaaguugcagugguuugucgaaaggaacauggugauucccgagggacggguaaucgaccugggcugugggcguggaggcuggucauauuacugcgcuggucucaagaaagugaccgaaguuagaggguauacaaagggaggcccuggccacgaggagccggugcccaugaguacuuacggguggaauauugucaaacuuaugagcggaaaggauguguucuaccugccaccugaaaaaugugacaccuugcugugcgauaucggugaguccucucccagcccuacagucgaagaguccaggacuauacgcgugcucaagaugguugagccaugguuaaagaacaaucaguucuguauuaaaguacugaaccccuauaugccuaccgugaucgaacaccuugagcggcugcaacgaaagcauggcgggaugcuagucagaaauccacucucaaggaacucuacacacgaaauguacuggaucaguaauggaaccggcaacauuguggccucgguuaauauggugagccgccuguugcugaaccgguuuacuaugacgcauagacgucccacaauagagaaagacgucgaucucggugcagggaccaggcacgugaacgccgaaccggagacuccuaauauggacguaaucggagagcggauuaagcgcaucaaagaagaacacaacuccaccuggcauuaugacgaugaaaauccauacaagacaugggcuuaucacggcucuuacgaggugaaggcgacgggcucagccagcuccaugauuaacgggguugucaaacuucugaccaagcccugggacguggugccuauggucacucagauggcaaugacagauaccacuccauucggacagcaacgaguuuuuaaagaaaagguggacacaagaacccccaggaguaugccggguacacggcgcguaaugggcaucacugcugagugguuauggagaacccuggggaggaauaaaaagccucgauugugcacgcgggaggaguucaccaagaaagugcguacaaacgccgcaaugggagccgucuuuacugaggaaaaucagugggauucugcuaaggccgcgguggaggacgaagauuucuggaaacucguugacagagagcgcgagcugcauaagcuaggcaaaugugguagcugcguguauaacaugauggggaagagggagaagaaacuuggagaguuuggcaaagcaaaaggcucacgggccauaugguacauguggcugggggcuagauaccucgaguucgaggcccugggauuuuugaaugaggaucacugguucucccgcgaaaacaguuauagcggugucgagggcgaagggcugcauaagcucggauacauccuuagggacauuucuaaaauccccggcggugcaauguaugcugaugacaccgccgggugggacacacgaauuacugaggaugaccugcacaaugaagagaagaucacccagcagauggauccagagcaccggcaauuagcuaacgccauauuuaaacugacguaccagaauaaggugguaaagguucagagaccuacacccaccggaacugugauggacauuaucuccaggaaagaucagcgcggcucaggccaagucgggacauauggauugaacaccuucacuaauauggaagcacagcucauccgucagauggagggugaaggcgugcugagcaaggcggaccuagagaacccacaucuucccgagaaaaagauuacccaguggcuggagacaaaagggguggagcggcucaagagaauggccauaucgggagaugacugcgucguuaagccuaucgaugacagguuugcuaacgcccuguuggcauuaaaugauaugggcaaagugcgcaaggacauuccacaauggcagccgucuaaagguuggcacgauuggcagcagguacccuucuguagucaucacuuccacgaacugaucaugaaggacgggcgaaaacucguggucccuugccggccacaagacgagcuuauuggaagggcuaggaucucccagggcgccggcuggagccugaaggaaacggcaugucuagggaaggccuacgcgcagauguggucacugauguauuuucaucgcagagaucuccgguuggcuuccaacgccauaugcucugcagugcccguucacugggugccuaccagcaggacuacauggaguauccaugcccaccaucaauggaugaccacugaggacaugcugacagucuggaaucguguguggauugaagauaacccauggauggaggacaaaacccccguaacgacaugggagaauguuccuuaccuuggaaagcgagaagaucaguggugugguucccugaucggccucaccagccgcgcuacuugggcccagaacauuccgaccgcaauccagcaagugagaucuuuaauugggaaugaggaguuccuggacuacaugccaucaaugaaacgguuuaggaaggaggaggaaagugagggagcuauaugguga

SEQ ID NO: 15273 - RNA, 9873 nt, Artificial Sequence
  derived and/or modified CDS sequence (opt3) from DENV-3__GQ199864__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucugaacacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaauagagauuuuguugaaggauugucaggugccaccuggguggacgucgugcuggagcacggcgggugcgugacgacuauggcgaagaacaaacccacacuagauauugagcuccagaagaccgaagcaacucaacuggccacacuuaggaaacuguguaucgagggaaagauuaccaauaucacgaccgacagccggugcccuacacagggcgaagcuacuuugccagaggaacaggaucagaacuaugucuguaaacacaccuacguugaccgcgguugggggaauggaugcggccucuucggcaaggggagucuggugacaugcgccaaguuucaauguuuagagcccauagagggaaaaguagugcagcaugaaaaccugaaguauacugucauuaucaccgugcacacaggugaucagcaucagguuggcaaugagacccaaggggugacugcagaaauuacgccucaggcuuccacaaccgaggccauccucccagaauacggaacucuuggccuggagugcucuccgcgaaccgguuuggacuucaacgagaugauccuacugacaaugaaaaauaaggcguggaugguccacagacagugguuuuucgaccucccccugccuuggaccagcggggccacuacagaaacgccaaccuggaacaggaaagagcuucuggugacuuuuaagaaugcacacgcuaaaaagcaagaaguaguuguguugggcucccaggagggagccaugcauacagcucucaccggcgccacagaaauucagaacucagggggaacuaguauauucgcaggucaccugaagugucgguuaaaaauggauaagcuggagcuaaaaggcaugagcuaugccaugugcaccaacacguuuguccucaagaaagaggugucugaaacccagcaugggacaauccugauuaaggucgaguacaagggagaagacgugcccuguaaaaucccuuucuccacugaggauggccaagguaaggcucacaaugggcgucuuauaaccgcgaacccaguugugacaaaaaaggaggaacccguaaauauugaggcagaaccgccuuucggcgagucaaacaucgucaucggaauuggcgacaaugccuugaaaaucaacugguacaagaaggggagcaguauuggaaaaauguuugaagcuacugcccgcggugcaagaaggauggccauacugggcgauaccgcuugggacuucgggucugugggaggcguucucaauucccuggguaagauggugcaucagaucuuugggagcgccuauacggcacuuuucucgggcgucucuugggugaugaaaauuggaaucggcguacuguugacauggaucgggcucaacuccaagaauaccucaaugaguuuuagcugcauugcgauaggaaucauuacucuguacuuaggcgcugugguucaggccgauauggguugugucaucaacuggaaagggaaggagcugaagugcggauccggcauuuucgugacaaaugaggugcacaccuggacugaacaguauaaauuucaagcagacucucccaagcggcuagccaccgcuaucgccggugcaugggagaacggcgucugugggauacgaagcacaacgcgcauggaaaaucuccuguggaaacagaucgcuaacgagcuuaauuacauuuugugggaaaacaacaucaagcugaccguuguggugggagauauuaucggcguacucgagcaggggaaaagaacucugacaccacagccuauggaguuaaaguauucauggaaaaccuggggaaaggccaagauagucacagcggaaacucaaaauaguuccuucauuaucgacggccccaacaccccagagugccccagcgugucuagggccuggaauguuugggaaguggaggauuacgguuuuggggucuucacgacaaacauuuggcugaaacuucgggaaguguauacccaguugugugaccaccgccucaugucagcugcaguuaaggacgagagagccgugcaugcugauaugggauacuggaucgagagucagaaaaauggcagcuggaagcuggaaaaagccucccuaauagagguaaagacuugcaccuggccuaagucucacacacuguggucgaacgguguccucgaaagcgacaugaucauuccaaaaucccuggcaggcccgaucucacagcauaaucacaggcccggguaccacacucaaaccgcgggaccuuggcaucuuggcaaguuggagcuggauuuuaacuauugcgaggggacaacgguggugauuaccgaaaauuguggaacucguggcccaaguuuacggacaaccacugucucugguaaacucauccacgaguggugcugucgaagcugcacacugcccccucuuagauacaugggggaagacggauguugguauggcauggagauaaggccaauuuccgaaaaggaggagaacaugguuaaaucacuggugagcgccgguucuggcaagguagauaauuucaccaucgggguguugugccucgcuauccuguuugaagaggucaugcgcggaaaguucggcaaaaagcauaugauugccgggguguucuuuacguucguucuacugcucuccggacagaucacuuggcgggacauggcacacacccugauuaugauaggcaguaacgcuagcgauagaauggguaugggggugacauaccuugccuugaucgcaaccuuuaaaauucagcccuuccuggccuuaggauuuuuccucaggaagcugacuucucgcgaaaaucuucugcuaggcgucggccucgcuauggcgacaacccugcaauugccggaggacaucgaacagauggccaacgggauugcacugggauuaauggcucucaaacugaucacacaguuugagacuuaucagcuuuggaccgcccugauauccuugacguguucaaauacaaucuucacccucacuguggccuggcgaaccgcuacacugauucuagcagguguuagucugcuuccugugugccaaagcucguccaugcggaagacugauuggcucccaauggccgucgcggcuaugggcguacccccucugcccuuguuuaucuucucucugaaggacaccuuaaaacguagaagcuggccacucaacgagggggugauggccguuggacuggugucaauucuugcaaguucccuguugaggaacgaugucccuauggccggcccccucguggcuggugggcugcuaaucgcauguuacguaauaacgggaacaucugccgaccugaccguggaaaaggcggcugauauuacuugggaggaagaggccgaacagacaggcgucagccauaaucuuaugaucaccguugacgacgauggcacuaugcgcaucaaagacgaugagacagagaacauucucaccgugcuguugaagacggcauuacugauaguguccgggaucuuuccauauucaauuccggccacucuccuggucuggcacaccuggcagaaacagacacaacggagcggagugcuuugggacguuccuagucccccagaaacccagaaggcugagcuggaagaggguguauacagaaucaaacagcagggcauuuucgggaagacacaagugggagucggcgugcagaaggaggguguuuuucacacuauguggcaugugaccaggggggccgucuugacguacaauggaaaacgacuagaacccaacugggcaucugugaagaaagaucugaucuccuauggcggcggguggcgccucagcgcucaguggcaaaagggagaggaaguacaggucauagccguggagccugguaaaaauccaaagaacuuccagacaaugcccggcacuuuccagaccacaaccggggaaaucggagcgauugcccuggacuuuaagccuggcacuucggguucaccgaucauuaaucgggaggggaaaguugugggacuuuacggcaacggcgucgugaccaagaaugggggauauguuucugguaucgcacaaacaaacgcugagccagauggccccacgccugaauuagaggaagagauguucaaaaagagaaaucugacuauaauggaccuccacccagggaguggaaaaaccaggaaguacuugcccgccauugugcgugaagcuaucaagcgccggcugagaacacucauccuggcaccuaccagggucguggccgccgagauggaggaagcucuuaaaggccugccgauucgauaucagacuacagcgaccaaguccgagcauacgggucgggaaaucguagauuugaugugccacgcaacuuuuacaaugcgccuacugagccccgugagaguuccaaacuacaaucucauaauuauggacgaggcccauuucaccgauccugcuucuaucgccgcaaggggguauauuagcacccgggucggaaugggcgaagccgcugcgaucuuuaugacugccacacccccaggcaccgcagacgcuuucccucaguccaacgcccccauacaggaugaggagcgagacauuccagaaagaucauggaauagugggaacgaguggaucacagacuuugcaggaaaaacugugugguucgugccgagcaucaaggccgguaacgauauugcuaauuguuuacgcaaaaacggcaagaaggucauccaacugucuaggaaaacguuugacaccgaauaccagaagacaaaacuuaaugauugggacuucguagugacuaccgauauuuccgagaugggggccaacuuuaaggcggaccguguuauagauccucggagaugccugaaacccgugauccucacagacggaccagagagggucauuuuggcaggccccaugccugugaccgccgcuucagccgcucagcgccgagguagaguugggcggaauccacagaaggaaaacgaucaauacaucuucacuggccagccccugaauaacgacgaggaucacgcacacuggacggaagccaagaugcuccuggacaauaucaacaccccugagggaauuauaccggcucuuuucgaaccagagagggagaaaagugccgcaaucgacggcgaauaucgccuaaagggggagagccguaaaacauuuguggaacugaugagacggggagauuugcccgucugguuagcgcauaagguggccuccgaggguauuaaauacacugacaggaaguggugcuucgauggccagcgcaauaaccagauccuggaagagaauauggacguagagauuuggaccaaagaaggggagaagaagaaacuccgaccuagauggcuggaugcucggacauauucugacccccuugcccugaaggaauuuaaagaguucgcagcuggaaggaagucgaucgcccucgauuuggugaccgaaauaggccgcguuccaagccaccuggcacauagaacuaggaacgcccuagacaaucuggucaugcuccacacaucagagcacggugggcgggcuuaccgucaugcgguggaggaacuuccugagacgauggaaacccuguuauugcugggccucaugauccugcuuacuggaggcgccaugcuguuucucauuuccgggaaaggaaucgguaagacaaguauuggcuugaucugugugauagcaucuagcgggaugcuguggauggcugagauucccuuacaauggaucgccuccgccauuguccuagaguucuuuaugaugguucugcucaucccagaaccugagaagcagcgcaccccgcaggauaaccaacuugcauaugugguaauaggaauccugaccuuggcugccauuaucgcggcuaaugaaaugggccugcucgagacaacuaaacgagaccuggguaugucaaaggaacccgggguggucucuccaacgagcuaccuugauguggaccuccacccugccagugcauggacccuguaugccguugcuacaacugugauuacccccauguugagacauacaaucgagaacuccaccgcaaacgucagccuggccgcgauagcuaaucaggccguaguguuaaugggccuagauaaaggauggccaauuucuaagauggaccugggcguuccucuccuugcacuggggugcuacucacaggugaaccccuugacucugacggccgcuguccuccugcuuaucacacacuacgccaucauuggaccgggcuuacaggcaaaagcuaccagggaggcccaaaagcggacugcggccgguaucaugaagaauccaaccguggacgggauaaugacaauugaucuggacccugucaucuaugauuccaaauucgaaaagcagcucggacaggugauguugcugguucuaugugcagugcagcugcuccuuaugcgcacuaguugggcucugugcgaggccuugacccuggcaacaggccccauuacgacccucugggaagguagcccaggcaaauuuuggaacacuacaaucgcuguaucgauggccaauauauucagagggucuuaccuggccggagcgggcuuagcuuuuuccaucaugaagagcguggggaccggaaaaaggggcacugguucacaaggggagacacuuggagaaaaguggaagaaaaagcugaaccagcucagucggaaagacuucgaucuauauaagaaaucuggcauuaccgaggucgaccgaacggaggcaaaggaaggucugaaaagaggcgagaucacccaucacgccguuucccgcgggagcgcuaaguugcagugguuuguggaaaggaauauggucauucccgagggacgggugaucgaucugggcugugggcguggaggcuggucauacuauugcgccggucucaagaaaguaacagaagugagaggguacacuaagggaggcccuggccacgaggagccgguucccaugaguaccuauggguggaacauugugaaacuuaugagcggaaaggacgucuucuaccugccaccugaaaaaugugauacauugcugugcgacaucggugaguccucucccagcccuacuguggaagaguccaggaccauacgcguccucaagaugguggagccaugguuaaagaauaaccaguucuguauuaaaguucugaaucccuacaugccuacaguaaucgaacaucuugagcggcugcaacgaaagcacggcgggaugcuagugagaaacccacucucaaggaauucuacccaugaaauguauuggaucaguaacggaacuggcaauauugucgcaucggugaacaugguuagccgccuguugcugaaccgguuuacgaugacacacagacgucccaccauagagaaagauguggaccucggugccgggacuaggcacgucaaugcugaaccggagaccccuaacauggaugugaucggagagcggauuaagcgcaucaaagaagagcauaauuccacauggcacuacgacgacgaaaacccauauaagacgugggcguaccauggcucuuaugagguaaaggccaccggcucagcaagcuccaugauuaauggggugguuaaacuucugacuaagcccugggaugucgugccuauggugacacagauggcuaugaccgacacuacaccauucggacagcaacgagucuuuaaagaaaagguugauaccagaacacccaggaguaugccggguacucggcgcgugaugggcaucaccgccgagugguuauggagaacgcuggggaggaacaaaaagccucgauugugcacccgggaggaauucacaaagaaaguacguacuaaugcagccaugggagcuguguuuaccgaggaaaaccagugggacucugccaaggcggcagucgaggaugaagacuucuggaaacucguggauagagagcgcgagcugcacaagcuaggcaaaugugguagcugcguuuacaauaugauggggaagagggaaaaaaagcuuggagaguuuggcaaggccaaaggcucacgggcuauaugguauauguggcugggggccagauaccucgaauucgaggcacugggauuuuugaacgaggaccauugguucucccgcgaaaauaguuacagcgguguggagggcgaagggcugcacaagcucggauauauccuuagggauauuucuaaaauccccggcggugcuauguacgccgacgauacagcugggugggacacucgaauuaccgaggacgaucugcacaacgaagagaagaucacgcagcagauggacccagagcaucggcaauuagccaaugcaauauuuaaacugacauaucagaacaaggucgugaagguacagagaccuacccccacuggaacaguuauggauauuaucuccaggaaagaccagcgcggcucaggccaaguggggaccuacggauugaauacuuucaccaacauggaagcgcagcucauccgucagauggagggugaaggcguccugagcaaggccgaucuagagaacccacaccuucccgaaaaaaagauuacacaguggcuggagacgaaagggguggagcggcucaagagaauggcuauaucgggagacgauugcguggucaagccuaucgacgauagguuugccaaugcacuguuggcuuuaaacgacaugggcaaaguucgcaaggauauuccacaauggcagccgucuaaagguuggcaugacuggcagcaggugcccuucuguagucaccacuuccaugaacugaucaugaaggaugggcgaaaacucguagugccuugccggccacaagacgagcuuauuggaagagccaggaucucccagggcgcaggcuggagccugaaggaaaccgccugucuagggaaggcguaugcucagauguggucacugauguacuuucaccgcagagaccuccgguuggccuccaaugcaauaugcucugccguccccgugcauuggguuccuacuagcaggacaaccuggaguauccacgcucaucaccaauggaugacuacagaggauaugcugaccguguggaaccgugucuggauugaagacaauccauggauggaggauaaaacgcccgugacaaccugggagaacguaccuuaucuuggaaagcgagaagaccaguggugugguucccugaucggccucacuagccgcgccaccugggcacagaauauuccgacagcuauccagcaaguuagaucuuuaauugggaacgaggaauuccuggauuacaugccaucaaugaaacgguuuaggaaggaggaggaaagugagggagccauaugguga

SEQ ID NO: 15274 - RNA, 9873 nt, Artificial Sequence
  derived and/or modified CDS sequence (opt3) from DENV-3__GQ199865__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcagcaugaaaaucugaaguauacugucauuaucaccgugcacacaggugaccagcaucagguuggcaacgagacccaaggggugacugcagaaauuacgccucaggcuuccacaaccgaggccauccucccagaauacggaacucuuggccuggagugcucuccgcgaaccgguuuggacuucaaugagaugauccuacugacaaugaaaaacaaggcguggaugguccacagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcauacagcucucaccggcgccacagaaauucagaauucagggggaacuaguauauucgcaggucaccugaagugucgguuaaaaauggacaagcuggagcuaaaaggcaugagcuaugccaugugcaccaacacguuuguccucaagaaagaggugucugaaacccagcaugggacaauccugauuaaggucgaguacaagggagaagaugugcccuguaaaaucccuuucuccacugaggacggccaagguaaggcucacaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguacaagaaggggagcaguauuggaaaaauguuugaagcuacugcccgcggugcaagaaggauggccauacugggcgacaccgcuugggauuucgggucugugggaggcguucucaacucccuggguaagauggugcaucagaucuuugggagcgccuauacggcacuuuucucgggcgucucuugggugaugaaaauuggaaucggcguacuguugacauggaucgggcucaauuccaagaacaccucaaugaguuuuagcugcauugcgauaggaaucauuacucuguacuuaggcgcugugguucaggccgacauggguugugucaucaauuggaaagggaaggagcugaagugcggauccggcauuuucgugacaaacgaggugcacaccuggacugaacaguauaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuacauuuugugggaaaauaacaucaagcugaccguuguggugggagacauuaucggcguacucgagcaggggaaaagaacucugacaccacagccuauggaguuaaaguauucauggaaaaccuggggaaaggccaagauagucacagcggaaacucaaaacaguuccuucauuaucgauggccccaauaccccagagugccccagcgugucuagggccuggaacguuugggaaguggaggacuacgguuuuggggucuucacgacaaauauuuggcugaaacuucgggaaguguauacccaguugugugaccaccgccucaugucagcugcaguuaaggaugagagagccgugcaugcugacaugggauacuggaucgagagucagaaaaacggcagcuggaagcuggaaaaagccucccuaauagagguaaagacuugcaccuggccuaagucucacacacuguggucgaaugguguccucgaaagcgauaugaucauuccaaaaucccuggcaggcccgaucucacagcauaaccacaggcccggguaccacacucaaaccgcgggaccuuggcaucuuggcaaguuggagcuggacuuuaauuauugcgaggggacaacgguggugauuaccgaaaacuguggaacucguggcccaaguuuacggacaaccacugucucugguaaacucauccacgaguggugcugucgaagcugcacacugcccccucuuagauacaugggggaagauggauguugguauggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcauaugaucgccgggguguucuuuacguucguucuacugcucuccggacagauuacuuggcgggauauggcacacacccugaucaugauuggcaguaaugcuagcgacagaauggguaugggggugacauaccuugccuugauagcaaccuuuaaaauccagcccuuccuggccuuaggauuuuuccucaggaagcugacuucucgcgaaaaccuucugcuaggcgucggccucgcuauggcgacaacccugcaauugccggaggauauugaacagauggccaaugggaucgcacugggauuaauggcucucaaacugauuacacaguuugagacuuaucagcuuuggaccgcccugaucuccuugacguguucaaacacaauauucacccucacuguggccuggcgaaccgcuacacugauccuagcagguguuagucugcuuccuaugugccaaagcucguccaugcggaagacugacuggcucccaauggccguggcggcuaugggcguccccccucugcccuuguuuauuuucucucugaaggauaccuuaaaacguagaagcuggccacucaaugaggggguaauggccgugggacugguuucaauccuugcaaguucccuguugaggaacgacgugccuauggccggcccccucgucgcuggugggcugcuaauugcauguuacgugaucacgggaacaucugccgaucugaccguagaaaaggcggcugacauaacuuggggcgaggaagccgagcagacaggcgugagccauaugcuuaugauuaccgucgaagacgaugggacuaugcgcaucaaagacgaugagacagagaacauccucaccguucuguugaagacggcauuacugauuguguccggaauauuuccauauucaaucccggccacucuccugguguggcacaccuggcagaaacagacacaacggagcgguguccuuugggacgugccuagucccccagaaacccagaaggcugagcuggaagagggcguuuacagaauuaaacagcaggggaucuucggaaagacacaaguaggcguggguguccagaaggaggggguguuucacacuauguggcauguuaccaggggagccguguugacguacaauggcaaacgacuagaacccaacugggcaucugucaagaaagaucugauuuccuauggcgggggauggcgccucagcgcucaguggcaaaagggugaggaagugcagguaaucgccgucgagccuggcaaaaauccaaagaacuuccagacaaugcccgggacuuuccagaccacaaccggagaaauaggcgcgaucgcccuggacuuuaagccugguacuucggggucaccgauuaucaaucgggagggaaaagugguuggccuuuacggcaacgggguggucaccaagaauggagguuaugugucuggcauugcacaaacaaacgcugagccagaugggcccacgccugaauuagaggaagagauguucaaaaagagaaaucugacuaucauggaccuccacccaggaaguggcaaaaccaggaaguacuugcccgccauaguucgugaagcuauuaagcgccggcugagaacacucauccuggcaccuaccaggguggucgccgccgagauggaggaagcucuuaaaggucugccgauccgauaucagacuacagcgaccaaguccgagcauacggggcgggaaauuguggauuugaugugccacgcaacuuuuacaaugcgccuacugagccccguaagagugccaaacuacaaucucaucauaauggacgaggcccauuucaccgauccugcuucuauugccgcaaggggauauaucagcacccggguuggcaugggcgaagccgcugcgauuuuuaugacugccacacccccagggaccgcagacgcuuucccucaguccaacgcccccauccaggaugaggagcgagacauaccagaaagaucauggaauaguggaaacgaguggauuacagacuuugcagguaaaacugucugguucgugccgagcaucaaggccggcaaugauaucgcuaacuguuuacgcaaaaacgggaagaaggugauucaacugucuaggaaaacguuugacaccgaauaccagaagacaaaacuuaaugauugggacuucgucguaacuaccgauaucuccgagaugggagccaacuuuaaggcggaccgugugauugauccucggagaugccugaaacccguuauacucacagacggcccagagagggugaucuuggcaggucccaugccugucaccgccgcuucagccgcucagcgccgagggagagugggccggaauccacagaaggaaaacgaucaauacauuuucacuggacagccccugaauaacgacgaggaucacgcacacuggacggaagccaagaugcuccuggacaauaucaacaccccugagggcaucauuccggcucuuuucgaaccagagagggagaaaagugccgcaauagacggggaauaucgccuaaagggagagagccguaaaacauuuguugaacugaugagacggggugauuugcccgugugguuagcgcauaaggucgccuccgagggcaucaaauacacugacaggaaguggugcuucgaugggcagcgcaauaaccagauucuggaagagaauauggacguggagaucuggaccaaagaaggagagaagaagaaacuccgaccuagauggcuggaugcucggacauauucugacccccuugcccugaaggaauuuaaagaguucgcagcuggcaggaagucgauugcccucgauuugguaaccgaaaucggucgcgugccaagccaccuggcacauagaacuaggaacgcccuagacaaucugguuaugcuccacacaucagagcacgggggccgggcuuaccgucaugcggucgaggaacuuccugagacgauggaaacccuguuauugcugggacucaugauacugcuuacuggcggggccaugcuguuucucaucuccggaaaagguauuggcaagacaaguaucggguugauuugugugaucgcaucuagcggaaugcuguggauggcugagauacccuuacaauggauugccuccgccaucgugcuagaguucuuuaugaugguccugcucauuccagaaccugagaagcagcgcaccccgcaggauaaccaacuugcauauguugugaucggcauacugaccuuggcugccaucauugcggcuaaugaaaugggucugcucgagacaacuaaacgagaccuggggaugucaaaggaacccggcguagugucuccaacgagcuaccuugaugucgaccuccacccugccagugcauggacccuguaugccguggcuacaacuguuaucacccccauguugagacauacaauugagaacuccaccgcaaaugugagccuggccgcgaucgcuaaccaggccgucguauuaaugggacuagauaaaggcuggccaauaucuaagauggaccugggggugccucuccuugcacugggaugcuacucacagguuaaccccuugacucugacggccgcugugcuccugcuuauuacacacuacgccaucaucggcccggguuuacaggcaaaagcuaccagggaggcccaaaagcggacugcggccgggauuaugaagaauccaaccgucgacggaaucaugacaauagaucuggacccugugauuuaugauuccaaauucgaaaagcagcucggccaggucauguugcuggugcuaugugcaguucagcugcuccuuaugcgcacuaguugggcucugugcgaggccuugacccuggcaacaggucccaucacgacccucugggaaggcagcccagggaaauuuuggaacacuacaauugcugugucgauggccaauaucuucagaggaucuuaccuggccggcgcgggguuagcuuuuuccauaaugaagagcguaggaaccggcaaaagggguacugggucacaaggagagacacuuggcgaaaaguggaagaaaaagcugaaccagcucagucggaaagacuucgaucuauauaagaaaucugguaucaccgagguggaccgaacggaggcaaaggaaggccugaaaagaggggagauuacccaucacgccgucucccgcggaagcgcuaaguugcagugguuuguugaaaggaauauggugauccccgagggccgggucauugaucugggguguggacguggcgguuggucauacuauugcgccgggcucaagaaagugacagaaguaagaggauacacuaagggcggcccugggcacgaggagccggugcccaugaguaccuauggauggaacaucguuaaacuuaugagcgguaaggacguguucuaccugccaccugaaaaaugugauacauugcugugcgacauuggcgaguccucucccagcccuacugucgaagaguccaggaccauccgcgugcucaagauggucgagccaugguuaaagaauaaccaguucuguauaaaagugcugaaucccuacaugccuacaguuauugaacaucuugagcggcugcaacgaaagcacgggggaaugcuaguaagaaacccacucucaaggaauucuacccaugaaauguauuggaucaguaacggcacugguaauaucguggcaucggucaacauggugagccgccuguugcugaaucgguuuacgaugacacacagacgucccaccauugagaaagauguugaccucggggccggaacuaggcacgugaacgcugaaccggagaccccuaacauggaugucauaggcgagcggaucaagcgcauuaaagaagagcauaauuccacauggcacuacgacgacgaaaacccauauaagacgugggcguaccauggcucuuaugaggugaaggccaccgggucagcaagcuccaugaucaauggaguagugaaacuucugacuaagcccugggauguugucccuauggugacacagauggcuaugaccgacacuacaccauucggucagcaacgaguguuuaaagaaaaggucgauaccagaacacccaggaguaugccgggcacucggcgcguuauggggauuaccgccgagugguuauggagaacgcugggaaggaacaaaaagccucgauugugcacccgggaggaauucacaaagaaagugcguacuaaugcagccaugggcgcuguauuuaccgaggaaaaccagugggacucugccaaggcggcaguggaggaugaagacuucuggaaacucgucgauagagagcgcgagcugcacaagcuagguaaaugugggagcugcguguacaauaugaugggaaagagggaaaaaaagcuuggcgaguuuggcaaggccaaagggucacgggcuaucugguauauguggcugggagccagauaccucgaauucgaggcacuggguuuuuugaacgaggaccauugguucucccgcgaaaauaguuacagcggcguugagggggaaggacugcacaagcucggcuauauacuuagggauaucucuaaaauucccgguggggcuauguacgccgacgauacagcuggaugggacacucgaaucaccgaggacgaucugcacaacgaagagaagauuacgcagcagauggacccagagcaucggcaauuagccaaugcaaucuuuaaacugacauaucagaacaagguggucaaggugcagagaccuacccccacuggcacaguaauggauauaauuuccaggaaagaccagcgcggcucagggcaaguuggaaccuacgguuugaauacuuucaccaacauggaagcgcagcucauccgucagauggagggcgaaggggugcugagcaaggccgaucuagagaauccacaccuucccgaaaaaaagaucacacaguggcuggagacgaaaggagucgagcggcucaagagaauggcuauuucgggcgacgauugcguggugaagccuauagacgauagguuugccaacgcacuguuggcuuuaaacgacauggguaaaguccgcaaggauaucccacaauggcagccgucuaaaggguggcaugacuggcagcagguucccuucuguagucaccacuuccaugaacugauuaugaaggauggacgaaaacucgugguaccuugccggccacaagacgagcuuaucggcagagccaggauuucccagggcgcaggguggagccugaaggaaaccgccugucuaggaaaggcguaugcucagauguggucacugauguacuuucaccgcagagaccuccgguuggccuccaaugcaaucugcucugccgugcccguccauugggugccuacuagcaggacaaccuggaguauacacgcucaucaccaauggaugacuacagaggauaugcugaccguuuggaaccguguguggaucgaagacaauccauggauggaggauaaaacgcccgucacaaccugggagaacgugccuuaucuugguaagcgagaagaccagugguguggcucccugauugggcucacuagccgcgccaccugggcacagaauaucccgacagcuauucagcaaguaagaucuuuaaucggaaacgaggaauuccuggauuacaugccaucaaugaaacgguuuaggaaggaggaggaaagugagggcgccauuugguga

SEQ ID NO: 15275 - RNA, 9873 nt, Artificial Sequence
  derived and/or modified CDS sequence (opt3) from DENV-3__GQ199870__SS-prME
accagccugugccucaugaugauccuucccgcagcucuggcauuccacuugacauccagagacggcgaaccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucaaaauucagggggaacaagcauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacuaagaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauaugggggaagauggauguugguacggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcacaugaucgccgggguguucuuuacguucguucuacugcucuccggacagauuacuuggcgggauauggcacauacccugaucaugauuggcaguaaugcuagcgacagaauggguaugggggugacauaucuugccuugauagcaaccuuuaaaauccagcccuuccuggccuuaggauuuuuccucaggaagcugacuucucgcgaaaaccuucugcuaggcgucggccucgcuauggcgacaacccugcaauugccggaggauauugaacagauggccaaugggaucgcacugggauuaauggcucucaaacugauuacacaguuugagacuuaccagcuuuggaccgcccugaucuccuugacguguucaaacacaauauucacccucacuguggccuggcgaaccgcuacacugauccuagccgguguuagucugcuuccugugugccaaagcucguccaugcggaagacugacuggcucccaauggccgucgcggcuaugggcguacccccucugcccuuguuuauuuucgggcugaaggauaccuuaaaacguagaucuuggccacucaaugagggagugauggccguuggccuggugagcauccuugcaucaagucuguugaggaacgacgucccuauggccgguccccucguggcugggggacugcuaauugcauguuauguaaucacgggcacauccgccgaucugaccguggaaaaggcggcugacauaacuugggaggaagaggccgaacagacaggcgucucucacaaccuuaugauuaccguugacgaugacgggacuaugcgcaucaaagaugacgagacagagaauauccucaccgugcuguugaagacggcauuacugauugugagcggaauauuuccauacuccaucccggccacucuccuggucuggcauaccuggcagaaacagacacaacggucaggugugcuuugggauguuccuagucccccagaaacccagaaggcugagcuggaagagggcguauacagaauuaaacagcaggggaucuucggaaagacacaagugggcgucggugugcagaaggaggggguuuuucacacuauguggcacgugaccaggggagccgucuugacguauaacggcaaacgacuagaacccaauugggcaagugugaagaaagaccugauuucuuacggcgggggauggcgccucuccgcucaguggcaaaagggugaggaaguacaggucaucgccguggagccuggcaaaaacccaaagaauuuccagacaaugcccgggacuuuccagaccacaaccggagaaauaggcgcgaucgcccuggauuuuaagccugguacuagcgggucgccgauuaucaaccgggagggaaaaguugugggccuuuauggcaauggggucgugaccaagaacggagguuacguuucaggcauugcacaaacaaaugcugagccagacgggcccacgccugaauuagaggaagagauguucaaaaagagaaaccugacuaucauggaucuccauccaggaucuggcaaaaccaggaaguauuugcccgccauagugcgugaagcuauuaagcgccggcugagaacacucauccuggcaccuaccagggucguggccgccgagauggaggaagcucuuaaaggucugccgauccgauaccagacuacagcgaccaagagugagcacacggggcgggaaauuguagacuugaugugccaugcaacuuuuacaaugcgccuacugucccccgugagaguuccaaauuauaaccucaucauaauggaugaggcccacuucaccgacccugcuagcauugccgcaaggggauacaucucuacccgggucggcaugggcgaagccgcugcgauuuuuaugacugccacacccccagggaccgcagaugcuuucccucagagcaaugcccccauccaggacgaggagcgagacauaccagaaagauccuggaacucaggaaaugaguggauuacagauuuugcagguaaaacugugugguucgugccgaguaucaaggccggcaacgacaucgcuaacuguuuacgcaaaaaugggaagaaggucauucaacugagcaggaaaacguuugauaccgaauaccagaagacaaaacuuaacgacugggauuucguagugacuaccgacaucucugagaugggagccaauuuuaaggcggaucguguuauugacccucggagaugccugaaacccgugauacucacagauggcccagagagggucaucuuggcaggucccaugccugugaccgccgcuuccgccgcucagcgccgagggagaguuggccggaacccacagaaggaaaaugaccaauauauuuucacuggacagccccugaacaaugaugaggaccaugcacacuggacggaagccaagaugcuccuggacaacaucaauaccccugagggcaucauuccggcucuuuucgaaccagagagggagaaaucagccgcaauagauggggaauaccgccuaaagggagagagucguaaaacauuuguggaacugaugagacggggugacuugcccgucugguuagcgcacaagguggccagcgagggcaucaaauauacugauaggaaguggugcuucgacgggcagcgcaacaaucagauucuggaagagaacauggauguagagaucuggaccaaagaaggagagaagaagaaacuccgaccuagauggcuggacgcucggacauacuccgauccccuugcccugaaggaauuuaaagaguucgcagcuggcaggaagucuauugcccucgacuuggugaccgaaaucggucgcguuccaucgcaucuggcacacagaacuaggaaugcccuagauaaccuggucaugcuccauacaagcgagcacgggggccgggcuuaucgucacgcgguggaggaacuuccugagacgauggaaacccuguuauugcugggacucaugauacugcuuacuggcggggccaugcuguuucucaucucaggaaaagguauuggcaagacauccaucggguugauuugugugaucgcaaguucuggaaugcuguggauggcugagauacccuuacaauggauugccagcgccaucguccuagaguucuuuaugaugguucugcucauuccagaaccugagaagcagcgcaccccgcaggacaaucaacuugcauacgugguaaucggcauacugaccuuggcugccaucauugcggcuaacgaaaugggucugcucgagacaacuaaacgagaucuggggauguccaaggaacccggcguggucucaccaacgucuuaucuugacguggaucuccauccugccagcgcauggacccuguacgccguugcuacaacugugaucacccccauguugagacacacaauugagaauaguaccgcaaacgucucccuggccgcgaucgcuaaccaggccguaguguuaaugggacuagacaaaggcuggccaauaagcaagauggaccuggggguuccucuccuugcacugggaugcuacucucaggugaaucccuugacucugacggccgcuguccuccugcuuauuacacauuaugccaucaucggcccggguuuacaggcaaaagcuaccagggaggcccaaaagcggacugcggccgggauuaugaagaacccaaccguggauggaaucaugacaauagaccuggauccugucauuuacgacucaaaauucgaaaagcagcucggccaggugauguugcugguucuaugugcagugcagcugcuccuuaugcgcacuuccugggcucugugcgaggccuugacccuggcaacaggucccaucacgacccucugggaaggcaguccagggaaauuuuggaauacuacaauugcuguaagcauggccaacaucuucagaggaucguaucuggccggcgcgggguuagcuuuuucuauaaugaaguccgugggaaccggcaaaagggguacugggagccaaggagagacacuuggcgaaaaguggaagaaaaagcugaaucagcucucacggaaagauuucgaccuauacaagaaaagugguaucaccgaggucgaucgaacggaggcaaaggaaggccugaaaagaggggagauuacccaccaugccguuucucgcggauccgcuaaguugcagugguuuguggaaaggaacauggucauccccgagggccgggugauugaccugggguguggacguggcgguuggagcuauuacugcgccgggcucaagaaaguaacagaagugagaggauauacuaagggcggcccugggcacgaggagccgguucccaugucaaccuacggauggaauaucgugaaacuuaugagugguaaggaugucuucuaccugccaccugaaaaaugugacacauugcugugcgauauuggcgagagcucccccucuccuacuguggaagagagcaggaccauccgcguccucaagaugguggagccaugguuaaagaacaaucaguucuguauaaaaguucugaaccccuauaugccuacaguaauugaacaccuugagcggcugcaacgaaagcaugggggaaugcuagugagaaauccacucuccaggaacucaacccacgaaaugucuuggaucaguaauggcacugguaacaucgucgcaucggugaauaugguuagccgccuguugcugaaccgguccacgaugacacauagacgucccaccauugagaaagacguggaucucggggccggaccgaggcacgucaacgcugacccugaaccacccaauauggacgugauaggcgagcggaucaagcgcguaaaagaggaacacaacucuacuuggcauuacgaugacgagaauccuuauaagaccugggcguaccacggcucauaugaagugaaggccacagggagcgcauccaguaugauuaacggaguugucaaacuucugacgaagccaugggauguggugcccauggucccgcagauggcuaugaccgacacuacaccuuuuggucagcaacgaguuuucaaagagaagguggauaccagaacucccaggucuaucccaggcacacggcgcguaauggggauuaccgccgaaugguuauggagaacacugggaaggaauaaaaagccucgauugugcacucgggaggaguuuaccaagaaagugcguacgaacgcagccaugggcgcugucuucaccgaagagaaucagugggacagcgccaaggcggcaguggaagaugaggacuuuuggaaacucguugauagagaacgcgagcugcauaagcuagguaaaugugggucaugcguguacaacaugaugggaaagagggagaagaaacuuggcgaguucggcaaagccaaagggucccgggcuaucugguauauguggcugggagccagauaccucgaguuugaagcacuggguuucuugaaugaggaccacugguuuagucgcgagaacagcuacucuggcgucgaaggggagggacugcauaagcucggcuauauacuuagggauaucuccaaaauucccgguggggcuauguacgccgacgacacagcuggaugggauacucgaaucaccgaagacgaucugcacaaugaggaaaagauuacacagcagauggacccagagcaccggcaauuagccaacgcaaucuucaaacugacuuaucagaauaaggugguaaagguucagagacccaccccuacgggcacagugauggauauaauuucaaggaaagaccagcgcggcagcgggcaagucggaaccuacgguuugaacacuuuuacaaauauggaggcgcagcucauccgucagauggaaggcgagggggugcugucgaaggccgaucuagaaaacccacaucuuccggagaaaaagaucacccaguggcuggaaacuaaaggaguggagcggcucaagagaauggcuauuucuggcgacgauugcgucguuaagcccauagacgauagguucgccaacgcacuguuggcuuuaaaugacauggguaaagugcgcaaggauaucccucaauggcagccaaguaaaggguggcacgacuggcagcagguacccuuuuguucccaucacuuccacgagcugauuaugaaggacggacgaaaacucguggucccuugccggccacaagaugaacuuaucggcagagccaggauuagccagggcgcaggguggucacugaaggagaccgccugucuaggaaaggcguaugcucagauguggucccugauguacuuccaucgcagagaccuccgguuggccucuaacgcaaucugcagcgccgugcccguucacugggugccuacaaguaggacgaccugguccauacaugcucaccaucaauggaugacuacagaagauaugcugaccgucuggaaucguguguggaucgaggacaacccguggauggaagauaaaacuccaguaacaaccugggagaauguucccuaucuugguaagcgagaggaccagugguguggcagccugauugggcucacgucucgcgccacaugggcacagaacaucccuaccgcuauucagcaagugagaucauuaaucggaaaugaagaguuucuggauuacaugcccaguaugaaacgguucaggaaggaagaggaguccgaaggcgccauuugguga

SEQ ID NO: 15276 - RNA, 9873 nt, Artificial Sequence
  derived and/or modified CDS sequence (opt3) from DENV-3__JF937630__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacgcuuuuguccucaagaaagaggugucugaaacgcagcacgggaccauccugauuaaggucgaguacaagggagaagaugugcccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgcaggugcuugggagaauggcgucugugggauacgaagcaccacacgcauggaaaaccuccuguggaaacagaucgccaaugagcuuaacuauauuuugugggaaaauaacaucaagcugacgguuguggugggagacauuaucggcguacucgagcaggggaaaagaacccugacuccacagccuauggaguuaaaguacucauggaaaacauggggaaaggcgaagauagucaccgccgaaacacaaaacaguuccuucauuaucgauggccccaauacuccagagugccccagcgugucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaaccauaggcccggguaucacacacaaacugccggaccuuggcaccuuggcaaguuggagcuggacuuuaauuacugcgaggggaccacaguggugauuacggaaaacuguggaacccguggcccaaguuuacggacuacaaccgucucugguaaacucauccaugaguggugcugucgaagcugcacucugcccccucuuagauauaugggggaagauggauguugguacggcauggagauaaggccaauuuccgaaaaggaggagaauaugguuaaaucacuggugagcgcugguucuggcaagguagacaacuucacaauggggguguugugccucgccauccuguuugaagaggucaugcgcggaaaguucggcaaaaagcacaugaucgcagggguguucuuuaccuucguucuacugcucuccggacagauuacguggcgggauauggcucauacucugaucaugauuggcaguaaugccagcgacagaauggguaugggggugaccuaucuugcauugauagccacauuuaaaauccagcccuuccuggcuuuaggauuuuuccucaggaagcugaccucucgcgaaaaccuucugcuaggcgucggccucgcgauggccacuacacugcaauugccggaggauauugaacagauggcaaaugggaucgcucugggauuaauggcccucaaacugauuacccaguuugagacauaccagcuuuggacugcccugaucuccuugaccuguucaaacacgauauucacacucaccguggcuuggcgaacugcaacccugauccuagccgguguuagucugcuuccugugugccaaagcucguccaugcggaagacagacuggcucccaauggcggucgcugccaugggcguacccccucugcccuuguuuauuuucucucugaaggauacuuuaaaacguagaagcuggccacucaaugagggggugauggcaguuggacuggugucaauccuugccaguucccuguugaggaacgacgucccuauggcuggcccccucguggcaggugggcugcuaauugccuguuauguaaucaccggaacgucugcggaucugacaguggaaaaggcugccgacauaaccugggaggaagaggcagaacagacuggcgucagccacaaccuuaugauuacaguugacgaugacggcaccaugcgcaucaaagaugacgagacugagaauauccucacagugcuguugaagaccgccuuacugauuguguccgggauauuuccauacucaaucccggcuacgcuccuggucuggcauacuuggcagaaacagacccaacggagcggagugcuuugggauguuccuagucccccagaaacacagaaggccgagcuggaagaggguguauacagaauuaaacagcagggcaucuucgggaagacccaagugggagucggcgugcagaaggaggguguuuuucacacaauguggcacgugacuaggggggcagucuugaccuauaacggaaaacgacuagaacccaauugggcuucugugaagaaagaccugauuuccuacggcggcggguggcgccucagcgcccaguggcaaaagggagaggaaguacaggucaucgcgguggagccugguaaaaacccaaagaauuuccagacgaugcccggcacauuccagacuaccacaggggaaauaggagccaucgcacuggauuuuaagccuggcaccucggguucaccgauuaucaaccgggaggggaaaguugugggacuuuauggcaauggcgucgugacuaagaacgggggauacguuucugguauugcucaaaccaaugccgagccagacggccccacaccugaauuagaggaagagauguucaaaaagagaaaccugacgaucauggaucuccauccagggaguggaaaaacuaggaaguauuugcccgcuauagugcgugaagcaauuaagcgccggcugagaacccucauccuggccccuacaagggucguggccgcugagauggaggaagcgcuuaaaggccugccgauccgauaccagaccacugcaacaaaguccgagcacaccggucgggaaauuguagacuugaugugccaugccacguuuacuaugcgccuacugagccccgugagaguuccaaauuauaaccucaucauaauggaugaggcucacuucacagacccugccucuauugcagccaggggguacaucagcacccgggucggaaugggcgaagcugcggccauuuuuaugaccgcaacucccccaggcacagcugaugccuucccucaguccaaugcacccauccaggacgaggagcgagacauaccagaaagaucauggaacagugggaaugaguggauuaccgauuuugccggaaaaacagugugguucgugccgagcaucaaggcugguaacgacaucgccaacuguuuacgcaaaaauggcaagaaggucauucaacugucuaggaaaacuuuugauacggaauaccagaagaccaaacuuaacgacugggauuucguagugacaacugacaucuccgagaugggggcgaauuuuaaggcagaucguguuauugacccucggagaugccugaaacccgugauacucaccgauggaccagagagggucaucuuggccggccccaugccugugacagcugccucagcugcacagcgccgagguagaguugggcggaacccacagaaggaaaaugaccaauauauuuucaccggccagccccugaacaaugaugaggaccaugcccacuggacugaagcuaagaugcuccuggacaacaucaauacgccugagggaaucauuccggcccuuuucgaaccagagagggagaaaagugcagcgauagauggcgaauaccgccuaaagggggagagccguaaaaccuuuguggaacugaugagacggggagacuugcccgucugguuagcccacaagguggcuuccgaggguaucaaauauacagauaggaaguggugcuucgacggccagcgcaacaaucagauucuggaagagaacauggauguagagaucuggacuaaagaaggggagaagaagaaacuccgaccuagauggcuggacgcccggaccuacucugauccccuugcacugaaggaauuuaaagaguucgcugccggaaggaagucgauugcacucgacuuggugacagaaaucggccgcguuccaagccaucuggcccacagaaccaggaaugcucuagauaaccuggucaugcuccauacuucagagcacggugggcgggcguaucgucacgccguggaggaacuuccugagacaauggaaacgcuguuauugcugggccucaugauacugcuuaccggaggcgcaaugcuguuucucaucuccgggaaaggaauugguaagacuaguaucggcuugauuugugugaucgcuucuagcgggaugcuguggauggccgagauacccuuacaauggauugccuccgcaaucguccuagaguucuuuaugaugguucugcucauuccagaaccugagaagcagcgcacaccgcaggacaaucaacuugcuuacgugguaaucggaauacugaccuuggccgcgaucauugcugccaacgaaaugggccugcucgagaccacaaaacgagaucuggguaugucaaaggaacccgggguggucucuccaacuagcuaucuugacguggaucuccauccugcaagugccuggacgcuguacgcuguugcaaccacagugaucacucccauguugagacacaccauugagaauuccacagccaacgucagccuggcggcuaucgccaaccaggcaguaguguuaaugggccuagacaaaggauggccaauaucuaagauggaccugggcguuccucuccuugcccuggggugcuacucacaggugaaucccuugacccugacugcugccguccuccugcuuauuacgcauuaugcaaucaucggaccgggcuuacaggcuaaagccacaagggaggcgcaaaagcggaccgccgcagguauuaugaagaacccaacuguggaugggaucaugaccauagaccuggauccugucauuuacgacuccaaauucgaaaagcagcucggacaggugauguugcugguucuaugugcugugcagcugcuccuuaugcgcacaaguugggcccugugcgaggcauugacucuggcuaccggccccaucacaacgcucugggaagguagcccaggcaaauuuuggaauaccacuauugccguaucgauggccaacaucuucagagggucuuaucuggcgggagcuggcuuagcauuuuccauaaugaagagcguggggacaggaaaaaggggcaccgguucacaaggggagacucuuggagaaaaguggaagaaaaagcugaaucagcucagucggaaagauuucgaccuauacaagaaaucuggcaucacagaggucgaucgaaccgaggccaaggaaggucugaaaagaggcgagauuacgcaccaugcuguuucccgcgggagcgccaaguugcagugguuuguggaaaggaacauggucauccccgagggacgggugauugaccugggcugugggcguggaggcuggucauauuacugcgcaggucucaagaaaguaaccgaagugagaggguauacaaagggaggcccuggccacgaggagccgguucccaugaguacuuacggguggaauaucgugaaacuuaugagcggaaaggaugucuucuaccugccaccugaaaaaugugacaccuugcugugcgauauuggugaguccucucccagcccuacaguggaagaguccaggacuauccgcguccucaagaugguggagccaugguuaaagaacaaucaguucuguauaaaaguucugaaccccuauaugccuaccguaauugaacaccuugagcggcugcaacgaaagcauggcgggaugcuagugagaaauccacucucaaggaacucuacacacgaaauguacuggaucaguaauggaaccggcaacaucgucgccucggugaauaugguuagccgccuguugcugaaccgguuuacuaugacgcauagacgucccacaauugagaaagacguggaucucggugcugggaccaggcacgucaacgcggaaccggagacuccuaauauggacgugauaggagagcggaucaagcgcauuaaagaagagcacaacuccaccuggcauuaugacgaugaaaauccauacaagacaugggccuaucacggcucuuacgagguaaaggcaacgggcucagcuagcuccaugaucaacggggugguuaaacuucugaccaagcccugggacgucgugccuauggugacucagauggccaugacagauaccacuccauucggacagcaacgagucuuuaaagaaaagguugacacaagaacccccaggaguaugccggguacacggcgcgugaugggcauuacugcagagugguuauggagaacccuggggaggaauaaaaagccucgauugugcacgcgggaggaauucaccaagaaaguacguacaaacgccgcuaugggagccguguuuacugaggaaaaucagugggauucugcgaaggcagccgucgaggacgaagauuucuggaaacucguggacagagagcgcgagcugcauaagcuaggcaaaugugguagcugcguuuauaacaugauggggaagagggaaaaaaagcuuggagaguuuggcaaggcuaaaggcucacgggccaucugguacauguggcugggggcaagauaccucgaauucgaggcucugggauuuuugaaugaggaucacugguucucccgcgaaaacaguuauagcgguguggagggcgaagggcugcauaagcucggauacauacuuagggacaucucuaaaauucccggcggugccauguaugcugaugacaccgccgggugggacacacgaaucacugaggaugaccugcacaaugaagagaagauuacccagcagauggauccagagcaccggcaauuagcaaacgcgaucuuuaaacugacguaccagaauaaggucgugaagguacagagaccuacacccaccggaacuguuauggacauaauuuccaggaaagaucagcgcggcucaggccaaguggggacauauggauugaacaccuucacuaauauggaagcccagcucauccgucagauggagggugaaggcguccugagcaaggcugaccuagagaacccacaucuucccgaaaaaaagaucacccaguggcuggagacaaaagggguggagcggcucaagagaauggccauuucgggagaugacugcguggucaagccuauagaugacagguuugcaaacgcucuguuggccuuaaaugauaugggcaaaguucgcaaggacaucccacaauggcagccgucuaaagguuggcacgauuggcagcaggugcccuucuguagucaucacuuccacgaacugauuaugaaggacgggcgaaaacucguagugccuugccggccacaagacgagcuuaucggaagagcaaggauuucccagggcgccggcuggagccugaaggaaacggcgugucuagggaaggcuuacgcccagauguggucacugauguauuuucaucgcagagaucuccgguuggcauccaacgccaucugcucugcuguccccgugcacuggguuccuaccagcaggacuacauggaguauacaugcccaccaucaauggaugaccacugaggacaugcugacaguguggaaucgugucuggaucgaagauaacccauggauggaggacaaaacccccgugacgacaugggagaauguaccuuaccuuggaaagcgagaagaucaguggugugguucccugauuggccucaccagccgcgcaacuugggcucagaacaucccgaccgccauucagcaaguuagaucuuuaaucgggaaugaggaauuccuggacuacaugccaucaaugaaacgguuuaggaaggaggaggaaagugagggagcgauuugguga

SEQ ID NO: 15277 - RNA, 9873 nt, Artificial Sequence
  derived and/or modified CDS sequence (opt3) from DENV-3__JN000936__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauaugggggaagauggauguugguacggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcacaugaucgccggggugguuuucacguuugugcuacugcucuccggacagauuacuuggcgggauauggcacauacccugaucaugauuggcaguaaugcuagcgacagaauggguaugggggucacauaucuugccuugauagcaaccuucaaaauccagcccuuucuggccuuaggauucuuucucaggaagcugacuucucgcgaaaaccuucugcuaggcgugggccucgcuauggcgacaacccugcaauugccggaggauauugaacagauggccaaugggaucgcacugggauuaauggcucucaaacugauuacacaguucgagaucuaccagcuuuggacugcccugauauccuugaccuguucaaacacgaucuuuacacucaccguugccuggcgaacugcuacccugauucuagcaggugugagucugcuuccuaugugccaaagcucguccaugcggaagacagacuggcucccaauggccgucgcggcuaugggcguacccccucugcccuuguucaucuuuucucugaaggauacuuuaaaacguagaagcuggccacucaaugagggggugauggccguuggacuggugucaauucuugcaaguucccuguugaggaacgacgucccuauggccggcccccucguggcuggugggcugcuaaucgcauguuauguaauaaccggaacgucugccgaucugacaguggaaaaggcggcugacauuaccugggaggaagaggccgaacagacuggcgucagccacaaccuuaugaucacaguugacgaugacggcaccaugcgcaucaaagaugacgagacugagaauauucucacagugcuguugaagaccgcauuacugauaguguccgggaucuucccauacucaauuccggccacgcuccuggucuggcauacuuggcagaaacagacccaacggagcggagugcuuugggauguuccuagucccccagaaacacagaaggcugagcuggaagaggguguauacagaaucaaacagcagggcauuuuugggaagacccaagugggagucggcgugcagaaggaggguguuuuccacacaauguggcacgugacuaggggggccgucuugaccuauaacggaaaacgacuagaacccaauugggcaucugugaagaaagaccugaucuccuacggcggcggguggcgccucagcgcucaguggcaaaagggagaggaaguacaggucauagccguggagccugguaaaaacccaaagaauuuucagacgaugcccggcacauuccagacuaccacaggggaaaucggagcgauugcccuggauuucaagccuggcaccucggguucaccgaucauuaaccgggaggggaaaguugugggacuuuauggcaauggcgucgugacuaagaacgggggauacguuucugguaucgcacaaaccaaugcugagccagacggccccacaccugaauuagaggaagagauguuuaaaaagagaaaccugacgauaauggaucuccauccagggaguggaaaaacuaggaaguauuugcccgccauugugcgugaagcuaucaagcgccggcugagaacccucauccuggcaccuacaagggucguggccgccgagauggaggaagcucuuaaaggccugccgauucgauaccagaccacugcgacaaaguccgagcacaccggucgggaaaucguagacuugaugugccaugcaacguucacuaugcgccuacugagccccgugagaguuccaaauuauaaccucauaauuauggaugaggcccacuuuacagacccugcuucuaucgccgcaaggggguacauuagcacccgggucggaaugggcgaagccgcugcgaucuucaugaccgccacucccccaggcacagcagaugcuuuuccucaguccaaugcccccauacaggacgaggagcgagacauuccagaaagaucauggaacagugggaaugaguggaucaccgauuucgcaggaaaaacagugugguuugugccgagcaucaaggccgguaacgacauugcuaacuguuuacgcaaaaauggcaagaaggucauccaacugucuaggaaaacuuucgauacggaauaccagaagaccaaacuuaacgacugggauuuuguagugacaacugacauuuccgagaugggggccaauuucaaggcggaucguguuauagacccucggagaugccugaaacccgugauccucaccgauggaccagagagggucauuuuggcaggccccaugccugugacagccgcuucagccgcucagcgccgagguagaguugggcggaacccacagaaggaaaaugaccaauauaucuuuaccggccagccccugaacaaugaugaggaccaugcacacuggacugaagccaagaugcuccuggacaacaucaauacgccugagggaauuauaccggcucuuuucgaaccagagagggagaaaagugccgcaaucgauggcgaauaccgccuaaagggggagagccguaaaaccuucguggaacugaugagacggggagacuugcccgucugguuagcgcacaagguggccuccgaggguauuaaauauacagauaggaaguggugcuuugacggccagcgcaacaaucagauccuggaagagaacauggauguagagauuuggacuaaagaaggggagaagaagaaacuccgaccuagauggcuggacgcucggaccuacucugauccccuugcccugaaggaauucaaagaguuugcagcuggaaggaagucgaucgcccucgacuuggugacagaaauaggccgcguuccaagccaucuggcacacagaaccaggaaugcccuagauaaccuggucaugcuccauacuucagagcacggugggcgggcuuaucgucacgcgguggaggaacuuccugagacaauggaaacgcuguuauugcugggccucaugauccugcuuaccggaggcgccaugcuguuccucauuuccgggaaaggaaucgguaagacuaguauuggcuugaucugugugauaacaucuagcgggaugcuguggauggcagagauucccuuacaauggaucgcuuccgccauuguccuagaguuuuucaugaugguucugcucaucccagaaccugagaagcagcgcaccccgcaggacaaucaacuugccuacgugguaauaggaauccugaccuuggcagcuauuaucgccgcgaacgaaaugggccugcucgagacaacuaaacgagaucuggguaugucaaaggaacccgggguggucucuccaacgagcuaucuugacguggaucuccauccugcuagugccuggacccuguacgcaguugccacaacugugauuacccccauguugagacacacaaucgagaauuccaccgcuaacgucagccuggcagccauagcgaaccaggcuguaguguuaaugggccuagacaaaggauggccaauuucuaagauggaccugggcguuccucuccuugcccuggggugcuacucacaggugaaucccuugacucugacggcagccguccuccugcuuaucacacauuaugcuaucauuggaccgggcuuacaggccaaagcaaccagggaggcucaaaagcggacugccgcggguaucaugaagaacccaaccguggaugggauaaugacaauugaccuggauccugucaucuacgacuccaaauuugaaaagcagcucggacaggugauguugcugguucuaugugccgugcagcugcuccuuaugcgcacuaguugggcacugugcgaggcuuugacccuggccacaggccccauuacgacccucugggaagguagcccaggcaaauucuggaauacuacaaucgcaguaucgauggcuaacauauuuagagggucuuaucuggccggagccggcuuagcguucuccaucaugaagagcguggggaccggaaaaaggggcacugguucacaaggggagacacuuggagaaaaguggaagaaaaagcugaaucagcucagucggaaagauuuugaccuauacaagaaaucuggcauuaccgaggucgaucgaacggaggcuaaggaaggucugaaaagaggcgagaucacccaccaugcaguuucccgcgggagcgccaaguugcagugguucguggaaaggaacauggucauucccgagggacgggugaucgaccugggcugugggcguggaggcuggucauauuacugcgcuggucucaagaaaguaacagaagugagaggguauacuaagggaggcccuggccacgaggagccgguucccaugaguaccuacggguggaauauugugaaacuuaugagcggaaaggaugucuuuuaccugccaccugaaaaaugugacacauugcugugcgauaucggugaguccucucccagcccuacuguggaagaguccaggaccauacgcguccucaagaugguggagccaugguuaaagaacaaucaguucuguauuaaaguucugaaccccuauaugccuacaguaaucgaacaccuugagcggcugcaacgaaagcauggcgggaugcuagugagaaauccacucucaaggaacucuacccacgaaauguacuggaucaguaauggaacuggcaacauugucgccucggugaauaugguuagccgccuguugcugaaccgguucacgaugacacauagacgucccaccauagagaaagacguggaucucggugcagggacuaggcacgucaacgccgaaccggagaccccuaauauggacgugaucggagagcggauuaagcgcaucaaagaagagcacaacuccacauggcauuaugacgaugaaaauccauacaagacgugggcuuaucacggcucuuacgagguaaaggcgaccggcucagccagcuccaugauuaacggggugguuaaacuucugacuaagcccugggacgucgugccuauggugacacagauggcaaugaccgauacuacaccauuuggacagcaacgagucuucaaagaaaagguugacaccagaacacccaggaguaugccggguacucggcgcgugaugggcaucaccgcugagugguuauggagaacgcuggggaggaauaaaaagccucgauugugcacccgggaggaauuuacaaagaaaguacguacuaacgccgcaaugggagccguguucaccgaggaaaaucagugggauucugcuaaggccgcggucgaggacgaagauuuuuggaaacucguggacagagagcgcgagcugcauaagcuaggcaaaugugguagcugcguuuauaacaugauggggaagagggaaaaaaagcuuggagaguucggcaaggcaaaaggcucacgggccauaugguacauguggcugggggcuagauaccucgaauuugaggcccugggauucuugaaugaggaucacugguuuucccgcgaaaacaguuauagcgguguggagggcgaagggcugcauaagcucggauacauccuuagggacauuucuaaaauccccggcggugcaauguaugcugaugacacagccgggugggacacucgaauuaccgaggaugaccugcacaaugaagagaagaucacgcagcagauggauccagagcaccggcaauuagcuaacgccauauucaaacugacauaccagaauaaggucgugaagguacagagaccuacccccacuggaacaguuauggacauuaucuccaggaaagaucagcgcggcucaggccaaguggggaccuauggauugaacacuuuuaccaauauggaagcacagcucauccgucagauggagggugaaggcguccugagcaaggcggaccuagagaacccacaucuucccgaaaaaaagauuacacaguggcuggagacgaaagggguggagcggcucaagagaauggccauaucgggagaugacugcguggucaagccuaucgaugacagguucgcuaacgcccuguuggcauuaaaugauaugggcaaaguucgcaaggacauuccacaauggcagccgucuaaagguuggcacgauuggcagcaggugcccuuuuguagucaucacuuccacgaacugaucaugaaggacgggcgaaaacucguagugccuugccggccacaagacgagcuuauuggaagagcuaggaucucccagggcgccggcuggagccugaaggaaaccgcaugucuagggaaggccuacgcgcagauguggucacugauguauuuccaucgcagagaucuccgguuggcuuccaacgccauaugcucugcaguccccgugcacuggguuccuacuagcaggacaaccuggaguauccaugcccaccaucaauggaugacuacagacgauaugcugaccguguggaaucgugucuggauugaggacaacccauggauggaagauaaaacgcccgugacaaccugggagaauguaccuuaccuuggaaagcgagaggaccaguggugugguucccugaucggccucacuagccgcgcuaccugggcccagaacauuccgacagcaauccagcaaguuagaucuuuaauugggaaugaagaguuucuggauuacaugccaucaaugaaacgguucaggaaggaagaggagagugaaggagcuauaugguga

SEQ ID NO: 15278 - RNA, 9873 nt, Artificial Sequence
  derived and/or modified CDS sequence (opt3) from DENV-3__HQ541796__SS-prME
accagccugugccucaugaugauccuucccgcagcucuggcauuccacuugacauccagagacggcgaaccuagaaugauuguggggaagaacgaacgggguaaaucuuuacuguuuaagacugccucagguauaaauauguguacgcuaaucgcgauggaucucggcgaaaugugcgacgauaccgucaccuacaaauguccacauauuacugaaguugaaccggaagacaucgauugcugguguaaccugaccaguacaugggugaccuaugggacuugcaaucaggcuggagaacaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucaaaauucagggggaacaagcauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacuaagaaggaggaacccguaaacauugaggcagaaccgccuuucggcgagucaaauacugucaucggaaucggcgauaacgccuugaaaauuaauugguauaagaaggggagcaguaucggaaaaauguuugaagcuaccgcccgcggugcaagaaggauggccauucugggcgacacggcuugggauuucgggucugugggaggcguucucaacucccuggguaagauggugcaccagauauuugggagcgccuacacagcacuuuucucgggcgucucuugggugaugaaaaucggaauuggcguacuguugaccuggaucgggcucaauuccaagaacacuucaaugaguuuuagcugcaucgcgauuggaauaaucacacuguauuuaggcgcugugguucaggccgacauggguugugucauuaauuggaaagggaaggagcugaagugcggauccggcaucuucgugaccaacgaggugcauacuuggaccgaacaguacaaauuucaagcagauucucccaagcggcuagccacagcuauugccggugcaugggagaauggcgucugugggauccgaagcacgacccgcauggaaaaccuccuguggaaacagauagcuaaugagcuuaacuauaucuugugggaaaauaacauuaagcugacuguuguggugggagacaucauuggcguacucgagcaggggaaaagaacacugaccccacagccuauggaguuaaaguacucauggaaaacauggggaaaggccaagaucgucacugcggaaacccaaaacaguuccuucauaauugauggccccaauacgccagagugccccagcgugucuagggccuggaacguuugggaaguggaggacuaugguuuuggggucuucacaaccaauaucuggcugaaacuucgggaaguguacacucaguugugugaccaccgccucaugucagcugcaguuaaggaugagagagccgugcacgcugacaugggauacuggauugagagucagaaaaacggcagcuggaagcuggaaaaagccucccuaaucgagguaaagaccugcacauggccuaagucucauacucuguggucgaaugguguccucgaaagcgauaugauaaucccaaaaucccuggcaggcccgauuucacagcacaaccauaggcccggguaucacacccaaacagcgggaccuuggcaccuuggcaaguuggagcuggacuuuaauuacugcgaggggacgaccguggugaucacugaaaacuguggaacacguggcccaaguuuacggaccacuacagucucugguaaacucauucaugaguggugcugucgaagcugcacccugcccccucuuagauauaugggggaagauggauguugguacggcauggagaucaggccaauauccgaaaaggaggagaauaugguuaaaucacuggugagcgccgguucuggcaagguagacaacuucacgauggggguguugugccucgcuauucuguuugaagaggucaugcgcggaaaguucggcaaaaagcacaugaucgccgggguguucuuuacuuucguucuacugcucuccggacagaucaccuggcgggauauggcacauacacugauuaugaucggcaguaaugcuagcgacagaauggguaugggggugaccuaucuugccuugauugcaacuuuuaaaauacagcccuuccuggccuuaggauuuuuccucaggaagcugacaucucgcgaaaaccuucugcuaggcgucggccucgcuauggcgaccacacugcaauugccggaggauaucgaacagauggccaaugggauugcacugggauuaauggcucucaaacugaucacucaguuugagaccuaccagcuuuggacggcccugauuuccuugacauguucaaacaccaucuucacucucaccguggccuggcgaacagcuacucugauacuagccgguguuagucugcuuccugugugccaaagcucguccaugcggaagaccgacuggcucccaauggccgucgcggcuaugggcguacccccucugcccuuguuuaucuucgggcugaaggauacguuaaaacguagaucuuggccacucaaugagggagugauggccguuggccuggugagcauucuugcaucaagucuguugaggaacgacgucccuauggccgguccccucguggcugggggacugcuaaucgcauguuauguaauuacaggcaccuccgccgaucugacuguggaaaaggcggcugacaucacaugggaggaagaggccgaacagaccggcgucucucacaaccuuaugauaacuguugacgaugacgggacaaugcgcauuaaagaugacgagaccgagaauauccucacggugcuguugaagacugcauuacugaucgugagcggaauuuuuccauacuccauaccggccacccuccuggucuggcauacauggcagaaacagacccaacggucaggugugcuuugggauguuccuagucccccagaaacacagaaggcugagcuggaagagggcguauacagaaucaaacagcaggggauuuucggaaagacucaagugggcgucggugugcagaaggaggggguuuuucacaccauguggcacgugacgaggggagccgucuugacauauaacggcaaacgacuagaacccaauugggcaagugugaagaaagaccugaucucuuacggcgggggauggcgccucuccgcucaguggcaaaagggugaggaaguacaggucauugccguggagccuggcaaaaacccaaagaauuuccagacuaugcccgggaccuuccagacaaccacuggagaaaucggcgcgauagcccuggauuuuaagccugguaccagcgggucgccgaucauuaaccgggagggaaaaguugugggccuuuauggcaauggggucgugacaaagaacggagguuacguuucaggcaucgcacaaacgaaugcugagccagacgggcccacuccugaauuagaggaagagauguucaaaaagagaaaccugaccauuauggaucuccauccaggaucuggcaaaacaaggaaguauuugcccgccaucgugcgugaagcuauaaagcgccggcugagaacccucauucuggcaccuacuagggucguggccgccgagauggaggaagcucuuaaaggucugccgauccgauaccagacaaccgcgacgaagagugagcacacugggcgggaaaucguagacuugaugugccaugcaacauuuaccaugcgccuacugucccccgugagaguuccaaauuauaaccucauuaucauggaugaggcccacuucaccgacccugcuagcauagccgcaaggggauacauuucuacucgggucggcaugggcgaagccgcugcgaucuuuaugacagccacacccccagggacagcagaugcuuucccucagagcaaugcccccauucaggacgaggagcgagacaucccagaaagauccuggaacucaggaaaugaguggauaacugauuuugcagguaaaacggugugguucgugccgaguauuaaggccggcaacgacaucgcuaacuguuuacgcaaaaaugggaagaaggucauccaacugagcaggaaaaccuuugauacagaauaccagaagacuaaacuuaacgacugggauuucguagugaccacagacauuucugagaugggagccaauuuuaaggcggaucguguuaucgacccucggagaugccugaaacccgugauucucaccgauggcccagagagggucauauuggcaggucccaugccugugacugccgcuuccgccgcucagcgccgagggagaguuggccggaacccacagaaggaaaaugaccaauauaucuucacgggacagccccugaacaaugaugaggaccaugcacacuggaccgaagccaagaugcuccuggacaacauuaauacaccugagggcaucaucccggcucuuuucgaaccagagagggagaaaucagccgcaauugauggggaauaccgccuaaagggagagagucguaaaacuuuuguggaacugaugagacggggugacuugaccgucugguuagcgcacaagguggccagcgagggcauaaaauauacagauaggaaguggugcuucgacgggcagcgcaacaaucagauccuggaagagaacauggauguagagauuuggaccaaagaaggagagaagaagaaacuccgacccagauggcuggacgcucggacuuacuccgauccucuugcccugaaggaauuuaaagaguucgcagcuggcaggaagucuaucgcccucgacuuggugacagaaauuggucgcguucccucgcaucuggcacacagaacgaggaaugcccuagauaaccuggucaugcuccauaccagcgagcacgggggccgggcuuaucgucacgcgguggaggaacuuccagagacuauggaaacacuguuauugcugggacucaugauccugcuuaccggcggggccaugcuguuucucauaucaggaaaagguaucggcaagaccuccauuggguugaucugugugauugcaaguucuggaaugcuguggauggcugagaucccuuuacaauggauagccagcgccauuguccuagaguucuuuaugaugguucugcucauccccgaaccagagaagcagcgcacaccucaggacaaucaacuugcauacgugguaauuggcauccugacuuuggcugccauaaucgcggcuaacgaaaugggucugcucgagacgaccaaacgagaucuggggauguccaaggaaccgggcguggucucacccacaucuuaucuugacguggaucuccauccagccagcgcauggacucuguacgccguugcuaccacagugauuaccccuauguugagacacacuaucgagaauaguacggcaaacgucucccuggccgcgauugcuaaccaggccguaguguuaaugggacuagacaaaggcuggcccaucagcaagauggaccuggggguuccacuccuugcacugggaugcuacucucaggugaauccuuugacacugaccgccgcuguccuccugcuuauaacucauuaugccauuaucggccccgguuuacaggcaaaagcuaccagggaggcccaaaagcggacagcggccgggaucaugaagaacccgacuguggauggaauuaugaccaucgaccuggauccagucauauacgacucaaaauucgaaaagcagcucggccaggugauguugcugguucuaugugcagugcagcugcuccuuaugcgcacauccugggcucugugcgaggccuugacgcuggcaaccgguccuauuacuacacucugggaaggcagucccgggaaauuuuggaauaccacuaucgcuguaagcauggccaacauuuucagaggaucguaucuggccggcgcgggguuagcuuuuucuaucaugaaguccgugggaacaggcaaaagggguaccgggagccaaggagagacgcuuggcgaaaaguggaagaaaaagcugaaucagcucucacggaaagauuucgaccuauacaagaaaagugguauaaccgaggucgaucgaacagaggcaaaggaaggccugaaaagaggggagaucacucaccaugccguuucucgcggauccgcuaaguugcagugguuuguggaaaggaacauggucauuccagagggccgggugaucgaccugggguguggacguggcgguuggagcuauuacugcgccgggcucaagaaaguaaccgaagugagaggauauacaaagggcggccccgggcacgaggagccuguuccgaugucaacuuacggauggaauauugugaaacuuaugagugguaaggaugucuucuaccugcccccagaaaaaugugacaccuugcugugcgauaucggcgagagcuccccuucucccacaguggaagagagcaggaccauucgcguccucaagaugguggagccuugguuaaagaacaaucaguucuguaucaaaguucugaacccauauaugcccacuguaauagaacaccuugagcggcugcaacgaaagcaugggggaaugcuagugagaaauccucucuccaggaacucaacgcacgaaauguacuggauuucuaauggcacagguaacaucgucgcaagugugaauaugguuucgcgccuguugcugaaccgguuuaccaugacucauagacguccaaccaucgagaaagacguggaucucggggccggaacaaggcacgucaacgcugaacccgagacgccgaauauggacgugauuggcgagcggauaaagcgcaucaaagaagaacacaacagcaccuggcauuaugacgaugaaaauccuuacaagacuugggcguaucacggcuccuacgagguaaaggccacagggucugcaucaagcaugauuaacggagugguuaaacuucugaccaagccaugggacgucgugcccauggugacucagauggcuaugacagauaccacaccuuucggucagcaacgagucuuuaaagaaaagguugacacuagaaccccaagguccaugcccggcacgcggcgcgugauggggaucaccgccgagugguuauggagaacacugggaaggaauaaaaagccgcgauugugcacucgggaggaguucaccaagaaaguacguacaaacgcagccaugggcgcuguguuuacugaggaaaaucagugggauagugccaaggcggcagucgaggacgaagauuucuggaaacucguggacagagagcgcgagcugcauaagcuagguaaaugugggucuugcguuuauaacaugaugggaaagagggagaagaaacuuggcgaguuuggcaaagccaaagggagccgggcuauuugguacauguggcugggagccagauaccucgaguucgaggcacugggauuuuugaaugaggaucacugguucucacgcgaaaacuccuauaguggcguggagggggaaggacugcauaagcucggcuacauccuuagggacauaagcaaaaucccugguggggcuauguaugccgaugacaccgcuggaugggacacgcgaauuacagaggaugaccugcacaaugaagagaagaucacccagcagauggaucccgagcaccggcaauuagccaacgcaauuuuuaaacugacuuaccagaauaaggucgugaagguacagagaccaacaccuaccggcacuguuauggacaucauaucuaggaaagaucagcgcggcuccgggcaagugggaaccuaugguuugaacacauucacgaauauggaagcgcagcucauucgucagauggagggcgaagggguccugucaaaggccgaccuagagaacccccaucuuccagagaaaaagaucacccaguggcuggagacuaaaggaguggagcggcucaagagaauggcuaucagcggcgaugacugcguggucaagcccauugaugacagguuugccaacgcacuguuggcuuuaaaugauauggguaaaguucgcaaggacauaccucaauggcagccaucgaaaggguggcacgauuggcaacaggugccguucuguucucaucacuuccacgaacugaucaugaaggacggacgaaaacucguagugcccugccggccucaagacgagcuuauuggcagagccaggaucagucagggcgcaggguggucccugaaggaaacagccugucuaggaaaggcguacgcucagauguggagccugauguauuuucaucgcagagaucuccgguuggccucaaacgcaauuugcuccgccgucccagugcacuggguucccaccucuaggacuacauggagcauccaugcucaccaucaauggaugaccacggaggacaugcugacaguguggaaucgugucuggauagaagauaacccuuggauggaggacaaaaccccagugacuaccugggagaauguacccuaccuugguaagcgagaagaucagugguguggcagucugaucgggcucacaucccgcgccacuugggcacagaacauuccuaccgcuauccagcaaguuaggagcuuaauuggaaaugaggaguuccuggacuacaugccgucuaugaaacgguuuaggaaggaggaggaaucagagggcgccaucugguga

SEQ ID NO: 15279 - RNA, 9873 nt, Artificial Sequence
  derived and/or modified CDS sequence (opt3) from DENV-3__HQ166034__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcagcaugaaaaucugaaguauacugucauuaucaccgugcacacaggugaccagcaucagguuggcaacgagacccaaggggugacugcagaaauuacgccucaggcuuccacaaccgaggccauccucccagaauacggaacucuuggccuggagugcucuccgcgaaccgguuuggacuucaaugagaugauccuacugacaaugaaaaacaaggcguggaugguccacagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcauacagcucucaccggcgccacagaaauucagaauucagggggaacuaguauauucgcaggucaccugaagugucgguuaaaaauggacaagcuggagcuaaaaggcaugagcuaugccaugugcaccaacacguuuguccucaagaaagaggugucugaaacccagcaugggacaauccugauuaaggucgaguacaagggagaagaugugcccuguaaaaucccuuucuccacugaggacggccaagguaaggcucacaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguacaagaaggggagcaguauuggaaaaauguuugaagcuacugcccgcggugcaagaaggauggccauacugggcgacaccgcuugggauuucgggucugugggaggcguucucaacucccuggguaagauggugcaucagaucuuugggagcgccuauacggcacuuuucucgggcgucucuugggugaugaaaauuggaaucggcguacuguugacauggaucgggcucaauuccaagaacaccucaaugaguuuuagcugcauugcgauaggaaucauuacucuguacuuaggcgcugugguucaggccgacauggguugugucaucaauuggaaagggaaggagcugaagugcggauccggcauuuucgugacaaacgaggugcacaccuggacugaacaguauaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuacauuuugugggaaaauaacaucaagcugaccguuguggugggagacauuaucggcguacucgagcaggggaaaagaacucugacaccacagccuauggaguuaaaguauucauggaaaaccuggggaaaggccaagauagucacagcggaaacucaaaacaguuccuucauuaucgauggccccaauaccccagagugccccagcgugucuagggccuggaacguuugggaaguggaggacuacgguuuuggggucuucacgacaaauauuuggcugaaacuucgggaaguguauacccaguugugugaccaccgccucaugucagcugcaguuaaggaugagagagccgugcaugcugacaugggauacuggaucgagagucagaaaaacggcagcuggaagcuggaaaaagccucccuaauagagguaaagacuugcaccuggccuaagucucacacacuguggucgaaugguguccucgaaagcgauaugaucauuccaaaaucccuggcaggcccgaucucacagcauaaccacaggcccggguaccacacucaaaccgcgggaccuuggcaucuuggcaaguuggagcuggacuuuaauuauugcgaggggacaacgguggugauuaccgaaaacuguggaacucguggcccaaguuuacggacaaccacugucucugguaaacucauccacgaguggugcugucgaagcugcacacugcccccucuuagauacaugggggaagauggauguugguauggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcauaugaucgccgggguguucuuuacguucguucuacugcucuccggacagauuacuuggcgggauauggcacacacccugaucaugauuggcaguaaugcuagcgacagaauggguaugggggugacauaccuugccuugauagcaaccuuuaaaauccagcccuuccuggccuuaggauuuuuccucaggaagcugacuucucgcgaaaaccuucugcuaggcgucggccucgcuauggcgacaacccugcaauugccggaggauauugaacagauggccaaugggaucgcacugggauuaauggcucucaaacugauuacacaguuugagaucuaucagcuuuggacugcccugauauccuugaccuguucaaacacgaucuucacacucaccguggccuggcgaacugcuacccugauucuagcagguguuagucugcuuccuaugugccaaagcucguccaugcggaagacagacuggcucccaauggccguggcggcuaugggcguccccccucugcccuuguuuaucuucucucugaaggauacuuuaaaacguagaagcuggccacucaaugaggggguaauggccgugggacugguuucaauucuugcaaguucccuguugaggaacgacgugccuauggccggcccccucgucgcuggugggcugcuaaucgcauguuacgugauaaccggaacgucugccgaucugacaguagaaaaggcggcugacauuaccugggaggaagaggccgaacagacuggcgugagccauaaccuuaugaucacagucgacgaugacggcaccaugcgcaucaaagaugacgagacugagaauauucucacaguucuguugaagaccgcauuacugauaguguccgggaucuuuccauauucaauuccggccacgcuccugguguggcacacuuggcagaaacagacccaacggagcggaguccuuugggaugugccuagucccccagaaacacagaaggcugagcuggaagaggguguuuacagaaucaaacagcagggcauuuucgggaagacccaaguaggagugggcguccagaaggaggguguguuucacacaauguggcauguuacuaggggggccguguugaccuacaacggaaaacgacuagaacccaauugggcaucugucaagaaagaccugaucuccuauggcggcggguggcgccucagcgcucaguggcaaaagggagaggaagugcagguaauagccgucgagccugguaaaaacccaaagaauuuccagacgaugcccggcacauuccagacuaccacaggggaaaucggagcgauugcccuggauuuuaagccuggcaccucggguucaccgaucauuaaccgggaggggaaagugguuggacuuuacggcaauggcguggucacuaagaacgggggauaugugucugguaucgcacaaaccaaugcugagccagacggccccacaccugaauuagaggaagagauguucaaaaagagaaaccugacgauaauggaucuccacccagggaguggaaaaacuaggaaguacuugcccgccauuguucgugaagcuaucaagcgccggcugagaacccucauccuggcaccuacaaggguggucgccgccgagauggaggaagcucuuaaaggccugccgauucgauaucagaccacugcgacaaaguccgagcauaccggucgggaaaucguggacuugaugugccacgcaacguuuacuaugcgccuacugagccccguaagagugccaaauuacaaccucauaauuauggaugaggcccauuucacagacccugcuucuaucgccgcaaggggguauauuagcacccggguuggaaugggcgaagccgcugcgaucuuuaugaccgccacucccccaggcacagcagaugcuuucccucaguccaaugcccccauacaggacgaggagcgagacauuccagaaagaucauggaacagugggaaugaguggaucaccgauuuugcaggaaaaacagucugguucgugccgagcaucaaggccgguaacgacauugcuaacuguuuacgcaaaaauggcaagaaggugauccaacugucuaggaaaacuuuugauacggaauaccagaagaccaaacuuaacgacugggauuucgucguaacaacugacauuuccgagaugggggccaauuuuaaggcggaucgugugauagacccucggagaugccugaaacccguuauccucaccgauggaccagagagggugauuuuggcaggccccaugccugucacagccgcuucagccgcucagcgccgagguagaguggggcggaacccacagaaggaaaaugaccaauacaucuucaccggccagccccugaacaaugaugaggaccacgcacacuggacugaagccaagaugcuccuggacaacaucaauacgccugagggaauuauaccggcucuuuucgaaccagagagggagaaaagugccgcaaucgauggcgaauaucgccuaaagggggagagccguaaaaccuuuguugaacugaugagacggggagacuugcccgugugguuagcgcauaaggucgccuccgaggguauuaaauacacagauaggaaguggugcuucgacggccagcgcaacaaucagauccuggaagagaacauggauguggagauuuggacuaaagaaggggagaagaagaaacuccgaccuagauggcuggacgcucggaccuauucugauccccuugcccugaaggaauuuaaagaguucgcagcuggaaggaagucgaucgcccucgacuugguaacagaaauaggccgcgugccaagccaccuggcacauagaaccaggaaugcccuagauaaccugguuaugcuccacacuucagagcacggugggcgggcuuaccgucaugcggucgaggaacuuccugagacaauggaaacgcuguuauugcugggccucaugauccugcuuaccggaggcgccaugcuguuucucauuuccgggaaaggaaucgguaagacuaguauuggcuugaucugugugauagcaucuagcgggaugcuguggauggcugagauucccuuacaauggaucgccuccgccauugugcuagaguucuuuaugaugguccugcucaucccagaaccugagaagcagcgcacaccgcaggacaaucaacuugcauauguugugauaggaauccugaccuuggcugccauuaucgcggcuaacgaaaugggccugcucgagaccacaaaacgagaucuggguaugucaaaggaacccgggguagugucuccaacuagcuaccuugacgucgaucuccacccugccagugcauggacgcuguaugccguggcuaccacaguuauuacucccauguugagacauaccaucgagaauuccacagcaaacgugagccuggccgcgauagcuaaccaggccgucguauuaaugggccuagacaaaggauggccaauuucuaagauggaccugggcgugccucuccuugcacuggggugcuacucacagguuaaucccuugacccugacugccgcugugcuccugcuuaucacgcacuacgccaucauuggaccgggcuuacaggcaaaagcuacaagggaggcccaaaagcggaccgcggccgguaucaugaagaacccaacugucgaugggauaaugaccauugaccuggauccugugaucuaugacuccaaauucgaaaagcagcucggacaggucauguugcuggugcuauguguugugcagcugcuccuuaugcgcacaaguugggcacugugcgaggcuuugacucuggccaccggccccauuacaacgcucugggaagguagcccaggcaaauuuuggaauaccacuaucgcaguaucgauggcuaacauauucagagggucuuaccuggccggagccggcuuagcguuuuccaucaugaagagcguggggacaggaaaaaggggcaccgguucacaaggggagacucuuggagaaaaguggaagaaaaagcugaaucagcucagucggaaagauuucgaccuauauaagaaaucuggcauuacagaggucgaucgaaccgaggcuaaggaaggucugaaaagaggcgagaucacgcaucacgcaguuucccgcgggagcgccaaguugcagugguuuguggaaaggaacauggucauucccgagggacgggugaucgaccugggcugugggcguggaggcuggucauacuauugcgcuggucucaagaaaguaaccgaagugagaggguacacaaagggaggcccuggccacgaggagccgguucccaugaguacuuauggguggaauauugugaaacuuaugagcggaaaggaugucuucuaccugccaccugaaaaaugugacaccuugcugugcgauaucggugaguccucucccagcccuacaguggaagaguccaggacuauacgcguccucaagaugguggagccaugguuaaagaacaaucaguucuguauuaaaguucugaaccccuacaugccuaccguaaucgaacaucuugagcggcugcaacgaaagcacggcgggaugcuagugagaaauccacucucaaggaacucuacacaugaaauguauuggaucaguaauggaaccggcaacauugucgccucggugaauaugguuagccgccuguugcugaaccgguuuacuaugacgcacagacgucccacaauagagaaagacguggaucucggugcagggaccaggcacgucaacgccgaaccggagacuccuaauauggacgugaucggagagcggauuaagcgcaucaaagaagagcauaacuccaccuggcacuacgacgaugaaaauccauauaagacaugggcuuaccauggcucuuaugagguaaaggcgacgggcucagccagcuccaugauuaacggggugguuaaacuucugaccaagcccugggacgucgugccuauggugacucagauggcaaugacagauaccacuccauucggacagcaacgagucuuuaaagaaaagguugacacaagaacccccaggaguaugccggguacacggcgcgugaugggcaucacugcugagugguuauggagaacccuggggaggaauaaaaagccucgauugugcacgcgggaggaauucaccaagaaaguacguacaaacgccgcaaugggagccguguuuacugaggaaaaucagugggauucugcuaaggccgcggucgaggacgaagauuucuggaaacucguggacagagagcgcgagcugcacaagcuaggcaaaugugguagcugcguuuacaacaugauggggaagagggaaaaaaagcuuggagaguuuggcaaggcaaaaggcucacgggccauaugguauauguggcugggggcuagauaccucgaauucgaggcccugggauuuuugaaugaggaucauugguucucccgcgaaaacaguuacagcgguguggagggcgaagggcugcacaagcucggauauauccuuagggacauuucuaaaauccccggcgcagcuauguacgccgaugacaccgcugguugggacacacgaauuacugaggaugaccugcacaaugaagagaagaucacccagcagauggauccagagcaucggcaauuagccaacgcaauauuuaaacugacguaucagaauaaggucgugaagguacagagaccuacacccaccgggacuguuauggacauuaucuccaggaaagaucagcgcggaucaggccaagugggcacauacggguugaacaccuucacuaauauggaagcgcagcucauccgucagauggagggagaagguguccugagcaaggccgaccuagagaacccacaccuucccgaaaaaaagauuacccaguggcuggagacaaaaggcguggagcggcucaagagaauggcuauaucgggggaugacugcguggucaagccuaucgaugacagguuugccaacgcacuguuggcuuuaaaugauaugggaaaaguucgcaaggacauuccacaauggcagccgucuaaaggcuggcaugauuggcagcaggugcccuucuguagucaccacuuccaugaacugaucaugaaggacggucgaaaacucguagugccuugccggccacaagacgagcuuauugggagagccaggaucucccagggagcaggcuggagccugaaggaaacggccugucuaggcaaggcguaugcucagauguggucacugauguacuuucaccgcagagaucuccgguuggccuccaacgcaauaugcucugccguccccgugcauuggguuccuaccagcaggacuacauggaguauccacgcucaucaccaauggaugaccacugaggacaugcugacaguguggaaucgugucuggauugaagauaacccauggauggaggacaaaacccccgugacgacaugggagaauguaccuuaucuugggaagcgagaagaucagugguguggaucccugaucggucucaccagccgcgccacuugggcacagaacauuccgaccgcuauccagcaaguuagaucuuuaauuggcaaugaggaauuccuggacuacaugccaucaaugaaacgguuuaggaaggaggaggaaagugagggggccauaugguga

SEQ ID NO: 15280 - RNA, 9873 nt, Artificial Sequence
  derived and/or modified CDS sequence (opt3) from DENV-3__HM756274__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacgcuuuuguccucaagaaagaggugucugaaacgcagcacgggaccauccugauuaaggucgaguacaagggagaagaugugcccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgcaggugcuugggagaauggcgucugugggauacgaagcaccacacgcauggaaaaccuccuguggaaacagaucgccaaugagcuuaacuauauuuugugggaaaauaacaucaagcugacgguuguggugggagacauuaucggcguacucgagcaggggaaaagaacccugacuccacagccuauggaguuaaaguacucauggaaaacauggggaaaggcgaagauagucaccgccgaaacacaaaacaguuccuucauuaucgauggccccaauacuccagagugccccagcgugucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaaccauaggcccggguaucacacacaaacugccggaccuuggcaccuuggcaaguuggagcuggacuuuaauuacugcgaggggaccacaguggugauuacggaaaacuguggaacccguggcccaaguuuacggacuacaaccgucucugguaaacucauccaugaguggugcugucgaagcugcacucugcccccucuuagauauaugggggaagauggauguugguacggcauggagauaaggccaauuuccgaaaaggaggagaauaugguuaaaucacuggugagcgcugguucuggcaagguagacaacuucacaauggggguguugugccucgccauccuguuugaagaggucaugcgcggaaaguucggcaaaaagcacaugaucgcagggguguucuuuaccuucguucuacugcucuccggacagauuacguggcgggauauggcucauacucugaucaugauuggcaguaaugccagcgacagaauggguaugggggugaccuaucuugcauugauagccacauuuaaaauccagcccuuccuggcuuuaggauuuuuccucaggaagcugaccucucgcgaaaaccuucugcuaggcgucggccucgcgauggccacuacacugcaauugccggaggauauugaacagauggcaaaugggaucgcucugggauuaauggcccucaaacugauuacccaguuugagacauaccagcuuuggacugcccugaucuccuugaccuguucaaacacgauauucacacucaccguggcuuggcgaacugcaacccugauccuagccgguguuagucugcuuccugugugccaaagcucguccaugcggaagacagacuggcucccaauggcggucgcugccaugggcguacccccucugcccuuguuuauuuucgggcugaaggauacuuuaaaacguagaucuuggccacucaaugagggagugauggcaguuggccuggugagcauccuugccucaagucuguugaggaacgacgucccuauggcugguccccucguggcagggggacugcuaauugccuguuauguaaucaccggcacguccgcggaucugacaguggaaaaggcugccgacauaaccugggaggaagaggcagaacagacuggcgucucucacaaccuuaugauuacaguugacgaugacgggaccaugcgcaucaaagaugacgagacugagaauauccucacagugcuguugaagaccgccuuacugauugugagcggaauauuuccauacuccaucccggcuacgcuccuggucuggcauacuuggcagaaacagacccaacggucaggugugcuuugggauguuccuagccccccagaaacacagaaggccgagcuggaagagggcguauacagaauuaaacagcaggggaucuucggaaagacccaagugggcgucggugugcagaaggaggggguuuuucacacaauguggcacgugacuaggggagcagucuugacccauaacggcaaacgacuagaacccaauugggcuagugugaagaaagaccugauuucuuauggcgggggauggcgccucuccgcccaguggcaaaagggugaggaaguacaggucaucgcgguggagccuggcaaaaacccaaagaauuuccagacgaugcccgggacauuccagacuaccacaggagaaauaggcgccaucgcacuggauuuuaagccugguaccagcgggucgccgauuaucaaccgggagggaaaaguugugggccuuuacggcaauggggucgugacuaagaacggagguuauguuucaggcauugcucaaaccaaugccgagccagacgggcccacaccugaauuagaggaagagauguucaaaaagagaaaccugacgaucauggaucuccacccaggaucuggcaaaacuaggaaguacuugcccgcuauagugcgugaagcaauuaagcgccggcugagaacccucauccuggccccuacaagggucguggccgcugagauggaggaagcgcuuaaaggucugccgauccgauaucagaccacugcaacaaagagugagcauaccgggcgggaaauuguagacuugaugugccacgccacguuuacuaugcgccuacugucccccgugagaguuccaaauuacaaccucaucauaauggaugaggcucauuucacagacccugccagcauugcagccaggggauauaucucuacccgggucggcaugggcgaagcugcggccauuuuuaugaccgcaacucccccagggacagcugaugccuucccucagagcaaugcacccauccaggacgaggagcgagacauaccagaaagauccuggaacucaggaaaugaguggauuaccgauuuugccgguaaaacagugugguucgugccgaguaucaaggcuggcaacgacaucgccaacuguuuacgcaaaaaugggaagaaggucauucaacugagcaggaaaacuuuugauacggaauaccagaagaccaaacuuaacgacugggauuucguagugacaacugacaucucugagaugggagcgaauuuuaaggcagaucguguuauugacccucggagaugccugaaacccgugauacucaccgauggcccagagagggucaucuuggccggucccaugccugugacagcugccuccgcugcacagcgccgagggagaguuggccggaacccacagaaggaaaaugaccaauacauuuucaccggacagccccugaacaaugaugaggaccacgcccacuggacugaagcuaagaugcuccuggacaacaucaauacgccugagggcaucauuccggcccuuuucgaaccagagagggagaaaucagcagcgauagauggggaauaucgccuaaagggagagagucguaaaaccuuuguggaacugaugagacggggugacuugcccgucugguuagcccauaagguggcuagcgagggcaucaaauacacagauaggaaguggugcuucgacgggcagcgcaacaaucagauucuggaagagaacauggauguagagaucuggacuaaagaaggagagaagaagaaacuccgaccuagauggcuggacgcccggaccuauuccgauccccuugcacugaaggaauuuaaagaguucgcugccggcaggaagucuauugcacucgacuuggugacagaaaucggucgcguuccaucgcaccuggcccauagaaccaggaaugcucuagauaaccuggucaugcuccacacuagcgagcacgggggccgggcguaccgucaugccguggaggaacuuccugagacaauggaaacgcuguuauugcugggacucaugauacugcuuaccggcggggcaaugcuguuucucaucucaggaaaagguauuggcaagacuuccaucggguugauuugugugaucgcuaguucuggaaugcuguggauggccgagauacccuuacaauggauugccagcgcaaucguccuagaguucuuuaugaugguucugcucauuccagaaccugagaagcagcgcacaccgcaggacaaucaacuugcuuaugugguaaucggcauacugaccuuggccgcgaucauugcugccaacgaaaugggucugcucgagaccacaaaacgagaucuggggauguccaaggaacccggcguggucucaccaacuucuuaccuugacguggaucuccacccugcaagcgccuggacgcuguaugcuguugcaaccacagugaucacucccauguugagacauaccauugagaauaguacagccaacgucucccuggcggcuaucgccaaccaggcaguaguguuaaugggacuagacaaaggcuggccaauaagcaagauggaccuggggguuccucuccuugcccugggaugcuacucucaggugaaucccuugacccugacugcugccguccuccugcuuauuacgcacuacgcaaucaucggcccggguuuacaggcuaaagccacaagggaggcgcaaaagcggaccgccgcagggauuaugaagaacccaacuguggauggaaucaugaccauagaccuggauccugucauuuaugacucaaaauucgaaaagcagcucggccaggugauguugcugguucuaugugcugugcagcugcuccuuaugcgcacauccugggcccugugcgaggcauugacucuggcuaccggucccaucacaacgcucugggaaggcaguccagggaaauuuuggaauaccacuauugccguaagcauggccaacaucuucagaggaucguaccuggcgggcgcuggguuagcauuuucuauaaugaaguccgugggaacaggcaaaagggguaccgggagccaaggagagacucuuggcgaaaaguggaagaaaaagcugaaucagcucucacggaaagauuucgaccuauauaagaaaagugguaucacagaggucgaucgaaccgaggccaaggaaggccugaaaagaggggagauuacgcaucacgcuguuucucgcggauccgccaaguugcagugguuuguggaaaggaacauggucauccccgagggccgggugauugaccugggguguggacguggcgguuggagcuacuauugcgcagggcucaagaaaguaaccgaagugagaggauacacaaagggcggcccugggcacgaggagccgguucccaugucaacuuauggauggaauaucgugaaacuuaugagugguaaggaugucuucuaccugccaccugaaaaaugugacaccuugcugugcgauauuggcgagagcucccccucuccuacaguggaagagagcaggacuauccgcguccucaagaugguggagccaugguuaaagaacaaucaguucuguauaaaaguucugaaccccuacaugccuaccguaauugaacaucuugagcggcugcaacgaaagcacgggggaaugcuagugagaaauccacucuccaggaacucaacacaugaaauguauuggaucucuaauggcaccgguaacaucgucgccagugugaauaugguuucgcgccuguugcugaaccgguuuacuaugacgcacagacgucccacaauugagaaagacguggaucucggggcuggaaccaggcacgucaacgcggaaccggagacuccuaauauggacgugauaggcgagcggaucaagcgcauuaaagaagagcauaacagcaccuggcacuacgacgaugaaaauccauauaagacaugggccuaccauggcuccuaugagguaaaggcaacggggucugcuucaagcaugaucaacggagugguuaaacuucugaccaagcccugggacgucgugccuauggugacucagauggccaugacagauaccacuccauucggucagcaacgagucuuuaaagaaaagguugacacaagaacccccagguccaugccgggcacacggcgcgugauggggauuacugcagagugguuauggagaacccugggaaggaauaaaaagccucgauugugcacgcgggaggaauucaccaagaaaguacguacaaacgccgcuaugggcgccguguuuacugaggaaaaucagugggauagugcgaaggcagccgucgaggacgaagauuucuggaaacucguggacagagagcgcgagcugcacaagcuagguaaaugugggucuugcguuuacaacaugaugggaaagagggaaaaaaagcuuggcgaguuuggcaaggcuaaagggagccgggccaucugguauauguggcugggagcaagauaccucgaauucgaggcucuggguuuuuugaaugaggaucauugguucucacgcgaaaacuccuacaguggcguggagggggaaggacugcacaagcucggcuauauacuuagggacaucagcaaaauucccgguggggccauguacgcugaugacaccgccggaugggacacacgaaucacugaggaugaccugcacaaugaagagaagauuacccagcagauggauccagagcaucggcaauuagcaaacgcgaucuuuaaacugacguaucagaauaaggucgugaagguacagagaccuacacccaccggcacuguuauggacauaauuucuaggaaagaucagcgcggcuccgggcaagugggaacauacgguuugaacaccuucacuaauauggaagcccagcucauccgucagauggagggcgaagggguccugucaaaggcugaccuagagaacccacaccuucccgaaaaaaagaucacccaguggcuggagacaaaaggaguggagcggcucaagagaauggccauuagcggcgaugacugcguggucaagccuauagaugacagguuugcaaacgcucuguuggccuuaaaugauauggguaaaguucgcaaggacaucccacaauggcagccgucgaaaggguggcaugauuggcagcaggugcccuucuguucucaccacuuccaugaacugauuaugaaggacggacgaaaacucguagugccuugccggccacaagacgagcuuaucggcagagcaaggauuagucagggcgccggguggucccugaaggaaacggcgugucuaggaaaggcuuaugcccagauguggagccugauguacuuucaccgcagagaucuccgguuggcaucaaacgccaucugcuccgcuguccccgugcauuggguuccuaccucuaggacuacauggagcauacacgcccaucaccaauggaugaccacugaggacaugcugacaguguggaaucgugucuggaucgaagauaacccauggauggaggacaaaacccccgugacgacaugggagaauguaccuuaucuugguaagcgagaagaucagugguguggcagucugauugggcucaccucccgcgcaacuugggcucagaacaucccgaccgccauucagcaaguuagaagcuuaaucggaaaugaggaauuccuggacuacaugccaucuaugaaacgguuuaggaaggaggaggaaucagagggcgcgauuugguga

SEQ ID NO: 15281 - RNA, 9873 nt, Artificial Sequence
  derived and/or modified CDS sequence (opt3) from DENV-3__HM756275__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcagcaugaaaaucugaaguauacugucauuaucaccgugcacacaggugaccagcaucagguuggcaacgagacccaaggggugacugcagaaauuacgccucaggcuuccacaaccgaggccauccucccagaauacggaacucuuggccuggagugcucuccgcgaaccgguuuggacuucaaugagaugauccuacugacaaugaaaaacaaggcguggaugguccacagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcauacagcucucaccggcgccacagaaauucagaauucagggggaacuaguauauucgcaggucaccugaagugucgguuaaaaauggacaagcuggagcuaaaaggcaugagcuaugccaugugcaccaacacguuuguccucaagaaagaggugucugaaacccagcaugggacaauccugauuaaggucgaguacaagggagaagaugugcccuguaaaaucccuuucuccacugaggacggccaagguaaggcucacaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguacaagaaggggagcaguauuggaaaaauguuugaagcuacugcccgcggugcaagaaggauggccauacugggcgacaccgcuugggauuucgggucugugggaggcguucucaacucccuggguaagauggugcaucagaucuuugggagcgccuauacggcacuuuucucgggcgucucuugggugaugaaaauuggaaucggcguacuguugacauggaucgggcucaauuccaagaacaccucaaugaguuuuagcugcauugcgauaggaaucauuacucuguacuuaggcgcugugguucaggccgacauggguugugucaucaauuggaaagggaaggagcugaagugcggauccggcauuuucgugacaaacgaggugcacaccuggacugaacaguauaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuacauuuugugggaaaauaacaucaagcugaccguuguggugggagacauuaucggcguacucgagcaggggaaaagaacucugacaccacagccuauggaguuaaaguauucauggaaaaccuggggaaaggccaagauagucacagcggaaacucaaaacaguuccuucauuaucgauggccccaauaccccagagugccccagcgugucuagggccuggaacguuugggaaguggaggacuacgguuuuggggucuucacgacaaauauuuggcugaaacuucgggaaguguauacccaguugugugaccaccgccucaugucagcugcaguuaaggaugagagagccgugcaugcugacaugggauacuggaucgagagucagaaaaacggcagcuggaagcuggaaaaagccucccuaauagagguaaagacuugcaccuggccuaagucucacacacuguggucgaaugguguccucgaaagcgauaugaucauuccaaaaucccuggcaggcccgaucucacagcauaaccacaggcccggguaccacacucaaaccgcgggaccuuggcaucuuggcaaguuggagcuggacuuuaauuauugcgaggggacaacgguggugauuaccgaaaacuguggaacucguggcccaaguuuacggacaaccacugucucugguaaacucauccacgaguggugcugucgaagcugcacacugcccccucuuagauacaugggggaagauggauguugguauggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcauaugaucgccgggguguucuuuacguucguucuacugcucuccggacagauuacuuggcgggauauggcacacacccugaucaugauuggcaguaaugcuagcgacagaauggguaugggggugacauaccuugccuugauagcaaccuuuaaaauccagcccuuccuggccuuaggauuuuuccucaggaagcugacuucucgcgaaaaccuucugcuaggcgucggccucgcuauggcgacaacccugcaauugccggaggauauugaacagauggccaaugggaucgcacugggauuaauggcucucaaacugauuacacaguuugagaucuaucagcuuuggacugcccugauauccuugaccuguucaaacacgaucuucacacucaccguggccuggcgaacugcuacccugauucuagcagguguuagucugcuuccuaugugccaaagcucguccaugcggaagacagacuggcucccaauggccguggcggcuaugggcguccccccucugcccuuguuuaucuucucucugaaggauacuuuaaaacguagaagcuggccacucaaugaggggguaauggccgugggacugguuucaauucuugcaaguucccuguugaggaacgacgugccuauggccggcccccucgucgcuggugggcugcuaaucgcauguuacgugauaaccggaacgucugccgaucugacaguagaaaaggcggcugacauuaccugggaggaagaggccgaacagacuggcgugagccauaaccuuaugaucacagucgacgaugacggcaccaugcgcaucaaagaugacgagacugagaauauucucacaguucuguugaagaccgcauuacugauaguguccgggaucuuuccauauucaauuccggccacgcuccugguguggcacacuuggcagaaacagacccaacggagcggaguccuuugggaugugccuagucccccagaaacacagaaggcugagcuggaagaggguguuuacagaaucaaacagcagggcauuuucgggaagacccaaguaggagugggcguccagaaggaggguguguuucacacaauguggcauguuacuaggggggccguguugaccuacaacggaaaacgacuagaacccaauugggcaucugucaagaaagaccugaucuccuauggcggcggguggcgccucagcgcucaguggcaaaagggagaggaagugcagguaauagccgucgagccugguaaaaacccaaagaauuuccagacgaugcccggcacauuccagacuaccacaggggaaaucggagcgauugcccuggauuuuaagccuggcaccucggguucaccgaucauuaaccgggaggggaaagugguuggacuuuacggcaauggcguggucacuaagaacgggggauaugugucugguaucgcacaaaccaaugcugagccagacggccccacaccugaauuagaggaagagauguucaaaaagagaaaccugacgauaauggaucuccacccagggaguggaaaaacuaggaaguacuugcccgccauuguucgugaagcuaucaagcgccggcugagaacccucauccuggcaccuacaaggguggucgccgccgagauggaggaagcucuuaaaggccugccgauucgauaucagaccacugcgacaaaguccgagcauaccggucgggaaaucguggacuugaugugccacgcaacguuuacuaugcgccuacugagccccguaagagugccaaauuacaaccucauaauuauggaugaggcccauuucacagacccugcuucuaucgccgcaaggggguauauuagcacccggguuggaaugggcgaagccgcugcgaucuuuaugaccgccacucccccaggcacagcagaugcuuucccucaguccaaugcccccauacaggacgaggagcgagacauuccagaaagaucauggaacagugggaaugaguggaucaccgauuuugcaggaaaaacagucugguucgugccgagcaucaaggccgguaacgacauugcuaacuguuuacgcaaaaauggcaagaaggugauccaacugucuaggaaaacuuuugauacggaauaccagaagaccaaacuuaacgacugggauuucgucguaacaacugacauuuccgagaugggggccaauuuuaaggcggaucgugugauagacccucggagaugccugaaacccguuauccucaccgauggaccagagagggugauuuuggcaggccccaugccugucacagccgcuucagccgcucagcgccgagguagaguggggcggaacccacagaaggaaaaugaccaauacaucuucaccggccagccccugaacaaugaugaggaccacgcacacuggacugaagccaagaugcuccuggacaacaucaauacgccugagggaauuauaccggcucuuuucgaaccagagagggagaaaagugccgcaaucgauggcgaauaucgccuaaagggggagagccguaaaaccuuuguugaacugaugagacggggagacuugcccgugugguuagcgcauaaggucgccuccgaggguauuaaauacacagauaggaaguggugcuucgacggccagcgcaacaaucagauccuggaagagaacauggauguggagauuuggacuaaagaaggggagaagaagaaacuccgaccuagauggcuggacgcucggaccuauucugauccccuugcccugaaggaauuuaaagaguucgcagcuggaaggaagucgaucgcccucgacuugguaacagaaauaggccgcgugccaagccaccuggcacauagaaccaggaaugcccuagauaaccugguuaugcuccacacuucagagcacggugggcgggcuuaccgucaugcggucgaggaacuuccugagacaauggaaacgcuguuauugcugggccucaugauccugcuuaccggaggcgccaugcuguuucucauuuccgggaaaggaaucgguaagacuaguauuggcuugaucugugugauagcaucuagcgggaugcuguggauggcugagauucccuuacaauggaucgccuccgccauugugcuagaguucuuuaugaugguccugcucaucccagaaccugagaagcagcgcacaccgcaggacaaucaacuugcauauguugugauaggaauccugaccuuggcugccauuaucgcggcuaacgaaaugggccugcucgagaccacaaaacgagaucuggguaugucaaaggaacccgggguagugucuccaacuagcuaccuugacgucgaucuccacccugccagugcauggacgcuguaugccguggcuaccacaguuauuacucccauguugagacauaccaucgagaauuccacagcaaacgugagccuggccgcgauagcuaaccaggccgucguauuaaugggccuagacaaaggauggccaauuucuaagauggaccugggcgugccucuccuugcacuggggugcuacucacagguuaaucccuugacccugacugccgcugugcuccugcuuaucacgcacuacgccaucauuggaccgggcuuacaggcaaaagcuacaagggaggcccaaaagcggaccgcggccgguaucaugaagaacccaacugucgaugggauaaugaccauugaccuggauccugugaucuaugacuccaaauucgaaaagcagcucggacaggucauguugcuggugcuauguguugugcagcugcuccuuaugcgcacaaguugggcacugugcgaggcuuugacucuggccaccggccccauuacaacgcucugggaagguagcccaggcaaauuuuggaauaccacuaucgcaguaucgauggcuaacauauucagagggucuuaccuggccggagccggcuuagcguuuuccaucaugaagagcguggggacaggaaaaaggggcaccgguucacaaggggagacucuuggagaaaaguggaagaaaaagcugaaucagcucagucggaaagauuucgaccuauauaagaaaucuggcauuacagaggucgaucgaaccgaggcuaaggaaggucugaaaagaggcgagaucacgcaucacgcaguuucccgcgggagcgccaaguugcagugguuuguggaaaggaacauggucauucccgagggacgggugaucgaccugggcugugggcguggaggcuggucauacuauugcgcuggucucaagaaaguaaccgaagugagaggguacacaaagggaggcccuggccacgaggagccgguucccaugaguacuuauggguggaauauugugaaacuuaugagcggaaaggaugucuucuaccugccaccugaaaaaugugacaccuugcugugcgauaucggugaguccucucccagcccuacaguggaagaguccaggacuauacgcguccucaagaugguggagccaugguuaaagaacaaucaguucuguauuaaaguucugaaccccuacaugccuaccguaaucgaacaucuugagcggcugcaacgaaagcacggcgggaugcuagugagaaauccacucucaaggaacucuacacaugaaauguauuggaucaguaauggaaccggcaacauugucgccucggugaauaugguuagccgccuguugcugaaccgguuuacuaugacgcacagacgucccacaauagagaaagacguggaucucggugcagggaccaggcacgucaacgccgaaccggagacuccuaauauggacgugaucggagagcggauuaagcgcaucaaagaagagcauaacuccaccuggcacuacgacgaugaaaauccauauaagacaugggcuuaccauggcucuuaugagguaaaggcgacgggcucagccagcuccaugauuaacggggugguuaaacuucugaccaagcccugggacgucgugccuauggugacucagauggcaaugacagauaccacuccauucggacagcaacgagucuuuaaagaaaagguugacacaagaacccccaggaguaugccggguacacggcgcgugaugggcaucacugcugagugguuauggagaacccuggggaggaauaaaaagccucgauugugcacgcgggaggaauucaccaagaaaguacguacaaacgccgcaaugggagccguguuuacugaggaaaaucagugggauucugcuaaggccgcggucgaggacgaagauuucuggaaacucguggacagagagcgcgagcugcacaagcuaggcaaaugugguagcugcguuuacaacaugauggggaagagggaaaaaaagcuuggagaguuuggcaaggcaaaaggcucacgggccauaugguauauguggcugggggcuagauaccucgaauucgaggcccugggauuuuugaaugaggaucauugguucucccgcgaaaacaguuacagcgguguggagggcgaagggcugcacaagcucggauauauccuuagggacauuucuaaaauccccggcggugcaauguacgcugaugacaccgccgggugggacacacgaauuacugaggaugaccugcacaaugaagagaagaucacccagcagauggauccagagcaucggcaauuagcuaacgccauauuuaaacugacguaucagaauaaggucgugaagguacagagaccuacacccaccggaacuguuauggacauuaucuccaggaaagaucagcgcggcucaggccaaguggggacauacggauugaacaccuucacuaauauggaagcacagcucauccgucagauggagggugaaggcguccugagcaaggcggaccuagagaacccacaccuucccgaaaaaaagauuacccaguggcuggagacaaaagggguggagcggcucaagagaauggccauaucgggagaugacugcguggucaagccuaucgaugacagguuugcuaacgcccuguuggcauuaaaugauaugggcaaaguucgcaaggacauuccacaauggcagccgucuaaagguuggcaugauuggcagcaggugcccuucuguagucaccacuuccaugaacugaucaugaaggacgggcgaaaacucguagugccuugccggccacaagacgagcuuauuggaagagcuaggaucucccagggcgccggcuggagccugaaggaaacggcaugucuagggaaggccuaugcgcagauguggucacugauguacuuucaccgcagagaucuccgguuggcuuccaacgccauaugcucugcaguccccgugcauuggguuccuaccagcaggacuacauggaguauccacgcccaucaccaauggaugaccacugaggacaugcugacaguguggaaucgugucuggauugaagauaacccauggauggaggacaaaacccccgugacgacaugggagaauguaccuuaucuuggaaagcgagaagaucaguggugugguucccugaucggccucaccagccgcgcuacuugggcccagaacauuccgaccgcaauccagcaaguuagaucuuuaauugggaaugaggaauuccuggacuacaugccaucaaugaaacgguuuaggaaggaggaggaaagugagggagcuauaugguga

SEQ ID NO: 15282 - RNA, 9873 nt, Artificial Sequence
  derived and/or modified CDS sequence (opt3) from DENV-3__JF937632__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauauaggggaagauggauguugguacggcauggagauuaggccaaucuccgaaaaggaggagaauaugguuaaaucacuggugagcgccgguucuggcaagguagacaacuucaccauggggguguugugccucgcuauccuguuugaagaggucaugcgcggaaaguucggcaaaaagcacaugauugccgggguguucuuuacguucguucuacugcucuccggacagaucacuuggcgggauauggcacauacccugauuaugauaggcaguaaugcuagcgacagaauggguaugggggugacauaucuugccuugaucgcaaccuuuaaaauucagcccuuccuggccuuaggauuuuuccucaggaagcugacuucucgcgaaaaccuucugcuaggcgucggccucgcuauggcgacaacccugcaauugccggaggauaucgaacagauggccaaugggauugcacugggauuaauggcucucaaacugaucacacaguuugagacuuaccagcuuuggaccgcccugauauccuugacguguucaaacacaaucuucacccucacuguggccuggcgaaccgcuacacugauucuagcagguguuagucugcuuccugugugccaaagcucguccaugcggaagacugacuggcucccaauggccgucgcggcuaugggcguacccccucugcccuuguuuaucuucucucugaaggauaccuuaaaacguagaagcuggccacucaaugagggggugauggccguuggacuggugucaauucuugcaaguucccuguugaggaacgacgucccuauggccggcccccucguggcuggugggcugcuaaucgcauguuauguaauaacgggaacaucugccgaucugaccguggaacgcgcggcugacauuacuugggaggaagaggccgaacagacaggcgucagccacaaccuuaugaucaccguugacgaugacggcacuaugcggaucaaggaugacgagacagagaauauucucaccgugcuguugaaaacggcauuacugauaguguccgggaucuuuccauacucaauuccggccacucuccuggucuggcauaccuggcagaagcagacacaaagaagcggagugcuuugggauguuccuagucccccagaaacccagaaagcugagcuggaagaggguguauacaggaucaagcagcagggcauuuucgggaaaacacaagugggagucggcgugcagaaggaggguguuuuucacacuauguggcacgugacccgaggggccgucuugacguauaacggaaagcgccuagaacccaauugggcaucugugaaaaaggaccugaucuccuacggcggcggguggcggcucagcgcucaguggcaaaaaggagaggaaguacaggucauagccguggagccugguaagaacccaaaaaauuuccagacaaugcccggcacuuuccagaccacaaccggggaaaucggagcgauugcccuggauuuuaagccuggcacuucggguucaccgaucauuaacagagaggggaagguugugggacuuuauggcaauggcgucgugaccaaaaacgggggauacguuucugguaucgcacaaacaaaugcugagccagacggccccacgccugaauuagaggaagagauguucaagaaaaggaaccugacuauaauggaucuccauccagggaguggaaagacccguaaauauuugcccgccauugugcgcgaagcuaucaagcggagacugaggacacucauccuggcaccuacccgagucguggccgccgagauggaggaagcucuuaagggccugccgauucgguaccagacuacagcgaccaaauccgagcacacgggucgcgaaaucguagacuugaugugccaugcaacuuuuacaaugagacuacugagccccgugaggguuccaaauuauaaccucauaauuauggaugaggcccacuucaccgacccugcuucuaucgccgcacggggguacauuagcacccgagucggaaugggcgaagccgcugcgaucuuuaugacugccacacccccaggcaccgcagaugcuuucccucaguccaaugcccccauacaggacgaggagagagacauuccagaacgcucauggaacagugggaaugaguggaucacagauuuugcaggaaagacugugugguucgugccgagcaucaaagccgguaacgacauugcuaacuguuuaaggaagaauggcaaaaaggucauccaacugucucguaagacguuugauaccgaauaccagaaaacaaagcuuaacgacugggauuucguagugacuaccgacauuuccgagaugggggccaauuuuaaagcggaucggguuauagacccuagaaggugccugaagcccgugauccucacagauggaccagagcgcgucauuuuggcaggccccaugccugugaccgccgcuucagccgcucagcgaagaggucggguugggaggaacccacagaaagaaaaugaccaauauaucuucacuggccagccccugaacaaugaugaggaccaugcacacuggacggaagccaagaugcuccuggacaacaucaauaccccugagggaauuauaccggcucuuuucgaaccagagcgcgagaagagugccgcaaucgauggcgaauaccgucuaaaaggggagagcagaaagacauuuguggaacugaugcggaggggagacuugcccgucugguuagcgcacaaaguggccuccgaggguauuaaguauacugaucgcaaauggugcuucgacggccagcgaaacaaucagauccuggaagagaacauggauguagagauuuggaccaaggaaggggagaaaaagaagcucagaccucgguggcuggacgcuaggacauacucugauccccuugcccugaaagaauuuaaggaguucgcagcuggacgcaaaucgaucgcccucgacuuggugaccgaaauaggcagaguuccaagccaucuggcacacaggacucggaaugcccuagauaaccuggucaugcuccauacaucagagcacggugggcgugcuuaucgccacgcgguggaggaacuuccugagacgauggaaacccuguuauugcugggccucaugauccugcuuacuggaggcgccaugcuguuucucauuuccgggaagggaaucgguaaaacaaguauuggcuugaucugugugauagcaucuagcgggaugcuguggauggcugagauucccuuacaauggaucgccuccgccauuguccuagaguucuuuaugaugguucugcucaucccagaaccugagaagcagcgaaccccgcaggacaaucaacuugcauacgugguaauaggaauccugaccuuggcugccauuaucgcggcuaacgaaaugggccugcucgagacaacuaagagagaucuggguaugucaaaagaacccgggguggucucuccaacgagcuaucuugacguggaucuccauccugccagugcauggacccuguacgccguugcuacaacugugauuacccccauguugaggcacacaaucgagaauuccaccgcaaacgucagccuggccgcgauagcuaaccaggccguaguguuaaugggccuagacaagggauggccaauuucuaaaauggaccugggcguuccucuccuugcacuggggugcuacucacaggugaaucccuugacucugacggccgcuguccuccugcuuaucacacauuaugccaucauuggaccgggcuuacaggcaaaggcuacccgggaggcccaaaaacgcacugcggccgguaucaugaagaacccaaccguggaugggauaaugacaauugaccuggauccugucaucuacgacuccaaguucgaaaaacagcucggacaggugauguugcugguucuaugugcagugcagcugcuccuuaugagaacuaguugggcucugugcgaggccuugacccuggcaacaggccccauuacgacccucugggaagguagcccaggcaaguuuuggaauacuacaaucgcuguaucgauggccaacauauucagggggucuuaucuggccggagcgggcuuagcuuuuuccaucaugaaaagcguggggaccggaaagcggggcacugguccccaaggggagacacuuggagaaaaauggaagaagaaacugaaucagcucucacgaaaggauuucgaccuauacaaaaagaguggcauuaccgaggucgauagaacggaggcaaaagaaggucugaagcgcggcgagaucacccaccaugccguuucuaggggguccgcuaaauugcagugguuuguggaacggaacauggucauuccugagggacgugugaucgaccugggcugugggagaggaggcuggagcuauuacugcgccggucucaagaagguaacagaagugaggggguauacuaaaggaggcccgggccacgaggagcccguuccaaugucaaccuacggguggaauauugugaagcuuaugaguggaaaagaugucuucuaccugccucccgaaaagugugacacauugcugugcgauaucggugagagcuccccuucuccaacuguggaagagagccgcaccauacggguccucaaaaugguggagcccugguuaaagaacaaucaguucuguauuaagguucugaacccuuauaugccaacaguaaucgaacaccuugagcgacugcaaagaaaacauggcgggaugcuagugaggaauccccucucccgcaacucaacccacgaaauguacuggaucucuaauggaacuggcaacauugucgcaagugugaauaugguuucgcggcuguugcugaacagauuuacgaugacacaucguaggccgaccauagagaaggacguggaucucggugccgggacucggcacgucaacgcugaaccugagaccccaaauauggacgugaucggagagcgcauuaaacgaaucaaggaagagcacaacagcacauggcauuaugacgaugaaaaucccuacaaaacgugggcguaucacggcuccuacgagguaaaggccaccggcucugcaucaagcaugauuaacggggugguuaagcuucugacuaaaccuugggacgucgugccaauggugacacagauggcuaugaccgauacuacacccuucggacagcaaagagucuuuaaggaaaaaguugacaccaggacaccgcgguccaugccugguacucgcagagugaugggcaucaccgccgagugguuauggaggacgcuggggcgaaauaagaaaccccgguugugcacccgugaggaauucacaaagaagguaagaacuaacgcagccaugggagcuguguuuaccgaggaaaaucagugggauagugccaaagcggcagucgaggacgaagauuucuggaagcucguggaccgcgagagggagcugcauaaacuaggcaagugugguucuugcguuuauaacaugauggggaaacgggaaaagaaacuuggagaguuuggcaaggccaagggcagcagagcuauaugguacauguggcugggggcccgcuaccucgaauucgaggcacugggauuuuugaaugaggaucacugguucucaagggaaaacuccuauagugguguggagggcgaagggcugcaucgacucggauacauccuucgggacauuagcaaaaucccaggcggugcuauguaugccgaugacacagcugggugggacacuagaauuaccgaggaugaccugcacaaugaagagaagaucacgcagcagauggauccugagcacaggcaauuagccaacgcaauauuuaaacugacauaccagaauaaggucgugaaaguacagcgccccaccccaacuggaacaguuauggacauuaucucucguaaggaucagcggggcuccggccaaguggggaccuauggauugaacacuuucaccaauauggaagcgcagcucaucagacagauggagggugaaggcguccugucaaaggccgaccuagagaacccccaucuuccugaaaaaaagauuacacaguggcuggagacgaaagggguggagaggcucaagcgcauggcuauaagcggagaugacugcguggucaaaccaaucgaugaccgauuugccaacgcacuguuggcuuuaaaugauaugggcaagguucggaaggacauuccgcaauggcagcccucgaaagguuggcacgauuggcagcaggugccuuucuguucucaucacuuccacgaacugaucaugaaggacgggagaaaacucguagugccaugcaggccccaagacgagcuuauuggacgcgccagaaucagucagggcgcaggcuggucccugaaggaaaccgccugucuagggaaagcguacgcucagauguggagccugauguauuuucaucggagggaucuccguuuggccucaaacgcaauaugcuccgccgucccugugcacuggguuccaacuucucgaacaaccuggagcauccaugcucaccaucaauggaugacuacagaggacaugcugaccguguggaaucgcgucuggauugaagauaaccccuggauggaggacaagacgccugugacaaccugggagaauguaccguaccuuggaaagagagaagaucaguggugugguagucugaucggccucacuucccgggccaccugggcacagaacauuccaacagcuauccagcaaguuaggagcuuaauugggaaugaggaauuccuggacuacaugcccucuaugaaacgcuuuagaaaggaggaggaaucagagggagccauaugguga

SEQ ID NO: 15283 - RNA, 9873 nt, Artificial Sequence
  derived and/or modified CDS sequence (opt3) from DENV-3__HM756281__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucgugaauuggaaagggaaggagcugaagugcggauccggcaucuucgugacaaacgagguccauaccuggacugaacaguacaaauuucaagcagauucucccaagcggcuagccaccgcuauugccggugcaugggagaauggcguuugugggauccgaagcacaacgcgcauggaaaaccuccuguggaaacagauagcuaaugagcuuaacuauaucuugugggaaaauaacauuaagcugaccguggugguaggagacaucauuggcguccucgagcaggggaaaagaacucugacaccacagccuaaggaguuaaaauacucauggaagaccuggggaaaggccaaaaucgugacagcggaaacucaaaacaguuccuucauaauugauggccccaauaccccagagugccccagcguuucuagggccuggaacgugugggaagucgaggacuaugguuuugggguguucacgacaaauaucuggcugaagcuucgggaaguuuacacccaguugugugaccaccgccucaugucagcugcagugaaagaugagagagccguacacgcugacaugggauacuggauugagagucagaagaacggcagcuggaaacuggaaaaggccucccuaaucgaggucaagacuugcaccuggccuaaaucucauacacuguggucgaauggugugcucgaaagcgauaugauaaucccaaagucccuggcaggcccgauuucacagcacaaccauaggcccggguaucacacucaaaccgcgggaccuuggcaccuuggcaaauuggagcuggacuuuaauuacugcgaggggacaacgguggucaucaccgaaaacuguggaacucguggcccaaguuuacggacaaccacuguuucugguaagcucauucaugaguggugcugucgaagcugcacacugcccccucuuagauauaugggggaagauggauguugguacggcauggagaucaggccaauauccgaaaaagaggagaauauggugaagucacugguaagcgccgguucuggcaagguggacaacuucaccaugggggucuugugccucgcuauucuguuugaagaggugaugcgcggaaaauucggcaagaaacacaugaucgccgggguuuucuuuacguucgugcuacugcucuccggacagaucacuuggcgggauauggcacauacccugauuaugaucggcaguaaugcuagcgacagaauggguaugggggucacauaucuugccuugauugcaaccuuuaagauacagcccuuccuggccuuaggauuuuuccucaggaaacugacuucucgcgaaaaccuucugcuaggcgugggccucgcuauggcgacaacccugcaauugccggaggauaucgaacagauggccaaugggauugcacugggauuaauggcucucaagcugaucacacaguuugagacuuaccagcuuuggaccgcccugauuuccuugacguguucaaacacaaucuucacccucacuguugccuggcgaaccgcuacacugauacuagcaggugugagucugcuuccugucugccaaagcucguccaugcggaagacugacuggcucccaauggccguagcggcuaugggcgugcccccucugcccuuguuuaucuucucucugaaagauaccuuaaagcguagaagcuggccacucaaugaggggguuauggccgugggacuggucucaauucuugcaaguucccuguugaggaacgacgugccuauggccggcccccucguagcuggugggcugcuaaucgcauguuaugugauuacgggaacaucugccgaucugaccgucgaaaaagcggcugacaucacuugggaggaagaggccgaacagacaggcguuagccacaaccuuaugauaaccguggacgaugacggcacuaugcgcauuaaggaugacgagacagagaauauccucaccgugcuguugaaaacggcauuacugaucgucuccgggauuuuuccauacucaauaccggccacucuccugguguggcauaccuggcagaagcagacacaacggagcggaguucuuugggauguaccuagucccccagaaacccagaaagcugagcuggaagaggguguguacagaaucaagcagcagggcauuuucgggaagacacaagucggagugggcguucagaaagaggguguguuucacacuauguggcacgucaccaggggggccguguugacguauaacggaaagcgacuagaacccaauugggcaucuguaaaaaaggaccugaucuccuacggcggcggguggcgccucagcgcucaguggcaaaaaggagaggaaguccaggugauugccguugagccugguaagaacccaaagaauuuccagacaaugcccggcacuuuccagaccacaaccggggaaaucggagcgauagcccuggauuuuaaaccuggcacuucggguucaccgaucauuaaccgggaggggaagguggucggacuuuauggcaauggcgugguuaccaaaaacgggggauacgugucugguaucgcacaaacaaaugcugagccagacggccccacgccugaauuagaggaagagauguucaagaaaagaaaccugacuauuauggaucuccauccagggaguggaaagaccaggaaguauuugcccgccaucguccgugaagcuauaaaacgccggcugagaacacucauucuggcaccuaccagggugguagccgccgagauggaggaagcucuuaagggccugccgauccgauaccagacuacagcgaccaaauccgagcacacgggucgggaaaucguggacuugaugugccaugcaacuuuuacaaugcgccuacugagccccguuagagucccaaauuauaaccucauuaucauggaugaggcccacuucaccgacccugcuucuauagccgcaaggggguacauuagcacccgggugggaaugggcgaagccgcugcgaucuuuaugacugccacacccccaggcaccgcagaugcuuucccucaguccaaugcccccauucaggacgaggagcgagacaucccagaaagaucauggaacagugggaaugaguggauaacagauuuugcaggaaagacugugugguucgucccgagcauuaaagccgguaacgacaucgcuaacuguuuacgcaagaauggcaagaaaguaauccaacugucuaggaagacguuugauaccgaauaccagaaaacaaagcuuaacgacugggauuucgugguuacuaccgacauuuccgagaugggggccaauuuuaaagcggaucgugugaucgacccucggagaugccugaagcccgucauucucacagauggaccagagagggugauauuggcaggccccaugccuguuaccgccgcuucagccgcucagcgccgagguagaguggggcggaacccacagaaggaaaaugaccaauauaucuucacuggccagccccugaacaaugaugaggaccaugcacacuggacggaagccaaaaugcuccuggacaacauuaauaccccugagggaaucaucccggcucuuuucgaaccagagagggagaagagugccgcaauugauggcgaauaccgccuaaaaggggagagccguaagacauuugucgaacugaugagacggggagacuugcccgugugguuagcgcacaaaguagccuccgaggguauaaaguauacugauaggaaauggugcuucgacggccagcgcaacaaucagauccuggaagagaacauggauguggagauuuggaccaaggaaggggagaagaaaaagcuccgaccuagauggcuggacgcucggacauacucugauccccuugcccugaaagaauuuaaggaguucgcagcuggaaggaaaucgaucgcccucgacuugguuaccgaaauuggccgcgucccaagccaucuggcacacagaacuaggaaugcccuagauaaccuggugaugcuccauacaucagagcacggugggcgggcuuaucgucacgcgguggaggaacuuccugagacgauggaaacccuguuauugcugggccucaugauccugcuuacuggaggcgccaugcuguuucucauauccgggaagggaaucgguaagacaaguauuggcuugaucugugucauugcaucuagcgggaugcuguggauggcugagauccccuuacaauggauagccuccgccauuguucuagaguucuuuaugauggugcugcucaucccagaaccugagaaacagcgcaccccgcaggacaaucaacuugcauacguagugauuggaauccugaccuuggcugccauaaucgcggcuaacgaaaugggccugcucgagacaacuaagcgagaucuggguaugucaaaagaacccggggucgugucuccaacgagcuaucuugacguugaucuccauccugccagugcauggacccuguacgccguggcuacaacugucauuacccccauguugagacacacaaucgagaauuccaccgcaaacguaagccuggccgcgauugcuaaccaggccgugguuuuaaugggccuagacaagggauggccaaucucuaaaauggaccugggcgugccucuccuugcacuggggugcuacucacaggucaaucccuugacucugacggccgcugugcuccugcuuauaacacauuaugccauuaucggaccgggcuuacaggcaaaggcuaccagggaggcccaaaagcggacugcggccgguaucaugaaaaacccaaccgucgaugggauuaugacaaucgaccuggauccugugauauacgacuccaaguucgaaaaacagcucggacagguuauguugcuggugcuaugugcaguacagcugcuccuuaugcgcacuaguugggcucugugcgaggccuugacccuggcaacaggccccauuacgacccucugggaagguagcccaggcaaguuuuggaauacuacaaucgcugugucgauggccaacauuuucagagggucuuaucuggccggagcgggcuuagcuuuuuccaucaugaaaagcgucgggaccggaaagaggggcacugguucacaaggggagacacuuggagaaaaguggaaaaagaaacugaaucagcucagucggaaggauuucgaccuauacaaaaagucuggcauaaccgagguugaucgaacggaggcaaaagaaggucugaagagaggcgagaucacccaccaugccgugucccgcgggagcgcuaaguugcagugguuugucgaaaggaacauggugauucccgagggacggguaaucgaccugggcugugggcguggaggcuggucauauuacugcgccggucucaaaaaggugacagaaguuagaggguauacuaaaggaggcccuggccacgaggagccggugcccaugaguaccuacggguggaauauugucaagcuuaugagcggaaaagauguguucuaccugccaccugaaaagugugacacauugcugugcgauaucggugaguccucucccagcccuacugucgaagaguccaggaccauucgcgugcucaagaugguugagccaugguuaaaaaacaaucaguucuguaucaagguacugaaccccuauaugccuacagugauagaacaccuugagcggcugcaacgaaaacauggcgggaugcuagucagaaauccacucucaaggaacucuacccacgaaauguacuggauuaguaauggaacuggcaacaucguggcaucgguuaauauggugagccgccuguugcugaaccgguuuacgaugacacauagacgucccaccaucgagaaggacgucgaucucggugccgggacuaggcacgugaacgcugaaccggagaccccuaauauggacguaauuggagagcggauaaaacgcaucaaggaagagcacaacuccacauggcauuaugacgaugaaaauccauacaagacgugggcguaucacggcucuuacgaggugaaagccaccggcucagcaagcuccaugauuaacgggguugucaagcuucugacuaaacccugggacguggugccuauggucacacagauggcuaugaccgauacuacaccauucggacagcaacgaguuuuuagagaaaagguggacaccaggacaccccggaguaugccggguacucgcagaguaaugggcaucaccgccgagugguuauggaggacgcuggggcgaaauaaaaagccucgguugugcacccgugaggaauucacaaagaaagugagaacuaacgcagccaugggagcugucuuuaccgaggaaaaucagugggauucugccaaggcggcaguggaggacgaagauuucuggaaacucguugaccgcgagagggagcugcauaagcuaggcaaaugugguagcugcguguauaacaugauggggaagcgggaaaaaaagcuuggagaguuuggcaaggccaaaggcucaagagcuauuugguacauguggcugggggcccgcuaccucgaauucgaggcacugggauuuuugaaugaggaucacugguucuccagggaaaacaguuauagcggugucgagggcgaagggcugcauaagcucggauacauccuucgagacauaucuaaaauccccggcggugcuauguaugccgaugacacagcugggugggacacucggauuaccgaggaugaccugcacaaugaagagaagaucacgcagcagauggauccagagcacagacaauuagccaacgcaauuuuuaaacugacauaccagaauaaggugguaaagguucagaggccuacccccacuggaacagugauggacaucauaucccgcaaagaucagcguggcucaggccaagucgggaccuauggauugaacacuuucaccaauauggaagcgcagcucauucggcagauggagggugaaggcgugcugagcaaggccgaccuagagaacccacaucuucccgaaaaaaagaucacacaguggcuggagacgaaagggguggagagacucaagaggauggcuaucucgggagaugacugcgucguuaagccuauugaugaccgcuuugccaacgcacuguuggcuuuaaaugauaugggcaaagugcgaaaggacauaccacaauggcagccgucuaaagguuggcacgauuggcagcagguacccuucuguagucaucacuuccacgaacugaucaugaaggacgggcggaaacucguggucccuugcagaccacaagacgagcuuauuggaagggcccgcaucucccagggcgcaggcuggagccugaaggaaaccgccugucuagggaaggcguacgcucagauguggucacugauguauuuucauagacgggaucucagguuggccuccaacgcaauuugcucugccgugcccguucacugggugccuacuagccguacaaccuggaguauccaugcucaccaucaauggaugacuacagaggacaugcugaccgucuggaaucgaguguggauagaagauaacccauggauggaggacaaaacgcccguaacaaccugggagaauguuccuuaccuuggaaagcgcgaagaucaguggugugguucccugaucggccucacuagcagagccaccugggcacagaacauuccgacagcuauccagcaagugcggucuuuaauugggaaugaggaauuccuggacuacaugccaucaaugaaaagguuucgcaaggaggaggaaagugagggagccaucugguga

SEQ ID NO: 15284 - RNA, 9873 nt, Artificial Sequence
  derived and/or modified CDS sequence (opt3) from DENV-3__JF937643__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagaaagccgugcacgcugacaugggauacuggaucgagagucagaagaacggcagcuggaaacuggaaaaggccucccuaauagagguaaagacuugcaccuggccuaaaucucauacacuguggucgaaugguguccucgaaagcgauaugaucauuccaaagucccuggcaggcccgaucucacagcacaaccauagacccggguaucacacucaaaccgcgggaccuuggcaccuuggcaaauuggagcuggacuuuaauuacugcgaggggacaacgguggugauuaccgaaaacuguggaacuaggggcccaaguuuacguacaaccacugucucugguaagcucauccaugaguggugcugucggagcugcacacugcccccucuucgauauaugggggaagauggauguugguacggcauggagauaagaccaauuuccgaaaaagaggagaauaugguuaagucacuggugagcgccgguucuggcaagguagacaacuucaccauggggguguugugccucgcuauccuguuugaagaggucaugaggggaaaauucggcaagaaacacaugaucgccgggguguucuuuacguucguucuacugcucuccggacagauuacuuggcgcgauauggcacauacccugaucaugauuggcaguaaugcuagcgaccggauggguaugggggugacauaucuugccuugauagcaaccuuuaagauccagcccuuccuggccuuaggauuuuuccucagaaaacugacuucuagggaaaaccuucugcuaggcgucggccucgcuauggcgacaacccugcaauugccggaggauauugaacagauggccaaugggaucgcacugggauuaauggcucucaagcugauugcccaguuugagacauaccagcuuuggacugcccugaucuccuugaccuguucaaacacgauauucacacucaccguggcuuggcgcacugcaacccugauccuagccgguguuagucugcuuccugugugccaaagcucguccaugcgaaagacagacuggcucccaauggcggucgcugccaugggcguacccccucugcccuuguuuauuuucucucugaaagauacuuuaaagcggcguagcuggccacucaaugagggggugauggcaguuggacuggugucaauccuugccaguucccuguugagaaacgacgucccuauggcuggcccccucguggcaggugggcugcuaauugccuguuauguaaucaccggaacgucugcggaucugacaguggaaaaagcugccgacauaaccugggaggaagaggcagaacagacuggcgucagccacaaccuuaugauugccguugacgaugacggcacaaugaggaucaaggaugacgagaccgagaauauccucacugugcuguugaaaacagcuuuacugauuguguccgggauauuuccauacucaaucccggccacccuccuggucuggcauacguggcagaagcagacucaacgcagcggagugcuuugggauguuccuagucccccagaaacccagaaagcagagcuggaagaggguguauaccggauuaagcagcagggcaucuucgggaagacacaagugggagucggcgugcagaaagaggguguuuuucacaccauguggcacgugacaagaggggcugucuugacuuauaacggaaagaggcuagaacccaauugggccucugugaaaaaggaccugauuuccuacggcggcggguggcgacucagcgcgcaguggcaaaaaggagaggaaguacaggucaucgccguggagccugguaagaacccaaagaauuuccagaccaugcccggcacguuccagacaacuaccggggaaauaggagcaaucgcucuggauuuuaaaccuggcacaucggguucaccgauuaucaaccgcgaggggaagguugugggacuuuauggcaauggcgucgugaccaaaaacgggggauacguuucugguauugcccaaacuaaugcugagccagacggccccaccccugaauuagaggaagagauguucaagaaacggaaccugacaaucauggaucuccauccagggaguggaaagacgagaaaguauuugcccgcaauagugagggaagccauuaaacgucgccugcggacucucauccuggccccuaccagagucguggcugcggagauggaggaagcacuuaagggccugccgaucagguaccagacaaccgccacuaaauccgagcacacaggucgagaaauuguagacuugaugugccaugcuaccuuuacgaugcggcuacugagccccgugcgcguuccaaauuauaaccucaucauaauggaugaggcccacuucacugacccugcaucuauugccgcuagaggguacaucagcacaagggucggaaugggcgaagcggccgcaauuuuuaugaccgcuacccccccaggcacugccgaugcauucccucaguccaaugcccccauccaggacgaggagcgggacauaccagaacgaucauggaacagugggaaugaguggauuacagauuuugcuggaaagaccgugugguucgugccgagcaucaaagccgguaacgacaucgcgaacuguuuaagaaagaauggcaagaaagucauucaacugucucgcaagacauuugauacugaauaccagaaaacgaagcuuaacgacugggauuucguagugaccacagacaucuccgagaugggggcaaauuuuaaagccgauaggguuauugacccucgucggugccugaagcccgugauacucacugauggaccagagagagucaucuuggcuggccccaugccugugaccgccgcuucagcagcccagaggcgcggucgaguugggagaaacccacagaaggaaaaugaccaauauauuuucacaggccagccccugaacaaugaugaggaccaugcucacuggaccgaagccaaaaugcuccuggacaacaucaauacuccugagggaaucauuccggcacuuuucgaaccagagcgggagaagagugcggccauagauggcgaauacaggcuaaaaggggagagccgcaagacguuuguggaacugaugcguagaggagacuugcccgucugguuagcucacaaaguggccuccgaggguaucaaguauaccgaucggaaauggugcuucgacggccagaggaacaaucagauucuggaagagaacauggauguagagaucuggacaaaggaaggggagaagaaaaagcuccgcccucgauggcuggacgcaagaacuuacucugauccccuugcucugaaagaauuuaaggaguucgccgcaggacggaaaucgauugcccucgacuuggugaccgaaaucggcaggguuccaagccaucuggcucaccgcacaagaaaugcgcuagauaaccuggucaugcuccauaccucagagcacggugggagggccuaucggcacgcaguggaggaacuuccugagacuauggaaacacuguuauugcugggccucaugauacugcuuacgggaggcgcuaugcuguuucucaucuccgggaagggaauugguaagaccaguaucggcuugauuugugugaucgccucuagcgggaugcuguggauggccgagauacccuuacaauggauugcauccgcuaucguccuagaguucuuuaugaugguucugcucauuccagaaccugagaaacagcguacuccgcaggacaaucaacuugccuacgugguaaucggaauacugacauuggcggcugugaucgccgcaaacgaaaugggccugcucgagaccaccaagcgcgaucuggguaugucaaaagaacccggggucgugucuccaacaagcuaucuugacguugaucuccauccugccagugcuuggacucuguacgcaguggccacgaccgucauuacacccauguugcgacacacuaucgagaauuccaccgcgaacguaagccuggcugccauugcaaaccaggccgugguuuuaaugggccuagacaagggauggccaaucucuaaaauggaccugggcgugccucuccuugcucuggggugcuacucacaggucaaucccuugacacugaccgccgcagugcuccugcuuauaacucauuaugcuauuaucggaccgggcuuacaggccaaggcgacgagagaggcccaaaagaggacagcagcugguaucaugaaaaacccaaccgucgaugggauuaugacuaucgaccuggauccugugauauacgacuccaaguucgaaaaacagcucggacagguuauguugcuggugcuaugugccguacagcugcuccuuaugcggaccaguugggcacugugcgaggcuuugacacuggccacuggccccauuaccacacucugggaagguagcccaggcaaguuuuggaauacgaccaucgccgugucgauggcgaacauuuuccgcgggucuuaucuggcuggagcaggcuuagccuuuuccaucaugaaaagcgucgggacuggaaagagaggcacagguucacaaggggagacccuuggagaaaaguggaaaaagaaacugaaucagcucaguaggaaggauuucgaccuauacaaaaagucuggcauaacugagguugaucggacagaggcuaaagaaggucugaagcgaggcgagaucacccaccaugccguguccagagggagcgcaaaguugcagugguuugucgaacgcaacauggugauucccgagggaaggguaaucgaccugggcugugggcggggaggcuggucauauuacugcgccggucucaaaaaggugacggaaguucguggguauaccaaaggaggcccuggccacgaggagccggugcccaugaguacauacggguggaauauugucaagcuuaugagcggaaaagauguguucuaccugccaccugaaaagugugacacuuugcugugcgauaucggugaguccucucccagcccuaccgucgaagaguccagaacaauuagggugcucaagaugguugagccaugguuaaaaaacaaucaguucuguaucaagguacugaaccccuauaugccuacugugauagaacaccuugagcgccugcaacggaaacauggcgggaugcuaguccgaaauccacucucaagaaacucuacccacgaaauguacuggauuaguaauggaacaggcaacaucguggcuucgguuaauauggugagcaggcuguugcugaaccgcuuuaccaugacucaucggagacccacgaucgagaaggacgucgaucucggugcggggacacgucacgugaacgccgaaccggagaccccuaauauggacguaauuggagagaggauaaaacggaucaaggaagagcacaacuccacuuggcauuaugacgaugaaaauccauacaagaccugggcauaucacggcucuuacgaggugaaagcuacaggcucagccagcuccaugauuaacgggguugucaagcuucugacgaaacccugggacguggugccuauggucacccagauggcaaugacugauacaaccccauucggacagcaacgcguuuuuaaggaaaaaguggacacucgaacacccagaaguaugccggguaccaggcggguaaugggcaucacagccgagugguuauggcgcacucuggggagaaauaagaagccuagguugugcacccgagaggaauucacgaaaaaggugcggaccaacgcugccaugggagcggucuuuacagaggaaaaucagugggauucugcaaaagccgcuguggaggacgaagauuucuggaagcucguugaccgugagagagagcugcauaaacuaggcaagugugguagcugcguguauaacaugauggggaaacgcgaaaagaagcuuggagaguuuggcaaagccaagggcucaagggcaauuugguacauguggcugggggcucgguaccucgaauucgaggcccugggauuuuugaaugaggaucacugguucuccagagaaaacaguuauagcggugucgagggcgaagggcugcauaaacucggauacauccuucgcgacauaucuaagauccccggcggugcuauguaugccgaugacacugcagggugggacaccaggauuacagaggaugaccugcacaaugaagagaaaaucacucagcagauggauccagagcaccgacaauuagcgaacgccauuuuuaagcugaccuaccagaauaaggugguaaaaguucagcggccuacgcccacaggaaccgugauggacaucauauccagaaaggaucagaggggcucaggccaagucgggacuuauggauugaacacauucaccaauauggaagcucagcucauucgccagauggagggugaaggcgugcugagcaaagccgaccuagagaacccacaucuucccgaaaagaaaaucacucaguggcuggagaccaaggggguggagcgucucaagcggauggcaaucucgggagaugacugcgucguuaaaccuauugaugacagauuugcuaacgcccuguuggcauuaaaugauaugggcaaggugaggaaagacauaccacaauggcagccgucuaaggguuggcacgauuggcagcagguacccuucuguagucaucacuuccacgaacugaucaugaaagacgggcgcaagcucguggucccuugccgaccacaagacgagcuuauuggacgggccagaaucucccagggcgcgggcuggagccugaaggaaacagcuugucuagggaaagccuacgcacagauguggucacugauguauuuucauaggcgcgaucucagauuggccuccaacgcuauuugcucugccgugcccguucacugggugccuacgagccggaccacuuggaguauccaugcacaccaucaauggaugacaaccgacgauaugcugacugucuggaauaggguguggauagaggacaacccauggauggaagauaagacacccguaaccacgugggagaauguuccuuaccuuggaaaacgugaggaccaguggugugguucccugaucggccucacaagccgagcuaccugggcccagaacauuccgacugcgauccagcaagugcgcucuuuaauugggaaugaagaguuccuggauuacaugccaucaaugaagagauuucggaaagaagaggagagugaaggagcuaucugguga

SEQ ID NO: 15285 - RNA, 9873 nt, Artificial Sequence
  derived and/or modified CDS sequence (opt3) from DENV-3__HM181972__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauaugggggaagauggauguugguacggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcacaugaucgccgggguguucuuuacguucguucuacugcucuccggacagauuacuuggcgggauauggcacauacccugaucaugauuggcaguaaugcuagcgacagaauggguaugggggugacauaucuugccuugauagcaaccuuuaaaauccagcccuuccuggucuuaggauuuuuccucaggaagcugacuucucgcgaaaaccuucugcuaggcgugggccucgccauggcuacaacccugcaauugccggaggauauugaacagauggcgaaugggaucgcccugggauuaauggcacucaaacugauuacacaguuugagacuuaccagcuuuggaccgcucugaucuccuugacguguucaaacacaauauucacccucacuguugccuggcgaaccgccacacugauccuagcuggugugagucugcuuccugucugccaaagcucguccaugcggaagacugacuggcucccaauggcaguagccgcgaugggcgugcccccucugcccuuguuuauuuucucucugaaggauaccuuaaaacguagaagcuggccacucaaugaggggguuauggcugugggacuggucucaauccuugccaguucccuguugaggaacgacgugccuauggcaggcccccucguagccggugggcugcuaauugcuuguuaugugaucacgggaacaucugcagaucugaccgucgaaaaggccgcggacauaacuugggaggaagaggcugaacagacaggcguuagccacaaccuuaugauuaccguggacgaugacggcacuaugcgcaucaaagaugacgagacagagaauauccucaccgugcuguugaagacggccuuacugauugucuccgggauauuuccauacucaaucccggcaacucuccugguguggcauaccuggcagaaacagacacaacggagcggaguucuuugggauguaccuagucccccagaaacccagaaggccgagcuggaagaggguguguacagaauuaaacagcagggcaucuucgggaagacacaagucggagugggcguucagaaggaggguguguuucacacuauguggcacgucaccaggggggcuguguugacguauaacggaaaacgacuagaacccaauugggccucuguaaagaaagaccugauuuccuacggcggcggguggcgccucagcgcacaguggcaaaagggagaggaaguccaggugaucgcuguugagccugguaaaaacccaaagaauuuccagacaaugcccggcacuuuccagaccacaaccggggaaauaggagccaucgcgcuggauuuuaagccuggcacuucggguucaccgauuaucaaccgggaggggaaaguggucggacuuuauggcaauggcgugguuaccaagaacgggggauacgugucugguauugcccaaacaaaugcagagccagacggccccacgccugaauuagaggaagagauguucaaaaagagaaaccugacuaucauggaucuccauccagggaguggaaaaaccaggaaguauuugcccgcuauaguccgugaagccauuaagcgccggcugagaacacucauccuggcuccuaccagggugguagcagccgagauggaggaagcccuuaaaggccugccgauccgauaccagacuacagcuaccaaguccgagcacacgggucgggaaauuguggacuugaugugccaugcgacuuuuacaaugcgccuacugagccccguuagagucccaaauuauaaccucaucauaauggaugaggcacacuucaccgacccugccucuauugcugccaggggguacaucagcacccgggugggaaugggcgaagcagccgcuauuuuuaugacugcgacacccccaggcaccgccgaugcauucccucaguccaaugcucccauccaggacgaggagcgagacauaccagaaagaucauggaacagugggaaugaguggauuacagauuuugccggaaaaacugugugguucgucccgagcaucaaggcagguaacgacaucgccaacuguuuacgcaaaaauggcaagaagguaauucaacugucuaggaaaacguuugauaccgaauaccagaagacaaaacuuaacgacugggauuucgugguuacuaccgacaucuccgagaugggggcuaauuuuaaggccgaucgugugauugacccucggagaugccugaaacccgucauacucacagauggaccagagagggugaucuuggcgggccccaugccuguuaccgcagccucagcugcccagcgccgagguagaguggggcggaacccacagaaggaaaaugaccaauauauuuucacuggccagccccugaacaaugaugaggaccaugcucacuggacggaagcaaagaugcuccuggacaacaucaauaccccugagggaaucauuccggcccuuuucgaaccagagagggagaaaagugcugccauagauggcgaauaccgccuaaagggggagagccguaaaacauuugucgaacugaugagacggggagacuugcccgugugguuagcacacaagguagcguccgaggguaucaaauauacugauaggaaguggugcuucgacggccagcgcaacaaucagauucuggaagagaacauggauguggagaucuggaccaaagaaggggagaagaagaaacuccgaccuagauggcuggacgcccggacauacucugauccccuugcucugaaggaauuuaaagaguucgccgcaggaaggaagucgauugcucucgacuugguuaccgaaaucggccgcgucccaagccaucuggcccacagaacuaggaaugcacuagauaaccuggugaugcuccauacaucagagcacggugggcgggccuaucgucacgcuguggaggaacuuccugagacgauggaaacccuguuauugcugggccucaugauacugcuuacuggaggcgcgaugcuguuucucaucuccgggaaaggaauugguaagacaaguaucggcuugauuugugucaucgccucuagcgggaugcuguggauggcagagauacccuuacaauggauugcuuccgccaucguucuagaguucuuuaugauggugcugcucauuccagaaccugagaagcagcgcaccccgcaggacaaucaacuugccuacguagugaucggaauacugaccuuggcagcuaucauugccgcgaacgaaaugggccugcucgagacaacuaaacgagaucuggguaugucaaaggaacccggggucgugucuccaacgagcuaucuugacguugaucuccauccugcuagugccuggacccuguacgcaguggccacaacugucaucacccccauguugagacacacaauugagaauuccaccgcuaacguaagccuggcagccaucgcgaaccaggcugugguuuuaaugggccuagacaaaggauggccaauaucuaagauggaccugggcgugccucuccuugcccuggggugcuacucacaggucaaucccuugacucugacggcagccgugcuccugcuuauuacacauuaugcuaucaucggaccgggcuuacaggccaaagcaaccagggaggcucaaaagcggacugccgcggguauuaugaagaacccaaccgucgaugggaucaugacaauagaccuggauccugugauuuacgacuccaaauucgaaaagcagcucggacagguuauguugcuggugcuaugugccguacagcugcuccuuaugcgcacuaguugggcacugugcgaggcuuugacccuggccacaggccccaucacgacccucugggaagguagcccaggcaaauuuuggaauacuacaauugcagugucgauggcuaacaucuucagagggucuuaucuggccggagccggcuuagcguuuuccauaaugaagagcgucgggaccggaaaaaggggcacugguucacaaggggagacacuuggagaaaaguggaagaaaaagcugaaucagcucagucggaaagauuucgaccuauacaagaaaucuggcaucaccgagguugaucgaacggaggcuaaggaaggucugaaaagaggcgagauuacccaccaugcagugucccgcgggagcgccaaguugcagugguuugucgaaaggaacauggugauccccgagggacggguaauugaccugggcugugggcguggaggcuggucauauuacugcgcuggucucaagaaagugacagaaguuagaggguauacuaagggaggcccuggccacgaggagccggugcccaugaguaccuacggguggaauaucgucaaacuuaugagcggaaaggauguguucuaccugccaccugaaaaaugugacacauugcugugcgauauuggugaguccucucccagcccuacugucgaagaguccaggaccauccgcgugcucaagaugguugagccaugguuaaagaacaaucaguucuguauaaaaguacugaaccccuauaugccuacagugauugaacaccuugagcggcugcaacgaaagcauggcgggaugcuagucagaaauccacucucaaggaacucuacccacgaaauguacuggaucaguaauggaacuggcaacaucguggccucgguuaauauggugagccgccuguugcugaaccgguuuacgaugacacauagacgucccaccauugagaaagacgucgaucucggugcagggacuaggcacgugaacgccgaaccggagaccccuaauauggacguaauaggagagcggaucaagcgcauuaaagaagagcacaacuccacauggcauuaugacgaugaaaauccauacaagacgugggcuuaucacggcucuuacgaggugaaggcgaccggcucagccagcuccaugaucaacgggguugucaaacuucugacuaagcccugggacguggugccuauggucacacagauggcaaugaccgauacuacaccauucggacagcaacgaguuuuuaaagaaaagguggacaccagaacacccaggaguaugccggguacucggcgcguaaugggcauuaccgcugagugguuauggagaacgcuggggaggaauaaaaagccucgauugugcacccgggaggaauucacaaagaaagugcguacuaacgccgcaaugggagccgucuuuaccgaggaaaaucagugggauucugcuaaggccgcgguggaggacgaagauuucuggaaacucguugacagagagcgcgagcugcauaagcuaggcaaaugugguagcugcguguauaacaugauggggaagagggaaaaaaagcuuggagaguuuggcaaggcaaaaggcucacgggccaucugguacauguggcugggggcuagauaccucgaauucgaggcccugggauuuuugaaugaggaucacugguucucccgcgaaaacaguuauagcggugucgagggcgaagggcugcauaagcucggauacauacuuagggacaucucuaaaauucccggcggugcaauguaugcugaugacacagccgggugggacacucgaaucaccgaggaugaccugcacaaugaagagaagauuacgcagcagauggauccagagcaccggcaauuagcuaacgccaucuuuaaacugacauaccagaauaaggugguaaagguucagagaccuacccccacuggaacagugauggacauaauuuccaggaaagaucagcgcggcucaggccaagucgggaccuauggauugaacacuuucaccaauauggaagcacagcucauccgucagauggagggugaaggcgugcugagcaaggcggaccuagagaacccacaucuucccgaaaaaaagaucacacaguggcuggagacgaaagggguggagcggcucaagagaauggccauuucgggagaugacugcgucguuaagccuauagaugacagguuugcuaacgcccuguuggcauuaaaugauaugggcaaagugcgcaaggacaucccacaauggcagccgucuaaagguuggcacgauuggcagcagguacccuucuguagucaucacuuccacgaacugauuaugaaggacgggcgaaaacucguggucccuugccggccacaagacgagcuuaucggaagagcuaggauuucccagggcgccggcuggagccugaaggaaaccgcaugucuagggaaggccuacgcgcagauguggucacugauguauuuucaucgcagagaucuccgguuggcuuccaacgccaucugcucugcagugcccguucacugggugccuacuagcaggacaaccuggaguauacaugcccaccaucaauggaugacuacagaggacaugcugaccgucuggaaucguguguggaucgaagauaacccauggauggaggacaaaacgcccguaacaaccuggggaaauguuccuuaccuugguaagcgagaggaucagugguguggcucccugauugggcucacuagccgcgcuaccugggcccagaacaucccgacagcaauucagcaagugagaucuuuaaucggaaaugaagaguuccuggacuacaugccaucaaugaaacgguuuaggaaggaagaggagagugaaggcgcuauuugguga

SEQ ID NO: 15286 - RNA, 9873 nt, Artificial Sequence
  derived and/or modified CDS sequence (opt3) from DENV-3__HM631857__SS-prME
accagccugugccucaugaugauccuucccgcagcucuggcauuccacuugacauccagagacggcgaaccuagaaugauuguggggaagaacgaacgggguaaaucuuuacuguuuaagacugccucagguauaaauauguguacgcuaaucgcgauggaucucggcgaaaugugcgacgauaccgucaccuacaaauguccacauauuacugaaguugaaccggaagacaucgauugcugguguaaccugaccaguacaugggugaccuaugggacuugcaaucaggcuggagaacaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucaaaauucagggggaacaagcauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacuaagaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauaugggggaagauggauguugguacggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcacaugaucgccgggguguucuuuacguucguucuacugcucuccggacagauuacuuggcgggauaccgcacauacacugaucaugauuggcaguaaugcuagcgacagaauggguaugggggugaccuaucuugccuugauagcaacuuuuaaaauccagcccuuccuggccuuaggauuuuuccucaggaagcugacaucucgcgaaaaccuucugcuaggcgucggccucgcuauggcgaccacacugcaauugccggaggauauugaacagauggccaaugggaucgcacugggauuaauggcucucaaacugauuacucaguuugagaccuaccagcuuuggacggcccugaucuccuugacauguucaaacaccauauucacucucaccguggccuggcgaacagcuacucugauccuagccgguguuagucugcuuccugugugccaaagcucguccaugcggaagaccgacuggcucccaauggccgucgcggcuaugggcguacccccucugcccuuguuuauuuucgggcugaaggauacguuaaaacguagaucuuggccacucaaugagggagugauggccguuggccuggugagcauccuugcaucaagucuguugaggaacgacgucccuauggccgguccccucguggcugggggacugcuaauugcauguuauguaaucacaggcaccuccgccgaucugacuguggaaaaggcggcugacauaacaugggaggaagaggccgaacagaccggcgucucucacaaccuuaugauuacuguugacgaugacgggacaaugcgcaucaaagaugacgagaccgagaauauccucacggugcuguugaagacugcauuacugauugugagcggaauauuuccauacuccaucccggccacccuccuggucuggcauacauggcagaaacagacccaacggucaggugugcuuugggauguuccuagucccccagaaacacagaaggcugagcuggaagagggcguauacagaauuaaacagcaggggaucuucggaaagacucaagugggcgucggugugcagaaggaggggguuuuucacaccauguggcacgugacgaggggagccgucuugacauauaacggcaaacgacuagaacccaauugggcaagugugaagaaagaccugauuucuuacggcgggggauggcgccucuccgcucaguggcaaaagggugaggaaguacaggucaucgccguggagccuggcaaaaacccaaagaauuuccagacuaugcccgggaccuuccagacaaccacuggagaaauaggcgcgaucgcccuggauuuuaagccugguaccagcgggucgccgauuaucaaccgggagggaaaaguugugggccuuuauggcaauggggucgugacaaagaacggagguuacguuucaggcauugcacaaacgaaugcugagccagacgggcccacuccugaauuagaggaagagauguucaaaaagagaaaccugaccaucauggaucuccauccaggaucuggcaaaacaaggaaguauuugcccgccauagugcgugaagcuauuaagcgccggcugagaacccucauccuggcaccuacuagggucguggccgccgagauggaggaagcucuuaaaggucugccgauccgauaccagacaaccgcgacgaagagugagcacacugggcgggaaauugcagacuugaugugccaugccacauuuaccaugcgccuacugucccccguaagagugccaaauuauaaccucaucauaauggaugaggcucacuucaccgacccugccagcauugcagccaggggauacaucucuacucggguuggcaugggcgaagcugcggccauuuuuaugacagcaacacccccagggacagcugaugccuucccucagagcaaugcacccauccaggacgaggagcgagacauaccagaaagauccuggaacucaggaaaugaguggauuacugauuuugccgguaaaacggucugguucgugccgaguaucaaggcuggcaacgacaucgccaacuguuuacgcaaaaaugggaagaaggugauucaacugagcaggaaaaccuuugauacagaauaccagaagacuaaacuuaacgacugggauuucgucguaaccacagacaucucugagaugggagcgaauuuuaaggcagaucgugugauugacccucggagaugccugaaacccguuauacucaccgauggcccagagagggugaucuuggccggucccaugccugucacugcugccuccgcugcacagcgccgagggagagugggccggaacccacagaaggaaaaugaccaauauauuuucacgggacagccccugaacaaugaugaggaccaugcccacuggaccgaagcuaagaugcuccuggacaacaucaauacaccugagggcaucauuccggcccuuuucgaaccagagagggagaaaucagcagcgauagauggggaauaccgccuaaagggagagagucguaaaacuuuuguugaacugaugagacggggugacuugcccgugugguuagcccacaaggucgcuagcgagggcaucaaauauaccgauaggaaguggugcuucgacgggcagcgcaacaaucagauucuggaagagaacauggauguggagaucuggacaaaagaaggagagaagaagaaacuccgaccuagauggcuggacgcccggaccuacuccgauccccuugcacugaaggaauuuaaagaguucgcugccggcaggaagucuauugcacucgacuugguaacugaaaucggucgcgugccaucgcaucuggcccacagaacaaggaaugcucuagauaaccugguuaugcuccauacgagcgagcacgggggccgggcguaucgucacgccgucgaggaacuuccugagaccauggaaacucuguuauugcugggacucaugauacugcuuacaggcggggcaaugcuguuucucaucucaggaaaagguauuggcaagaccuccaucggguugauuugugugaucgcuaguucuggaaugcuguggauggccgagauacccuuacaauggauugccagcgcaaucgugcuagaguucuuuaugaugguccugcucauuccagaaccugagaagcagcgcaccccgcaggacaaucaacuugcuuacguugugaucggcauacugacauuggccgcgguaaucgcugccaacgaaaugggucugcucgagacuacgaaacgagaucuggggauguccaaggaacccggcguggucucaccaaccucuuaucuugacguggaucuccauccugcaagcgccuggacacuguacgcuguugcaacuaccgugauuacacccauguugagacacaccaucgagaauaguacugccaacgucucccuggcggcuauugccaaccaggcaguaguguuaaugggacuagacaaaggcuggccaaucagcaagauggaccuggggguuccucuccuugcccugggaugcuacucucaggugaaucccuugacgcugacagcugccguccuccugcuuauaacccauuaugcaauuaucggcccggguuuacaggcuaaagccacuagggaggcgcaaaagcggaccgccgcagggaucaugaagaacccaacaguggauggaauuaugacuaucgaccuggauccugucauauacgacucaaaauucgaaaagcagcucggccaggugauguugcugguucuaugugcugugcagcugcuccuuaugcgcaccuccugggcccugugcgaggcauugacacuggcuacgggucccauuaccacucucugggaaggcaguccagggaaauuuuggaauacaaccaucgccguaagcauggccaacauuuucagaggaucguaucuggcgggcgcuggguuagcauuuucuaucaugaaguccgugggaacuggcaaaagggguacagggagccaaggagagacccuuggcgaaaaguggaagaaaaagcugaaucagcucucacggaaagauuucgaccuauacaagaaaagugguauaacggaggucgaucgaaccgaggccaaggaaggccugaaaagaggggagaucacacaccaugcuguuucucgcggauccgccaaguugcagugguuuguggaaaggaacauggucauucccgagggccgggugaucgaccugggguguggacguggcgguuggagcuauuacugcgcagggcucaagaaaguaacugaagugagaggauauaccaagggcggcccugggcacgaggagccgguucccaugucaacauacggauggaauauugugaaacuuaugagugguaaggaugucuucuaccugccaccugaaaaaugugacacuuugcugugcgauaucggcgagagcucccccucuccuaccguggaagagagcaggacaauucgcguccucaagaugguggagccaugguuaaagaacaaucaguucuguaucaaaguucugaaccccuauaugccuaccguaauagaacaccuugagcggcugcaacgaaagcaugggggaaugcuagugagaaauccacucuccaggaacucaacucacgaaauguacuggauuucuaauggcacggguaacaucgucgccagugugaauaugguuucgcgccuguugcugaaccgguuuacaaugacccauagacgucccacuaucgagaaagacguggaucucggggcuggaaccaggcacgucaacguggaaccggagacaccuaauauggacguaauuggcgagcggauaaagcgcaucaaagaagaacacaacagcacguggcauuaugacgaugaaaauccauacaagaccugggcguaucacggcuccuacgaggugaaggccacugggucugcaucaagcaugauuaacggaguugucaaacuucugacaaagcccugggacguggugccuauggucacccagauggcuaugacugauacaaccccauucggucagcaacgaguuuuuaaagaaaagguggacacaagaacucccagguccaugccgggcacccggcgcguaauggggaucacggccgagugguuauggagaacccugggaaggaauaaaaagccucgauugugcacacgggaggaguucacuaagaaagugcguaccaacgcagccaugggcgcugucuuuacagaggaaaaucagugggauagugccaaggcggcaguggaggacgaagauuucuggaaacucguugacagagagcgcgagcugcauaagcuagguaaaugugggucuugcguguauaacaugaugggaaagagggagaagaaacuuggcgaguuuggcaaagccaaagggagccgggcuauuugguacauguggcugggagccagauaccucgaguucgaggcacugggauuuuugaaugaggaucacugguucucacgcgaaaacuccuauaguggcgucgagggggaaggacugcauaagcucggcuacauccuuagggacauaagcaaaauccccgguggggcuauguaugccgaugacacugcuggaugggacacccgaauuacggaggaugaccugcacaaugaagagaagaucacacagcagauggauccagagcaccggcaauuagccaacgcaauuuuuaaacugaccuaccagaauaaggugguaaagguucagagaccuacucccacaggcaccgugauggacaucauaucuaggaaagaucagcgcggcuccgggcaagucggaacuuaugguuugaacaccuucacaaauauggaagcgcagcucauucgucagauggagggcgaaggggugcugucaaaggccgaccuagagaacccacaucuucccgagaaaaagaucacgcaguggcuggagaccaaaggaguggagcggcucaagagaauggcuaucagcggcgaugacugcgucguuaagccuauugaugacagguuugccaacgcacuguuggcuuuaaaugauauggguaaagugcgcaaggacauaccacaauggcagccgucgaaaggguggcacgauuggcagcagguacccuucuguucucaucacuuccacgaacugaucaugaaggacggacgaaaacucguggucccuugccggccacaagacgagcuuauuggcagagccaggaucagucagggcgcaggguggucccugaaggaaacugccugucuaggaaaggcguacgcucagauguggagccugauguauuuucaucgcagagaucuccgguuggccucaaacgcaauuugcuccgccgugcccguucacugggugccuacaucuaggaccacuuggagcauccaugcucaccaucaauggaugacaaccgaggacaugcugacggucuggaaucguguguggauagaagauaacccauggauggaggacaaaacacccguaaccacuugggagaauguuccuuaccuugguaagcgagaagaucagugguguggcagucugaucgggcucaccucccgcgccacaugggcacagaacauuccgacugcuauccagcaagugaggagcuuaauuggaaaugaggaguuccuggacuacaugccaucuaugaaacgguuuaggaaggaggaggaaucagagggcgccaucugguga

SEQ ID NO: 15287 - RNA, 9873 nt, Artificial Sequence
  derived and/or modified CDS sequence (opt3) from DENV-3__HM631860__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucgugaauuggaaagggaaggagcugaagugcggauccggcaucuucgugacaaacgagguccauaccuggacugaacaguacaaauuucaagcagauucucccaagcggcuagccaccgcuauugccggugcaugggagaauggcguuugugggauccgaagcacaacgcgcauggaaaaccuccuguggaaacagauagcuaaugagcuuaacuauaucuugugggaaaauaacauuaagcugaccguggugguaggagacaucauuggcguccucgagcaggggaaaagaacucugacaccacagccuaaggaguuaaaauacucauggaagaccuggggaaaggccaaaaucgugacagcggaaacucaaaacaguuccuucauaauugauggccccaauaccccagagugccccagcguuucuagggccuggaacgugugggaagucgaggacuaugguuuugggguguucacgacaaauaucuggcugaagcuucgggaaguuuacacccaguugugugaccaccgccucaugucagcugcagugaaagaugagagagccguacacgcugacaugggauacuggauugagagucagaagaacggcagcuggaaacuggaaaaggccucccuaaucgaggucaagacuugcaccuggccuaaaucucauacacuguggucgaauggugugcucgaaagcgauaugauaaucccaaagucccuggcaggcccgauuucacagcacaaccauaggcccggguaucacacucaaaccgcgggaccuuggcaccuuggcaaauuggagcuggacuuuaauuacugcgaggggacaacgguggucaucaccgaaaacuguggaacucguggcccaaguuuacggacaaccacuguuucugguaagcucauucaugaguggugcugucgaagcugcacacugcccccucuuagauauaugggggaagauggauguugguacggcauggagaucaggccaauauccgaaaaagaggagaauauggugaagucacugguaagcgccgguucuggcaagguggacaacuucaccaugggggucuugugccucgcuauucuguuugaagaggugaugcgcggaaaauucggcaagaaacacaugaucgccgggguuuucuuuacguucgugcuacugcucuccggacagaucacuuggcgggauauggcacauacccugauuaugaucggcaguaaugcuagcgacagaauggguaugggggucacauaucuugccuugauugcaaccuuuaagauacagcccuuccuggccuuaggauuuuuccucaggaaacugacuucucgcgaaaaccuucugcuaggcgugggccucgcuauggcgacaacccugcaauugccggaggauaucgaacagauggccaaugggauugcacugggauuaauggcucucaagcugaucacacaguuugagacuuaccagcuuuggaccgcccugauuuccuugacguguucaaacacauauuucacccucacuguugccuggcgaaccgcuacacugauccuagcaggugugagucugcuuccugucugccaaagcucguccaugcggaagacugacuggcucccaauggccguagcggcuaugggcgugcccccucugcccuuguuuauauucucucugaaagauaccuuaaagcguagaagcuggccacucaaugaggggguuauggccgugggacuggucucaauccuugcaaguucccuguugaggaacgacgugccuauggccggcccccucguagcuggugggcugcuaauugcauguuacgugaucacgggaacaucugccgaucugaccgucgaaaaagcggcugacauuacuugggaggaagaggccgaacagacaggcguuagccacaaccuuaugaucaccguggacgaugacggcacuaugcgcauaaaggaugacgagacagagaauauucucaccgugcuguugaaaacggcauuacugaucgucuccgggaucuuuccauacucaauuccggccacucuccugguguggcauaccuggcagaagcagacacaacggagcggaguucuuugggauguaccuagucccccagaaacccagaaagcugagcuggaagaggguguguauagaauaaagcagcagggcaucuucgggaagacacaagucggagugggcguucagaaagaggguguguuucacacuauguggcacgucaccaggggggccguguugacguacaacggaaagcgacuagaacccaauugggcaucuguaaaaaaggaccugauuuccuauggcggcggguggcgccucagcgcucaguggcaaaaaggagaggaaguccaggugaucgccguugagccugguaagaacccaaagaauuuccagacaaugcccggcacuuuccagaccacaaccggggaaauuggagcgaucgcccuggauuuuaaaccuggcacuucggguucaccgauaaucaaccgggaggggaagguggucggacuuuacggcaauggcgugguuaccaaaaacgggggauaugugucugguauugcacaaacaaaugcugagccagacggccccacgccugaauuagaggaagagauguucaagaaaagaaaccugacuaucauggaucuccauccagggaguggaaagaccaggaaguacuugcccgccauuguccgugaagcuaucaaacgccggcugagaacacucauacuggcaccuaccagggugguagccgccgagauggaggaagcucuuaagggccugccgauucgauaucagacuacagcgaccaaauccgagcacacgggucgggaaaucguggacuugaugugccaugcaacuuuuacaaugcgccuacugagccccguuagagucccaaauuacaaccucaucauuauggaugaggcccacuucaccgacccugcuucuaucgccgcaaggggguacauaagcacccgggugggaaugggcgaagccgcugcgauuuuuaugacugccacacccccaggcaccgcagaugcuuucccucaguccaaugcccccauccaggacgaggagcgagacauuccagaaagaucauggaacagugggaaugaguggaucacagauuuugcaggaaagacugugugguucgucccgagcauaaaagccgguaacgacauugcuaacuguuuacgcaagaauggcaagaaaguaauccaacugucuaggaagacguuugauaccgaauaucagaaaacaaagcuuaacgacugggauuucgugguuacuaccgacaucuccgagaugggggccaauuuuaaagcggaucgugugauugacccucggagaugccugaagcccgucauccucacagauggaccagagagggugauuuuggcaggccccaugccuguuaccgccgcuucagccgcucagcgccgagguagaguggggcggaacccacagaaggaaaaugaccaauacauauucacuggccagccccugaacaaugaugaggaccaugcacacuggacggaagccaaaaugcuccuggacaacaucaauaccccugagggaauuaucccggcucuuuucgaaccagagagggagaagagugccgcaaucgauggcgaauaucgccuaaaaggggagagccguaagacauuugucgaacugaugagacggggagacuugcccgugugguuagcgcacaaaguagccuccgaggguauuaaguacacugauaggaaauggugcuucgacggccagcgcaacaaucagauacuggaagagaacauggauguggagaucuggaccaaggaaggggagaagaaaaagcuccgaccuagauggcuggacgcucggacauauucugauccccuugcccugaaagaauuuaaggaguucgcagcuggaaggaaaucgauugcccucgacuugguuaccgaaaucggccgcgucccaagccaucuggcacacagaacuaggaaugcccuagauaaccuggugaugcuccauacaucagagcacggugggcgggcuuaccgucacgcgguggaggaacuuccugagacgauggaaacccuguuauugcugggccucaugauucugcuuacuggaggcgccaugcuguuucucaucuccgggaagggaauagguaagacaaguaucggcuugauuugugucaucgcaucuagcgggaugcuguggauggcugagauucccuuacaauggaucgccuccgccauaguucuagaguucuuuaugauggugcugcucauuccagaaccugagaaacagcgcaccccgcaggacaaucaacuugcauauguagugaucggaauucugaccuuggcugccaucauagcggcuaacgaaaugggccugcucgagacaacuaagcgagaucuggguaugucaaaagaacccggggucgugucuccaacgagcuaccuugacguugaucuccauccugccagugcauggacccuguacgccguggcuacaacugucaucacccccauguugagacacacaauugagaauuccaccgcaaacguaagccuggccgcgaucgcuaaccaggccgugguuuuaaugggccuagacaagggauggccaauuucuaaaauggaccugggcgugccucuccuugcacuggggugcuauucacaggucaaucccuugacucugacggccgcugugcuccugcuuaucacacauuacgccauaauuggaccgggcuuacaggcaaaggcuaccagggaggcccaaaagcggacugcggccgguaucaugaaaaacccaaccgucgaugggaucaugacaauugaccuggauccugugaucuaugacuccaaguucgaaaaacagcucggacagguuauguugcuggugcuaugugcaguacagcugcuccuuaugcgcacuaguugggcucugugcgaggccuugacccuggcaacaggccccauaacgacccucugggaagguagcccaggcaaguuuuggaauacuacaauugcugugucgauggccaacaucuucagagggucuuaccuggccggagcgggcuuagcuuuuuccauuaugaaaagcgucgggaccggaaagaggggcacugguucacaaggggagacacuuggagaaaaguggaaaaagaaacugaaucagcucagucggaaggauuucgaccuauauaaaaagucuggcaucaccgagguugaucgaacggaggcaaaagaaggucugaagagaggcgagauaacccaccaugccgugucccgcgggagcgcuaaguugcagugguuugucgaaaggaacauggugauccccgagggacggguaauugaccugggcugugggcguggaggcuggucauacuauugcgccggucucaaaaaggugacagaaguuagaggguacacuaaaggaggcccuggccacgaggagccggugcccaugaguaccuacggguggaauaucgucaagcuuaugagcggaaaagauguguucuaucugccaccugaaaagugugacacauugcugugcgauauuggugaguccucucccagcccuacugucgaagaguccaggaccauccgcgugcucaagaugguugagccaugguuaaaaaacaaucaguucuguauuaagguacugaaccccuacaugccuacagugaucgaacaccuugagcggcugcaacgaaaacauggcgggaugcuagucagaaauccacucucaaggaacucuacccacgaaauguauuggauaaguaauggaacuggcaacauuguggcaucgguuaauauggugagccgccuguugcugaaccgguuuacgaugacacauagacgucccaccaucgagaaggacgucgaucucggugccgggacuaggcacgugaacgcugaaccggagaccccuaauauggacguaaucggagagcggauuaaacgcauaaaggaagagcacaacuccacauggcauuacgacgaugaaaauccauauaagacgugggcguaccacggcucuuaugaggugaaagccaccggcucagcaagcuccaugaucaacgggguugucaagcuucugacuaaacccugggacguggugccuauggucacacagauggcuaugaccgauacuacaccauucggacagcaacgaguuuuuaaggaaaaaguggacaccagaacacccaggaguaugccggguacucggcgcguaaugggcauuaccgccgagugguuauggagaacgcuggggaggaauaagaagccucgauugugcacccgggaggaauucacaaaaaaggugcguacuaacgcagccaugggagcugucuuuaccgaggaaaaucagugggauucugccaaagcggcaguggaggacgaagauuucuggaagcucguugacagagagcgcgagcugcauaaacuaggcaagugugguagcugcguguacaacaugauggggaaaagggaaaagaagcuuggagaguuuggcaaagccaagggcucacgggcuaucugguacauguggcugggggccagauaucucgaauucgaggcacugggauuuuugaaugaggaucacugguucucccgcgaaaacaguuacagcggugucgagggcgaagggcugcauaaacucggauauauucuuagggacaucucuaagauacccggcggugcuauguacgccgaugacacagcugggugggacacucgaaucaccgaggaugaccugcacaaugaagagaaaauuacgcagcagauggauccagagcaccggcaauuagccaacgcaaucuuuaagcugacauaucagaauaaggugguaaaaguucagagaccuacccccacuggaacagugauggacauuaucuccaggaaggaucagcgcggcucaggccaagucgggaccuacggauugaacacuuucaccaauauggaagcgcagcucauacgucagauggagggugaaggcgugcugagcaaagccgaccuagagaacccacaucuucccgaaaagaaaauuacacaguggcuggagacgaaggggguggagcggcucaagagaauggcuaucucgggagaugacugcgucguuaaaccuaucgaugacagguuugccaacgcacuguuggcuuuaaaugauaugggcaaggugcgcaaagacauuccacaauggcagccgucuaaggguuggcacgauuggcagcagguacccuucuguagucaucacuuccacgaacugauaaugaaagacgggcgaaagcucguggucccuugccggccacaagacgagcuuaucggaagagccaggauuucccagggcgcaggcuggagccugaaggaaaccgccugucuagggaaagcguaugcucagauguggucacugauguacuuucaucgcagagaucuccgguuggccuccaacgcaaucugcucugccgugcccguucacugggugccuacuagcaggacaaccuggaguauucaugcucaccaucaauggaugacuacagaggacaugcugaccgucuggaaucguguguggaucgaagauaacccauggauggaggacaagacgcccguaacaaccugggagaauguuccuuaccuuggaaaacgagaagaucaguggugugguucccugauaggccucacuagccgcgccaccugggcacagaacaucccgacagcuauucagcaagugagaucuuuaaucgggaaugaggaauuccuggacuauaugccaucaaugaagcgguuuaggaaagaggaggaaagugagggagccauuugguga

SEQ ID NO: 15288 - RNA, 9873 nt, Artificial Sequence
  derived and/or modified CDS sequence (opt3) from DENV-3__HM181977__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucgugaauuggaaagggaaggagcugaagugcggauccggcaucuucgugacaaacgagguccauaccuggacugaacaguacaaauuucaagcagauucucccaagcggcuagccaccgcuauugccggugcaugggagaauggcguuugugggauccgaagcacaacgcgcauggaaaaccuccuguggaaacagauagcuaaugagcuuaacuauaucuugugggaaaauaacauuaagcugaccguggugguaggagacaucauuggcguccucgagcaggggaaaagaacucugacaccacagccuaaggaguuaaaauacucauggaagaccuggggaaaggccaaaaucgugacagcggaaacucaaaacaguuccuucauaauugauggccccaauaccccagagugccccagcguuucuagggccuggaacgugugggaagucgaggacuaugguuuugggguguucacgacaaauaucuggcugaagcuucgggaaguuuacacccaguugugugaccaccgccucaugucagcugcagugaaagaugagagagccguacacgcugacaugggauacuggauugagagucagaagaacggcagcuggaaacuggaaaaggccucccuaaucgaggucaagacuugcaccuggccuaaaucucauacacuguggucgaauggugugcucgaaagcgauaugauaaucccaaagucccuggcaggcccgauuucacagcacaaccauaggcccggguaucacacucaaaccgcgggaccuuggcaccuuggcaaauuggagcuggacuuuaauuacugcgaggggacaacgguggucaucaccgaaaacuguggaacucguggcccaaguuuacggacaaccacuguuucugguaagcucauucaugaguggugcugucgaagcugcacacugcccccucuuagauauaugggggaagauggauguugguacggcauggagaucaggccaauauccgaaaaagaggagaauauggugaagucacugguaagcgccgguucuggcaagguggacaacuucaccaugggggucuugugccucgcuauucuguuugaagaggugaugcgcggaaaauucggcaagaaacacaugaucgccgggguuuucuuuacguucgugcuacugcucuccggacagaucacuuggcgggauauggcacauacccugauuaugaucggcaguaaugcuagcgacagaauggguaugggggucacauaucuugccuugauugcaaccuuuaagauacagcccuuccuggccuuaggauuuuuccucaggaaacugacuucucgcgaaaaccuucugcuaggcgugggccucgcuauggcgacaacccugcaauugccggaggauaucgaacagauggccaaugggauugcacugggauuaauggcucucaagcugaucacacaguuugagacuuaccagcuuuggaccgcccugauuuccuugacguguucaaacacaaucuucacccucacuguugccuggcgaaccgcuacacugauacuagcaggugugagucugcuuccugucugccaaagcucguccaugcggaagacugacuggcucccaauggccguagcggcuaugggcgugcccccucugcccuuguuuaucuucucucugaaagauaccuuaaagcguagaagcuggccacucaaugaggggguuauggccgugggacuggucucaauucuugcaaguucccuguugaggaacgacgugccuauggccggcccccucguagcuggugggcugcuaaucgcauguuaugugauuacgggaacaucugccgaucugaccgucgaaaaagcggcugacaucacuugggaggaagaggccgaacagacaggcguuagccacaaccuuaugauaaccguggacgaugacggcacuaugcgcauuaaggaugacgagacagagaauauccucaccgugcuguugaaaacggcauuacugaucgucuccgggauuuuuccauacucaauaccggccacucuccugguguggcauaccuggcagaagcagacacaacggagcggaguucuuugggauguaccuagucccccagaaacccagaaagcugagcuggaagaggguguguacagaaucaagcagcagggcauuuucgggaagacacaagucggagugggcguucagaaagaggguguguuucacacuauguggcacgucaccaggggggccguguugacguauaacggaaagcgacuagaacccaauugggcaucuguaaaaaaggaccugaucuccuacggcggcggguggcgccucagcgcucaguggcaaaaaggagaggaaguccaggugauugccguugagccugguaagaacccaaagaauuuccagacaaugcccggcacuuuccagaccacaaccggggaaaucggagcgauagcccuggauuuuaaaccuggcacuucggguucaccgaucauuaaccgggaggggaagguggucggacuuuauggcaauggcgugguuaccaaaaacgggggauacgugucugguaucgcacaaacaaaugcugagccagacggccccacgccugaauuagaggaagagauguucaagaaaagaaaccugacuauuauggaucuccauccagggaguggaaagaccaggaaguauuugcccgccaucguccgugaagcuauaaaacgccggcugagaacacucauucuggcaccuaccagggugguagccgccgagauggaggaagcucuuaagggccugccgauccgauaccagacuacagcgaccaaauccgagcacacgggucgggaaaucguggacuugaugugccaugcaacuuuuacaaugcgccuacugagccccguuagagucccaaauuauaaccucauuaucauggaugaggcccacuucaccgacccugcuucuauagccgcaaggggguacauuagcacccgggugggaaugggcgaagccgcugcgaucuuuaugacugccacacccccaggcaccgcagaugcuuucccucaguccaaugcccccauucaggacgaggagcgagacaucccagaaagaucauggaacagugggaaugaguggauaacagauuuugcaggaaagacugugugguucgucccgagcauuaaagccgguaacgacaucgcuaacuguuuacgcaagaauggcaagaaaguaauccaacugucuaggaagacguuugauaccgaauaccagaaaacaaagcuuaacgacugggauuucgugguuacuaccgacauuuccgagaugggggccaauuuuaaagcggaucgugugaucgacccucggagaugccugaagcccgucauucucacagauggaccagagagggugauauuggcaggccccaugccuguuaccgccgcuucagccgcucagcgccgagguagaguggggcggaacccacagaaggaaaaugaccaauauaucuucacuggccagccccugaacaaugaugaggaccaugcacacuggacggaagccaaaaugcuccuggacaacauuaauaccccugagggaaucaucccggcucuuuucgaaccagagagggagaagagugccgcaauugauggcgaauaccgccuaaaaggggagagccguaagacauuugucgaacugaugagacggggagacuugcccgugugguuagcgcacaaaguagccuccgaggguauaaaguauacugauaggaaauggugcuucgacggccagcgcaacaaucagauccuggaagagaacauggauguggagauuuggaccaaggaaggggagaagaaaaagcuccgaccuagauggcuggacgcucggacauacucugauccccuugcccugaaagaauuuaaggaguucgcagcuggaaggaaaucgaucgcccucgacuugguuaccgaaauuggccgcgucccaagccaucuggcacacagaacuaggaaugcccuagauaaccuggugaugcuccauacaucagagcacggugggcgggcuuaucgucacgcgguggaggaacuuccugagacgauggaaacccuguuauugcugggccucaugauccugcuuacuggaggcgccaugcuguuucucauauccgggaagggaaucgguaagacaaguauuggcuugaucugugucauugcaucuagcgggaugcuguggauggcugagauccccuuacaauggauagccuccgccauuguucuagaguucuuuaugauggugcugcucaucccagaaccugagaaacagcgcaccccgcaggacaaucaacuugcauacguagugauuggaauccugaccuuggcugccauaaucgcggcuaacgaaaugggccugcucgagacaacuaagcgagaucuggguaugucaaaagaacccggggucgugucuccaacgagcuaucuugacguugaucuccauccugccagugcauggacccuguacgccguggcuacaacugucauuacccccauguugagacacacaaucgagaauuccaccgcaaacguaagccuggccgcgauugcuaaccaggccgugguuuuaaugggccuagacaagggauggccaaucucuaaaauggaccugggcgugccucuccuugcacuggggugcuacucacaggucaaucccuugacucugacggccgcugugcuccugcuuauaacacauuaugccauuaucggaccgggcuuacaggcaaaggcuaccagggaggcccaaaagcggacugcggccgguaucaugaaaaacccaaccgucgaugggauuaugacaaucgaccuggauccugugauauacgacuccaaguucgaaaaacagcucggacagguuauguugcuggugcuaugugcaguacagcugcuccuuaugcgcacuaguugggcucugugcgaggccuugacccuggcaacaggccccauuacgacccucugggaagguagcccaggcaaguuuuggaauacuacaaucgcugugucgauggccaacauuuucagagggucuuaucuggccggagcgggcuuagcuuuuuccaucaugaaaagcgucgggaccggaaagaggggcacugguucacaaggggagacacuuggagaaaaguggaaaaagaaacugaaucagcucagucggaaggauuucgaccuauacaaaaagucuggcauaaccgagguugaucgaacggaggcaaaagaaggucugaagagaggcgagaucacccaccaugccgugucccgcgggagcgcuaaguugcagugguuugucgaaaggaacauggugauucccgagggacggguaaucgaccugggcugugggcguggaggcuggucauauuacugcgccggucucaaaaaggugacagaaguuagaggguauacuaaaggaggcccuggccacgaggagccggugcccaugaguaccuacggguggaauauugucaagcuuaugagcggaaaagauguguucuaccugccaccugaaaagugugacacauugcugugcgauaucggugaguccucucccagcccuacugucgaagaguccaggaccauucgcgugcucaagaugguugagccaugguuaaaaaacaaucaguucuguaucaagguacugaaccccuauaugccuacagugauagaacaccuugagcggcugcaacgaaaacauggcgggaugcuagucagaaauccacucucaaggaacucuacccacgaaauguacuggauuaguaauggaacuggcaacaucguggcaucgguuaauauggugagccgccuguugcugaaccgguuuacgaugacacauagacgucccaccaucgagaaggacgucgaucucggugccgggacuaggcacgugaacgcugaaccggagaccccuaauauggacguaauuggagagcggauaaaacgcaucaaggaagagcacaacuccacauggcauuaugacgaugaaaauccauacaagacgugggcguaucacggcucuuacgaggugaaagccaccggcucagcaagcuccaugauuaacgggguugucaagcuucugacuaaacccugggacguggugccuauggucacacagauggcuaugaccgauacuacaccauucggacagcaacgaguuuuuaaggaaaaaguggacaccagaacacccaggaguaugccggguacucggcgcguaaugggcaucaccgccgagugguuauggagaacgcuggggaggaauaagaagccucgauugugcacccgggaggaauucacaaaaaaggugcguacuaacgcagccaugggagcugucuuuaccgaggaaaaucagugggauucugccaaagcggcaguggaggacgaagauuucuggaagcucguugacagagagcgcgagcugcauaaacuaggcaagugugguagcugcguguauaacaugauggggaaaagggaaaagaagcuuggagaguuuggcaaagccaagggcucacgggcuauuugguacauguggcugggggccagauaccucgaauucgaggcacugggauuuuugaaugaggaucacugguucucccgcgaaaacaguuauagcggugucgagggcgaagggcugcauaaacucggauacauccuuagggacauaucuaagauccccggcggugcuauguaugccgaugacacagcugggugggacacucgaauuaccgaggaugaccugcacaaugaagagaaaaucacgcagcagauggauccagagcaccggcaauuagccaacgcaauuuuuaagcugacauaccagaauaaggugguaaaaguucagagaccuacccccacuggaacagugauggacaucauauccaggaaggaucagcgcggcucaggccaagucgggaccuauggauugaacacuuucaccaauauggaagcgcagcucauucgucagauggagggugaaggcgugcugagcaaagccgaccuagagaacccacaucuucccgaaaagaaaaucacacaguggcuggagacgaaggggguggagcggcucaagagaauggcuaucucgggagaugacugcgucguuaaaccuauugaugacagguuugccaacgcacuguuggcuuuaaaugauaugggcaaggugcgcaaagacauaccacaauggcagccgucuaaggguuggcacgauuggcagcagguacccuucuguagucaucacuuccacgaacugaucaugaaagacgggcgaaagcucguggucccuugccggccacaagacgagcuuauuggaagagccaggaucucccagggcgcaggcuggagccugaaggaaaccgccugucuagggaaagcguacgcucagauguggucacugauguauuuucaucgcagagaucuccgguuggccuccaacgcaauuugcucugccgugcccguucacugggugccuacuagcaggacaaccuggaguauccaugcucaccaucaauggaugacuacagaggacaugcugaccgucuggaaucguguguggauagaagauaacccauggauggaggacaagacgcccguaacaaccugggagaauguuccuuaccuuggaaaacgagaagaucaguggugugguucccugaucggccucacuagccgcgccaccugggcacagaacauuccgacagcuauccagcaagugagaucuuuaauugggaaugaggaauuccuggacuacaugccaucaaugaagcgguuuaggaaagaggaggaaagugagggagccaucugguga

SEQ ID NO: 15289 - RNA, 9873 nt, Artificial Sequence
  derived and/or modified CDS sequence (opt3) from DENV-3__HM181978__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauaugggggaagauggauguugguacggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcacaugaucgccgggguguucuuuacguucguucuacugcucuccggacagauuacuuggcgggauauggcacauacccugaucaugauuggcaguagcgcuucugacagaauggguaugggggugacauaucuugccuugauagcaaccuuuaaaauccagcccuuccuggccuuaggauuuuuccucaggaagcugacuucccgcgaaaaucuucugcuaggcgucggccucgcuauggcgacaacccugcaauugccggaggauauugaacagauggccaacgggaucgcacugggauuaauggcucucaaacugauuacacaguuugagacuuaccagcuuuggaccgcccugaucucauugacguguaguaauacaauauucacccucacuguggccuggcgaaccgcuacacugauccuagcagguguuagccugcuuccugugugccaaucguccucuaugcggaagacugacuggcucccaauggccgucgcggcuaugggcguacccccucugcccuuguuuauuuucgggcugaaggauaccuuaaaacguagaagcuggccacucaacgagggagugauggccguuggccuggugucaauccuugcaaguucccuguugaggaaugacgucccuauggccgguccccucguggcugggggacugcuaauugcauguuauguaaucacgggcacaucugccgaucugaccguggaaaaggcggcugacauaacuugggaggaagaggccgaacagacaggcgucagccacaaccuuaugauuaccguugacgaugacgggacuaugcgcaucaaagaugacgagacagagaacauccucaccgugcuguugaagacggcauuacugauuguguccggaauauuuccauacucaaucccggccacucuccuggucuggcauaccuggcagaaacagacacaacggagcggugugcuuugggauguuccuagucccccagaaacccagaaggcugagcuggaagagggcguauacagaauuaaacagcaggggaucuucggaaagacacaagugggcgucggugugcagaaggaggggguuuuucacacuauguggcacgugaccaggggagccgucuugacguauaauggcaaacgacuagaacccaacugggcaucugugaagaaagaccugauuuccuacggcgggggauggcgccucagcgcucaguggcaaaagggugaggaaguacaggucaucgccguggagccuggcaaaaauccaaagaacuuccagacaaugcccgggacuuuccagaccacaaccggagaaauaggcgcgaucgcccuggauuuuaagccugguacuucggggucaccgauuaucaaucgggagggaaaaguugugggccuuuauggcaacggggucgugaccaagaauggagguuacguuucuggcauugcacaaacaaacgcugagccagacgggcccacgccugaauuagaggaagagauguucaaaaagagaaaucugacuaucauggaucuccauccaggaaguggcaaaaccaggaaguauuugcccgccauagugcgugaagcuauuaagcgccggcugagaacacucauccuggcaccuaccagggucguggccgccgagauggaggaagcucuuaaaggucugccgauccgauaccagacuacagcgaccaaguccgagcacacggggcgggaaauuguagacuugaugugccaugcaacuuuuacaaugcgccuacugagccccgugagaguuccaaacuauaaucucaucauaauggaugaggcccacuucaccgacccugcuucuauugccgcaaggggauacaucagcacccgggucggcaugggcgaagccgcugcgauuuuuaugacugccacacccccagggaccgcagaugcuuucccucaguccaacgcccccauccaggacgaggagcgagacauaccagaaagaucauggaauaguggaaacgaguggauuacagauuuugcagguaaaacugugugguucgugccgagcaucaaggccggcaaugacaucgcuaacuguuuacgcaaaaacgggaagaaggucauucaacugucuaggaaaacguuugauaccgaauaccagaagacaaaacuuaaugacugggauuucguagugacuaccgacaucuccgagaugggagccaacuuuaaggcggaucguguuauugacccucggagaugccugaaacccgugauacucacagauggcccagagagggucaucuuggcaggucccaugccugugaccgccgcuucagccgcucagcgccgagggagaguuggccggaauccacagaaggaaaacgaccaauauauuuucacuggacagccccugaauaacgaugaggaccaugcacacuggacggaagccaagaugcuccuggacaauaucaacaccccugagggcaucauuccggcucuuuucgaaccagagagggagaaaagugccgcaauagauggggaauaccgccuaaagggagagagccguaaaacauuuguggaacugaugagacggggugacuugcccgucugguuagcgcacaagguggccuccgagggcaucaaauauacugauaggaaguggugcuucgacgggcagcgcaauaaccagauucuggaagagaauauggauguagagaucuggaccaaagaaggagagaagaagaaacuccgaccuagauggcuggacgcucggacauacucugauccccuugcccugaaggaauuuaaagaguucgcagcuggcaggaagucgauugcccucgacuuggugaccgaaaucggucgcguuccaagccaucuggcacacagaacuaggaacgcccuagauaaucuggucaugcuccauacaucagagcacgggggccgggcuuaucgucacgcgguggaggaacuuccugagacgauggaaacccuguuauugcugggacucaugauacugcuuacuggcggggccaugcuguuucucaucuccggaaaagguauuggcaagacaaguaucggguugauuugugugaucgcaucuagcggaaugcuguggauggcugagauacccuuacaauggauugccuccgccaucguccuagaguucuuuaugaugguucugcucauuccagaaccugagaagcagcgcaccccgcaggacaaccaacuugcauacgugguaaucggcauacugaccuuggcugccaucauugcggcuaaugaaaugggucugcucgagacaacuaaacgagaucuggggaugucaaaggaacccggcguggucucuccaacgagcuaucuugacguggaucuccauccugccagugcauggacccuguacgccguugcuacaacugugaucacccccauguugagacacacaauugagaacuccaccgcaaaugucagccuggccgcgaucgcuaaccaggccguaguguuaaugggacuagacaaaggcuggccaauaucuaagauggaccuggggguuccucuccuugcacugggaugcuacucacaggugaaccccuugacucugacggccgcuguccuccugcuuauuacacauuaugccaucaucggcccggguuuacaggcaaaagcuaccagggaggcccaaaagcggacugcggccgggauuaugaagaauccaaccguggauggaaucaugacaauagaccuggauccugucauuuacgacuccaaauucgaaaagcagcucggccaggugauguugcugguucuaugugcagugcagcugcuccuuaugcgcacuaguugggcucugugcgaggccuugacccuggcaacaggucccaucacgacccucugggaaggcagcccagggaaauuuuggaacacuacaauugcuguaucgauggccaauaucuucagaggaucuuaucuggccggcgcgggguuagcuuuuuccauaaugaagagcgugggaaccggcaaaagggguacugggucacaaggagagacacuuggcgaaaaguggaagaaaaagcugaaccagcucagucggaaagauuucgaccuauacaagaaaucugguaucaccgaggucgaucgaacggaggcaaaggaaggccugaaaagaggggagauuacccaccaugccguuucccgcggaagcgcuaaguugcagugguuuguggaaaggaauauggucauccccgagggccgggugauugaccugggguguggacguggcgguuggucauauuacugcgccgggcucaagaaaguaacagaagugagaggauauacuaagggcggcccugggcacgaggagccgguucccaugaguaccuacggauggaacaucgugaaacuuaugagcgguaaggaugucuucuaccugccaccugaaaaaugugacacauugcugugcgauauuggcgaguccucucccagcccuacuguggaagaguccaggaccauccgcguccucaagaugguggagccaugguuaaagaauaaccaguucuguauaaaaguucugaaucccuauaugccuacaguaauugaacaccuugagcggcugcaacgaaagcaugggggaaugcuagugagaaacccacucucaaggaauucuacccacgaaauguacuggaucaguaacggcacugguaauaucgucgcaucggugaacaugguuagccgccuguugcugaaucgguuuacgaugacacauagacgucccaccauugagaaagacguggaucucggggccggaacuaggcacgucaacgcugaaccggagaccccuaacauggacgugauaggcgagcggaucaagcgcauuaaagaagagcacaauuccacauggcauuaugacgaugaaaacccauacaagacgugggcguaucacggcucuuacgagguaaaggccaccgggucagcaagcuccaugaucaauggagugguuaaacuucugacuaagcccugggacgucgugccuauggugacacagauggcuaugaccgauacuacaccauucggucagcaacgagucuuuaaagaaaagguugacaccagaacacccaggaguaugccgggcacucggcgcgugauggggauuaccgccgagugguuauggagaacgcugggaaggaacaaaaagccucgauugugcacccgggaggaauucacaaagaaaguacguacuaaugcagccaugggcgcuguguuuaccgaggaaaaccagugggauucugccaaggcggcagucgaggacgaagauuucuggaaacucguggacagagagcgcgagcugcauaagcuagguaaaugugggagcugcguuuauaauaugaugggaaagagggaaaaaaagcuuggcgaguuuggcaaggccaaagggucacgggcuaucugguacauguggcugggagccagauaccucgaauucgaggcacuggguuuuuugaacgaggaucacugguucucccgcgaaaauaguuauagcggcguggagggggaaggacugcauaagcucggcuacauacuuagggacaucucuaaaauucccgguggggcuauguaugccgaugacacagcuggaugggacacucgaaucaccgaggaugaccugcacaacgaagagaagauuacgcagcagauggauccagagcaccggcaauuagccaaugcaaucuuuaaacugacauaccagaacaaggucgugaagguacagagaccuacccccacuggcacaguuauggacauaauuuccaggaaagaucagcgcggcucagggcaagugggaaccuaugguuugaauacuuucaccaacauggaagcgcagcucauccgucagauggagggcgaagggguccugagcaaggccgaccuagagaauccacaucuucccgaaaaaaagaucacacaguggcuggagacgaaaggaguggagcggcucaagagaauggcuauuucgggcgaugacugcguggucaagccuauagaugacagguuugccaacgcacuguuggcuuuaaacgauauggguaaaguucgcaaggacaucccacaauggcagccgucuaaaggguggcacgauuggcagcaggugcccuucuguagucaucacuuccacgaacugauuaugaaggacggacgaaaacucguagugccuugccggccacaagacgagcuuaucggcagagccaggauuucccagggcgcaggguggagccugaaggaaaccgccugucuaggaaaggcguacgcucagauguggucacugauguauuuucaucgcagagaucuccgguuggccuccaaugcaaucugcucugccguccccgugcacuggguuccuacuagcaggacaaccuggaguauacaugcucaccaucaauggaugacuacagaggacaugcugaccguguggaaccgugucuggaucgaagauaauccauggauggaggacaaaacgcccgugacaaccugggagaacguaccuuaccuugguaagcgagaagaucagugguguggcucccugauugggcucacuagccgcgccaccugggcacagaauaucccgacagcuauucagcaaguuagaucuuuaaucggaaacgaggaauuccuggacuacaugccaucaaugaaacgguuuaggaaggaggaggaaagugagggcgccauuugguga

SEQ ID NO: 15290 - RNA, 9873 nt, Artificial Sequence
  derived and/or modified CDS sequence (opt3) from DENV-3__JN183884__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugaaaaugaagaacaaagcguggaugguccauagacagugguuuuucgaucucccccugccuuggacaagcggggccaccacugaaacaccaacguggaauaggaaggagcuucuggugaccuuuaaaaacgcacacgcuaagaagcaagaaguaguuguguugggcucccaggagggagccaugcacacugcucucacaggcgccaccgaaauucagaauucagggggaacaaguauauucgcaggucaucugaaaugucgguuaaagauggacaaacuggagcuaaagggcaugagcuacgccaugugcacuaacaccuuuguccucaaaaaggaggugucugaaacgcagcacgggaccauccugauuaaggucgaguacaaaggagaagaugugcccuguaagaucccuuucuccacagaggacggccaagguaaagcucauaacgggcgucuuauaacugcgaauccaguugugaccaagaaagaggaacccguaaacauugaggcagaaccgccuuucggcgagucaaauaucgucaucggaauuggcgauaacgccuugaagaucaauugguauaagaaagggagcaguauuggaaagauguuugaagcuacagcccgcggugcaagaaggauggccauacugggcgacacugcuugggauuucgggucugugggaggcguucucaacucccuggguaaaauggugcaccagaucuuugggagcgccuacaccgcacuuuucucgggcgucucuugggugaugaagauuggaaucggcguacuguugacguggaucgggcucaauuccaaaaacacaucaaugaguuuuagcugcauugcgauaggaaucauuacccuguauuuaggcgcugugguucaggccgacauggguugugucaucaauuggaaggggaaggagcugaaaugcggauccggcauuuucgugacuaacgaggugcauacauggaccgaacaguacaaguuucaagcagauucucccaaacggcuagccacugcuaucgccggugcaugggagaauggcgucugugggauacgaagcaccacacgcauggaaaaccuccuguggaagcagaucgcuaaugagcuuaacuauauuuugugggaaaauaacaucaaacugacgguuguggugggagacauuaucggcguacucgagcaggggaagagaacccugacuccacagccuauggaguuaaaauacucauggaagacauggggaaaggccaaaauagucaccgcggaaacacaaaacaguuccuucauuaucgauggccccaauacuccagagugccccagcgugucuagggccuggaacguuugggaaguggaggacuaugguuuuggggucuucaccacgaauauuuggcugaagcuucgggaaguguacacacaguugugugaccaccgccucaugucagcugcaguuaaagaugagagagccgugcacgcugacaugggauacuggaucgagagucagaagaacggcagcuggaaacuggaaaaggccucccuaauagagguaaagaccugcacuuggccuaaaucucauacccuguggucgaaugguguccucgaaagcgauaugaucauuccaaagucccuggcaggcccgaucucacagcacaaccauaggcccggguaucacacacaaacugcgggaccuuggcaccuuggcaaauuggagcuggacuuuaauuacugcgaggggaccacaguggugauuacggaaaacuguggaacccguggcccaaguuuacggacuacaaccgucucugguaagcucauccaugaguggugcugucgaagcugcacucugcccccucuuagauauaugggggaagauggauguugguacggcauggagauaaggccaauuuccgaaaaagaggagaauaugguuaagucacuggugagcgccgguucuggcaagguagacaacuucacaauggggguguugugccucgcuauccuguuugaagaggucaugcgcggaaaauucggcaagaaacacaugaucgccgggguguucuuuaccuucguucuacugcucuccggacagauuacguggcgggauauggcacauacucugaucaugauuggcaguaaugcuagcgacagaauggguaugggggugaccuaucuugccuugauagcaacauuuaagauccagcccuuccuggccuuaggauuuuuccucaggaaacugaccucucgcgaaaaccuucugcuaggcgucggccucgcuauggcgacuacacugcaauugccggaggauauugaacagauggccaaugggaucgcacugggauuaauggcucucaagcugauuacccaguuugagacauaccagcuuuggacugcccugaucuccuugaccuguucaaacacgauauucacacucaccguggccuggcgaacugcuacccugauccuagcagguguuagucugcuuccugugugccaaagcucguccaugcggaagacagacuggcucccaauggccgucgcggcuaugggcguacccccucugcccuuguuuauuuucgggcugaaagauacuuuaaagcguagaucuuggccacucaaugagggagugauggccguuggccuggugagcauccuugcaucaagucuguugaggaacgacgucccuauggccgguccccucguggcugggggacugcuaauugcauguuauguaaucaccggcacguccgccgaucugacaguggaaaaagcggcugacauaaccugggaggaagaggccgaacagacuggcgucucucacaaccuuaugauuacaguugacgaugacgggaccaugcgcaucaaggaugacgagacugagaauauccucacagugcuguugaaaaccgcauuacugauugugagcggaauauuuccauacuccaucccggccacgcuccuggucuggcauacuuggcagaagcagacccaacggucaggugugcuuugggauguuccuagccccccagaaacacagaaagcugagcuggaagagggcguauacagaauuaagcagcaggggaucuucggaaagacccaagugggcgucggugugcagaaagaggggguuuuucacacaauguggcacgugacuaggggagccgucuugaccuauaacggcaagcgacuagaacccaauugggcaagugugaaaaaggaccugauuucuuacggcgggggauggcgccucuccgcucaguggcaaaaaggugaggaaguacaggucaucgccguggagccuggcaagaacccaaagaauuuccagacgaugcccgggacauuccagacuaccacaggagaaauaggcgcgaucgcccuggauuuuaaaccugguaccagcgggucgccgauuaucaaccgggagggaaagguugugggccuuuauggcaauggggucgugacuaaaaacggagguuacguuucaggcauugcacaaaccaaugcugagccagacgggcccacaccugaauuagaggaagagauguucaagaaaagaaaccugacgaucauggaucuccauccaggaucuggcaagacuaggaaguauuugcccgccauagugcgugaagcuauuaaacgccggcugagaacccucauccuggcaccuacaagggucguggccgccgagauggaggaagcucuuaagggucugccgauccgauaccagaccacugcgacaaaaagugagcacaccgggcgggaaauuguagacuugaugugccaugcaacguuuacuaugcgccuacugucccccgugagaguuccaaauuauaaccucaucauaauggaugaggcccacuucacagacccugcuagcauugccgcaaggggauacaucucuacccgggucggcaugggcgaagccgcugcgauuuuuaugaccgccacucccccagggacagcagaugcuuucccucagagcaaugcccccauccaggacgaggagcgagacauaccagaaagauccuggaacucaggaaaugaguggauuaccgauuuugcagguaagacagugugguucgugccgaguaucaaagccggcaacgacaucgcuaacuguuuacgcaagaaugggaagaaagucauucaacugagcaggaagacuuuugauacggaauaccagaaaaccaagcuuaacgacugggauuucguagugacaacugacaucucugagaugggagccaauuuuaaagcggaucguguuauugacccucggagaugccugaagcccgugauacucaccgauggcccagagagggucaucuuggcaggucccaugccugugacagccgcuuccgccgcucagcgccgagggagaguuggccggaacccacagaaggaaaaugaccaauauauuuucaccggacagccccugaacaaugaugaggaccaugcacacuggacugaagccaaaaugcuccuggacaacaucaauacgccugagggcaucauuccggcucuuuucgaaccagagagggagaagucagccgcaauagauggggaauaccgccuaaaaggagagagucguaagaccuuuguggaacugaugagacggggugacuugcccgucugguuagcgcacaaaguggccagcgagggcaucaaguauacagauaggaaauggugcuucgacgggcagcgcaacaaucagauucuggaagagaacauggauguagagaucuggacuaaggaaggagagaagaaaaagcuccgaccuagauggcuggacgcucggaccuacuccgauccccuugcccugaaagaauuuaaggaguucgcagcuggcaggaaaucuauugcccucgacuuggugacagaaaucggucgcguuccaucgcaucuggcacacagaaccaggaaugcccuagauaaccuggucaugcuccauacuagcgagcacgggggccgggcuuaucgucacgcgguggaggaacuuccugagacaauggaaacgcuguuauugcugggacucaugauacugcuuaccggcggggccaugcuguuucucaucucaggaaaggguauuggcaagacuuccaucggguugauuugugugaucgcaaguucuggaaugcuguggauggcugagauacccuuacaauggauugccagcgccaucguccuagaguucuuuaugaugguucugcucauuccagaaccugagaaacagcgcacaccgcaggacaaucaacuugcauacgugguaaucggcauacugaccuuggcugccaucauugcggcuaacgaaaugggucugcucgagaccacaaagcgagaucuggggauguccaaagaacccggcguggucucaccaacuucuuaucuugacguggaucuccauccugccagcgcauggacgcuguacgccguugcuaccacagugaucacucccauguugagacacaccauugagaauaguacagcaaacgucucccuggccgcgaucgcuaaccaggccguaguguuaaugggacuagacaagggcuggccaauaagcaaaauggaccuggggguuccucuccuugcacugggaugcuacucucaggugaaucccuugacccugacugccgcuguccuccugcuuauuacgcauuaugccaucaucggcccggguuuacaggcaaaggcuacaagggaggcccaaaagcggaccgcggccgggauuaugaaaaacccaacuguggauggaaucaugaccauagaccuggauccugucauuuacgacucaaaguucgaaaaacagcucggccaggugauguugcugguucuaugugcagugcagcugcuccuuaugcgcacauccugggcucugugcgaggccuugacucuggcaaccggucccaucacaacgcucugggaaggcaguccagggaaguuuuggaauaccacuauugcuguaagcauggccaacaucuucagaggaucguaucuggccggcgcgggguuagcuuuuucuauaaugaaauccgugggaacaggcaagagggguaccgggagccaaggagagacucuuggcgaaaaguggaaaaagaaacugaaucagcucucacggaaggauuucgaccuauacaaaaagagugguaucacagaggucgaucgaaccgaggcaaaagaaggccugaagagaggggagauuacgcaccaugccguuucucgcggauccgcuaaguugcagugguuuguggaaaggaacauggucauccccgagggccgggugauugaccugggguguggacguggcgguuggagcuauuacugcgccgggcucaaaaagguaaccgaagugagaggauauacaaaaggcggcccugggcacgaggagccgguucccaugucaacuuacggauggaauaucgugaagcuuaugagugguaaagaugucuucuaccugccaccugaaaagugugacaccuugcugugcgauauuggcgagagcucccccucuccuacaguggaagagagcaggacuauccgcguccucaagaugguggagccaugguuaaaaaacaaucaguucuguauaaagguucugaaccccuauaugccuaccguaauugaacaccuugagcggcugcaacgaaaacaugggggaaugcuagugagaaauccacucuccaggaacucaacacacgaaauguacuggaucucuaauggcaccgguaacaucgucgcaagugugaauaugguuucgcgccuguugcugaaccgguuuacuaugacgcauagacgucccacaauugagaaggacguggaucucggggccggaaccaggcacgucaacgcugaaccggagacuccuaauauggacgugauaggcgagcggaucaaacgcauuaaggaagagcacaacagcaccuggcauuaugacgaugaaaauccauacaagacaugggcguaucacggcuccuacgagguaaaagccacggggucugcaucaagcaugaucaacggagugguuaagcuucugaccaaacccugggacgucgugccuauggugacucagauggcuaugacagauaccacuccauucggucagcaacgagucuuuaaggaaaaaguugacacaagaacccccagguccaugccgggcacacggcgcgugauggggauuacugccgagugguuauggagaacccugggaaggaauaagaagccucgauugugcacgcgggaggaauucaccaaaaagguacguacaaacgcagccaugggcgcuguguuuacugaggaaaaucagugggauagugccaaagcggcagucgaggacgaagauuucuggaagcucguggacagagagcgcgagcugcauaaacuagguaagugugggucuugcguuuauaacaugaugggaaaaagggaaaagaagcuuggcgaguuuggcaaagccaaggggagccgggcuaucugguacauguggcugggagccagauaccucgaauucgaggcacuggguuuuuugaaugaggaucacugguucucacgcgaaaacuccuauaguggcguggagggggaaggacugcauaaacucggcuacauacuuagggacaucagcaagauucccgguggggcuauguaugccgaugacaccgcuggaugggacacacgaaucacugaggaugaccugcacaaugaagagaaaauuacccagcagauggauccagagcaccggcaauuagccaacgcaaucuuuaagcugacguaccagaauaaggucgugaaaguacagagaccuacacccaccggcacuguuauggacauaauuucuaggaaggaucagcgcggcuccgggcaagugggaacauaugguuugaacaccuucacuaauauggaagcgcagcucauccgucagauggagggcgaagggguccugucaaaagccgaccuagagaacccacaucuucccgaaaagaaaaucacccaguggcuggagacaaagggaguggagcggcucaagagaauggcuauuagcggcgaugacugcguggucaaaccuauagaugacagguuugccaacgcacuguuggcuuuaaaugauauggguaagguucgcaaagacaucccacaauggcagccgucgaagggguggcacgauuggcagcaggugcccuucuguucucaucacuuccacgaacugauuaugaaagacggacgaaagcucguagugccuugccggccacaagacgagcuuaucggcagagccaggauuagucagggcgcaggguggucccugaaggaaacggccugucuaggaaaagcguacgcucagauguggagccugauguauuuucaucgcagagaucuccgguuggccucaaacgcaaucugcuccgccguccccgugcacuggguuccuaccucuaggacuacauggagcauacaugcucaccaucaauggaugaccacugaggacaugcugacaguguggaaucgugucuggaucgaagauaacccauggauggaggacaagacccccgugacgacaugggagaauguaccuuaccuugguaaacgagaagaucagugguguggcagucugauugggcucaccucccgcgccacuugggcacagaacaucccgaccgcuauucagcaaguuagaagcuuaaucggaaaugaggaauuccuggacuacaugccaucuaugaagcgguuuaggaaagaggaggaaucagagggcgccauuugguga

SEQ ID NO: 15291 - RNA, 9873 nt, Artificial Sequence
  derived and/or modified CDS sequence (opt3) from DENV-3__HQ541785__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauaugggggaagauggauguugguacggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcacaugaucgccgggguguucuuuacguucguucuacugcucuccggacagauuacuuggcgggauauggcacauacccugaucaugauuggcaguaaugcuagcgacagaauggguaugggggugacauaucuugccuugauagcaaccuuuaaaauccagcccuuccuggccuuaggauuuuuccucaggaagcugacuucucgcgaaaaccuucugcuaggcgucggccucgcuauggcgacaacccugcaauugccggaggauauugaacagauggccaaugggaucgcacugggauuaauggcucucaaacugauuacacaguuugagacuuaccagcuuuggaccgcccugaucuccuugacguguucaaacacaauauucacccucacuguggccuggcgaaccgcuacacugauccuagcagguguuagucugcuuccugugugccaaagcucguccaugcggaagacugacuggcucccaauggccgucgcggcuaugggcguacccccucugcccuuguuuauuuucucucugaaggauaccuuaaaacguagaagcuggccacucaaugagggggugauggccguuggacuggugucaauccuugcaaguucccuguugaggaacgacgucccuauggccggcccccucguggcuggugggcugcuaauugcauguuauguaaucacgggaacaucugccgaucugaccguggaaaaggcggcugacauaacuugggaggaagaggccgaacagacaggcgucagccacaaccuuaugauugcaguugacgaugacggcaccaugcgcaucaaagaugacgagacugagaauauccucacagugcuguugaagaccgccuuacugauuguguccgggauauuuccauacucaaucccggcuacgcuccuggucuggcauacuuggcagaaacagacccaacggagcggagugcuuugggauguuccuagucccccagaaacacagaaggccgagcuggaagaggguguauacagaauuaaacagcagggcaucuucgggaagacccaagugggagucggcgugcagaaggaggguguuuuucacacaauguggcacgugacuaggggggcagucuugaccuauaacggaaaacgacuagaacccaauugggcuucugugaagaaagaccugauuuccuacggcggcggguggcgccucagcgcccaguggcaaaagggagaggaaguacaggucaucgcgguggagccugguaaaaacccaaagaauuuccagacgaugcccggcacauuccagacuaccacaggggaaauaggagccaucgcacuggauuuuaagccuggcaccucggguucaccgauuaucaaccgggaggggaaaguugugggacuuuauggcaauggcgucgugacuaagaacgggggauacguuucugguauugcucaaaccaaugccgagccagacggccccacaccugaauuagaggaagagauguucaaaaagagaaaccugacgaucauggaucuccauccagggaguggaaaaacuaggaaguauuugcccgcuauagugcgugaagcaauuaagcgccggcugagaacccucauccuggccccuacaagggucguggccgcugagauggaggaagcgcuuaaaggccugccgauccgauaccagaccacugcaacaaaguccgagcacaccggucgggaaauuguagacuugaugugccaugccacguuuacuaugcgccuacugagccccgugagaguuccaaauuauaaccucaucauaauggaugaggcucacuucacagacccugccucuauugcagccaggggguacaucagcacccgggucggaaugggcgaagcugcggccauuuuuaugaccgcaacucccccaggcacagcugaugccuucccucaguccaaugcacccauccaggacgaggagcgagacauaccagaaagaucauggaacagugggaaugaguggauuaccgauuuugccggaaaaacagugugguucgugccgagcaucaaggcugguaacgacaucgccaacuguuuacgcaaaaauggcaagaaggucauucaacugucuaggaaaacuuuugauacggaauaccagaagaccaaacuuaacgacugggauuucguagugacaacugacaucuccgagaugggggcgaauuuuaaggcagaucguguuauugacccucggagaugccugaaacccgugauacucaccgauggaccagagagggucaucuuggccggccccaugccugugacagcugccucagcugcacagcgccgagguagaguugggcggaacccacagaaggaaaaugaccaauauauuuucaccggccagccccugaacaaugaugaggaccaugcccacuggacugaagcuaagaugcuccuggacaacaucaauacgccugagggaaucauuccggcccuuuucgaaccagagagggagaaaagugcagcgauagauggcgaauaccgccuaaagggggagagccguaaaaccuuuguggaacugaugagacggggagacuugcccgucugguuagcccacaagguggcuuccgaggguaucaaauauacagauaggaaguggugcuucgacggccagcgcaacaaucagauucuggaagagaacauggauguagagaucuggacuaaagaaggggagaagaagaaacuccgaccuagauggcuggacgcccggaccuacucugauccccuugcacugaaggaauuuaaagaguucgcugccggaaggaagucgauugcacucgacuuggugacagaaaucggccgcguuccaagccaucuggcccacagaaccaggaaugcucuagauaaccuggucaugcuccauacuucagagcacggugggcgggcguaucgucacgccguggaggaacuuccugagacaauggaaacgcuguuauugcugggccucaugauacugcuuaccggaggcgcaaugcuguuucucaucuccgggaaaggaauugguaagacuaguaucggcuugauuugugugaucacaucuagcgggaugcuguggauggcugagauacccuuacaauggauugccuccgccaucguccuagaguucuuuaugaugguucugcucauuccagaaccugagaagcagcgcaccccgcaggacaaucaacuugcauacgugguaaucggaauacugaccuuggcugccaucauugcggcuaacgaaaugggccugcucgagacaacuaaacgagaucuggguaugucaaaggaacccgggguggucucuccaacgagcuaucuugacguggaucuccauccugccagugcauggacccuguacgccguugcuacaacugugaucacccccauguugagacacacaauugagaauuccaccgcaaacgucagccuggccgcgaucgcuaaccaggccguaguguuaaugggccuagacaaaggauggccaauaucuaagauggaccugggcguuccucuccuugcacuggggugcuacucacaggugaaucccuugacucugacggccgcuguccuccugcuuauuacacauuaugccaucaucggaccgggcuuacaggcaaaagcuaccagggaggcccaaaagcggacugcggccgguauuaugaagaacccaaccguggaugggaucaugacaauagaccuggauccugucauuuacgacuccaaauucgaaaagcagcucggacaggugauguugcugguucuaugugcagugcagcugcuccuuaugcgcacuaguugggcucugugcgaggccuugacccuggcaacaggccccaucacgacccucugggaagguagcccaggcaaauuuuggaauacuacaauugcuguaucgauggccaacaucuucagagggucuuaucuggccggagcgggcuuagcuuuuuccauaaugaagagcguggggaccggaaaaaggggcacugguucacaaggggagacacuuggagaaaaguggaagaaaaagcugaaucagcucagucggaaagauuucgaccuauacaagaaaucuggcaucaccgaggucgaucgaacggaggcaaaggaaggucugaaaagaggcgagauuacccaccaugccguuucccgcgggagcgcuaaguugcagugguuuguggaaaggaacauggucauccccgagggacgggugauugaccugggcugugggcguggaggcuggucauauuacugcgccggucucaagaaaguaacagaagugagaggguauacuaagggaggcccuggccacgaggagccgguucccaugaguaccuacggguggaauaucgugaaacuuaugagcggaaaggaugucuucuaccugccaccugaaaaaugugacacauugcugugcgauauuggugaguccucucccagcccuacuguggaagaguccaggaccauccgcguccucaagaugguggagccaugguuaaagaacaaucaguucuguauaaaaguucugaaccccuauaugccuacaguaauugaacaccuugagcggcugcaacgaaagcauggcgggaugcuagugagaaauccacucucaaggaacucuacccacgaaauguacuggaucaguaauggaacuggcaacaucgucgcaucggugaauaugguuagccgccuguugcugaaccgguuuacgaugacacauagacgucccaccauugagaaagacguggaucucggugccgggacuaggcacgucaacgcugaaccggagaccccuaauauggacgugauaggagagcggaucaagcgcauuaaagaagagcacaacuccacauggcauuaugacgaugaaaauccauacaagacgugggcguaucacggcucuuacgagguaaaggccaccggcucagcaagcuccaugaucaacggggugguuaaacuucugacuaagcccugggacgucgugccuauggugacacagauggcuaugaccgauacuacaccauucggacagcaacgagucuuuaaagaaaagguugacaccagaacacccaggaguaugccggguacucggcgcgugaugggcauuaccgccgagugguuauggagaacgcuggggaggaauaaaaagccucgauugugcacccgggaggaauucacaaagaaaguacguacuaacgcagccaugggagcuguguuuaccgaggaaaaucagugggauucugccaaggcggcagucgaggacgaagauuucuggaaacucguggacagagagcgcgagcugcauaagcuaggcaaaugugguagcugcguuuauaacaugauggggaagagggaaaaaaagcuuggagaguuuggcaaggccaaaggcucacgggcuaucugguacauguggcugggggccagauaccucgaauucgaggcacugggauuuuugaaugaggaucacugguucucccgcgaaaacaguuauagcgguguggagggcgaagggcugcauaagcucggauacauacuuagggacaucucuaaaauucccggcggugcuauguaugccgaugacacagcugggugggacacucgaaucaccgaggaugaccugcacaaugaagagaagauuacgcagcagauggauccagagcaccggcaauuagccaacgcaaucuuuaaacugacauaccagaauaaggucgugaagguacagagaccuacccccacuggaacaguuauggacauaauuuccaggaaagaucagcgcggcucaggccaaguggggaccuauggauugaacacuuucaccaauauggaagcgcagcucauccgucagauggagggugaaggcguccugagcaaggccgaccuagagaacccacaucuucccgaaaaaaagaucacacaguggcuggagacgaaagggguggagcggcucaagagaauggcuauuucgggagaugacugcguggucaagccuauagaugacagguuugccaacgcacuguuggcuuuaaaugauaugggcaaaguucgcaaggacaucccacaauggcagccgucuaaagguuggcacgauuggcagcaggugcccuucuguagucaucacuuccacgaacugauuaugaaggacgggcgaaaacucguagugccuugccggccacaagacgagcuuaucggaagagccaggauuucccagggcgcaggcuggagccugaaggaaaccgccugucuagggaaggcguacgcucagauguggucacugauguauuuucaucgcagagaucuccgguuggccuccaacgcaaucugcucugccguccccgugcacuggguuccuacuagcaggacaaccuggaguauacaugcucaccaucaauggaugacuacagacgauaugcugaccguguggaaucgugucuggaucgaggacaacccauggauggaagauaaaacgcccgugacaaccugggagaauguaccuuaccuuggaaagcgagaggaccaguggugugguucccugauuggccucacuagccgcgccaccugggcacagaacaucccgacagcuauucagcaaguuagaucuuuaaucgggaaugaagaguuccuggauuacaugccaucaaugaaacgguuuaggaaggaagaggagagugaaggagccauuugguga

SEQ ID NO: 15292 - RNA, 9873 nt, Artificial Sequence
  derived and/or modified CDS sequence (opt3) from DENV-3__HM181975__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucgucuuacugaugcuugugaccccaucgaugacaaugcgcuguguaggcguugggaacagagacuuuguggaaggauugucaggugccaccugggucgauguggugcuggagcacggcgggugcgucacgacuauggcgaagaauaaacccacacuagacaucgagcuccagaagaccgaagcaacucaacuggccacacuuaggaaacuguguauugagggaaagaucaccaacauuacgaccgauagccggugcccuacacagggcgaagcuacuuugccagaggaacaggaccagaauuauguuuguaaacacaccuacguggaucgcgguugggggaacggaugcggccucuucggcaaggggagucugguaacaugcgccaaguuucaauguuuagagcccaucgagggaaaagugguccagcaugaaaaucugaaguauacugugauaauuaccguucacacaggugaccagcaucaggugggcaacgagacccaaggggucacugcagaaaucacgccucaggcuuccacaaccgaggccauucucccagaauacggaacucuuggccuggagugcucuccgcgaaccgguuuggacuucaaugagaugauccuacugacaaugaaaaacaaggcguggauggugcacagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcauacagcucucaccggcgccacagaaauccagaauucagggggaacuaguauuuucgcaggucaccugaagugucgguuaaaaauggacaagcuggagcuaaaaggcaugagcuaugccaugugcaccaacacguuugugcucaagaaagaggucucugaaacccagcaugggacaauacugaucaagguggaguacaagggagaagauguucccuguaaaauuccuuucuccacugaggacggccaagguaaggcucacaacgggcgucuuaucaccgcgaauccagugguaacaaaaaaggaggaacccgucaacauagaggcagaaccgccuuucggcgagucaaauauugugaucggaaucggcgauaacgccuugaaaauuaauugguacaagaaggggagcaguaucggaaaaauguuugaagcuacugcccgcggugcaagaaggauggccauucugggcgacaccgcuugggauuucgggucuguuggaggcgugcucaacucccuggguaagaugguccaucagauauuugggagcgccuauacggcacuuuucucgggcgugucuuggguaaugaaaaucggaauuggcgugcuguugacauggaucgggcucaauuccaagaacaccucaaugaguuuuagcugcaucgcgauuggaauaaucacucuguacuuaggcgcuguuguccaggccgacauggguugugugauuaauuggaaagggaaggagcugaagugcggauccggcaucuucgugacaaacgagguccacaccuggacugaacaguauaaauuucaagcagauucucccaagcggcuagccaccgcuauugccggugcaugggagaauggcguuugugggauccgaagcacaacgcgcauggaaaaccuccuguggaaacagauagcuaaugagcuuaacuacaucuugugggaaaauaacauuaagcugaccguggugguaggagacaucauuggcguccucgagcaggggaaaagaacucugacaccacagccuauggaguuaaaguauucauggaaaaccuggggaaaggccaagaucgugacagcggaaacucaaaacaguuccuucauaauugauggccccaauaccccagagugccccagcguuucuagggccuggaacgugugggaagucgaggacuacgguuuugggguguucacgacaaauaucuggcugaaacuucgggaaguuuauacccaguugugugaccaccgccucaugucagcugcagugaaggaugagagagccguacaugcugacaugggauacuggauugagagucagaaaaacggcagcuggaagcuggaaaaagccucccuaaucgaggucaagacuugcaccuggccuaagucucacacacuguggucgaauggugugcucgaaagcgauaugauaaucccaaaaucccuggcaggcccgauuucacagcauaaccacaggcccggguaccacacucaaaccgcgggaccuuggcaucuuggcaaguuggagcuggacuuuaauuauugcgaggggacaacgguggucaucaccgaaaacuguggaacucguggcccaaguuuacggacaaccacuguuucugguaaacucauucacgaguggugcugucgaagcugcacacugcccccucuuagauacaugggggaagauggauguugguauggcauggagaucaggccaauauccgaaaaggaggagaauauggugaaaucacugguaagcgccgguucuggcaagguggacaacuucaccaugggggucuugugccucgcuauucuguuugaagaggugaugcgcggaaaguucggcaaaaagcauaugaucgccgggguuuucuuuacguucgugcuacugcucuccggacagaucacuuggcgggauauggcacacacccugauuaugaucggcaguaaugcuagcgacagaauggguaugggggucacauaccuugccuugauugcaaccuuuaaaauacagcccuuccuggccuuaggauuuuuccucaggaagcugacuucucgcgaaaaccuucugcuaggcgugggccucgcuauggcgacaacccugcaauugccggaggauaucgaacagauggccaaugggauugcacugggauuaauggcucucaaacugaucacacaguuugagauuuaucagcuuuggacugcccugaucuccuugaccuguucaaacacgauauucacacucaccguugccuggcgaacugcuacccugauccuagcaggugugagucugcuuccuaugugccaaagcucguccaugcggaagacagacuggcucccaauggccgucgcggcuaugggcguacccccucugcccuuguuuauuuucucucugaaggauacuuuaaaacguagaagcuggccacucaaugagggggugauggccguuggacuggugucaauccuugcaaguucccuguugaggaacgacgucccuauggccggcccccucguggcuggugggcugcuaauugcauguuacguaaucaccggaacgucugccgaucugacaguggaaaaggcggcugacauaaccugggaggaagaggccgaacagacuggcgucagccauaaccuuaugauuacaguugacgaugacggcaccaugcgcaucaaagaugacgagacugagaauauccucacagugcuguugaagaccgcauuacugauuguguccgggauauuuccauauucaaucccggccacgcuccuggucuggcacacuuggcagaaacagacccaacggagcggagugcuuugggauguuccuagucccccagaaacacagaaggcugagcuggaagaggguguauacagaauuaaacagcagggcaucuucgggaagacccaagugggagucggcgugcagaaggaggguguuuuucacacaauguggcaugugacuaggggggccgucuugaccuacaacggaaaacgacuagaacccaauugggcaucugugaagaaagaccugauuuccuauggcggcggguggcgccucagcgcucaguggcaaaagggagaggaaguacaggucaucgccguggagccugguaaaaacccaaagaauuuccagacgaugcccggcacauuccagacuaccacaggggaaauaggagcgaucgcccuggauuuuaagccuggcaccucggguucaccgauuaucaaccgggaggggaaaguugugggacuuuacggcaauggcgucgugacuaagaacgggggauauguuucugguauugcacaaaccaaugcugagccagacggccccacaccugaauuagaggaagagauguucaaaaagagaaaccugacgaucauggaucuccacccagggaguggaaaaacuaggaaguacuugcccgccauagugcgugaagcuauuaagcgccggcugagaacccucauccuggcaccuacaagggucguggccgccgagauggaggaagcucuuaaaggccugccgauccgauaucagaccacugcgacaaaguccgagcauaccggucgggaaauuguagacuugaugugccacgcaacguuuacuaugcgccuacugagccccgugagaguuccaaauuacaaccucaucauaauggaugaggcccauuucacagacccugcuucuauugccgcaaggggguauaucagcacccgggucggaaugggcgaagccgcugcgauuuuuaugaccgccacucccccaggcacagcagaugcuuucccucaguccaaugcccccauccaggacgaggagcgagacauaccagaaagaucauggaacagugggaaugaguggauuaccgauuuugcaggaaaaacagugugguucgugccgagcaucaaggccgguaacgacaucgcuaacuguuuacgcaaaaauggcaagaaggucauucaacugucuaggaaaacuuuugauacggaauaccagaagaccaaacuuaacgacugggauuucguagugacaacugacaucuccgagaugggggccaauuuuaaggcggaucguguuauugacccucggagaugccugaaacccgugauacucaccgauggaccagagagggucaucuuggcaggccccaugccugugacagccgcuucagccgcucagcgccgagguagaguugggcggaacccacagaaggaaaaugaccaauacauuuucaccggccagccccugaacaaugaugaggaccacgcacacuggacugaagccaagaugcuccuggacaacaucaauacgccugagggaaucauuccggcucuuuucgaaccagagagggagaaaagugccgcaauagauggcgaauaucgccuaaagggggagagccguaaaaccuuuguggaacugaugagacggggagacuugcccgucugguuagcgcauaagguggccuccgaggguaucaaauacacagauaggaaguggugcuucgacggccagcgcaacaaucagauucuggaagagaacauggauguagagaucuggacuaaagaaggggagaagaagaaacuccgaccuagauggcuggacgcucggaccuauucugauccccuugcccugaaggaauuuaaagaguucgcagcuggaaggaagucgauugcccucgacuuggugacagaaaucggccgcguuccaagccaccuggcacauagaaccaggaaugcccuagauaaccuggucaugcuccacacuucagagcacggugggcgggcuuaccgucaugcgguggaggaacuuccugagacaauggaaacgcuguuauugcugggccucaugauacugcuuaccggaggcgccaugcuguuucucaucuccgggaaaggaauugguaagacuaguaucggcuugauuugugugaucgcaucuagcgggaugcuguggauggcugagauacccuuacaauggauugccuccgccaucguccuagaguucuuuaugaugguucugcucauuccagaaccugagaagcagcgcacaccgcaggacaaucaacuugcauaugugguaaucggaauacugaccuuggcugccaucauugcggcuaacgaaaugggccugcucgagaccacaaaacgagaucuggguaugucaaaggaacccgggguggucucuccaacuagcuaccuugacguggaucuccacccugccagugcauggacgcuguaugccguugcuaccacagugaucacucccauguugagacauaccauugagaauuccacagcaaacgucagccuggccgcgaucgcuaaccaggccguaguguuaaugggccuagacaaaggauggccaauaucuaagauggaccugggcguuccucuccuugcacuggggugcuacucacaggugaaucccuugacccugacugccgcuguccuccugcuuauuacgcacuacgccaucaucggaccgggcuuacaggcaaaagcuacaagggaggcccaaaagcggaccgcggccgguauuaugaagaacccaacuguggaugggaucaugaccauagaccuggauccugucauuuaugacuccaaauucgaaaagcagcucggacaggugauguugcugguucuaugugugguacagcugcuccuuaugcgcacaaguugggcacugugcgaggcuuugacucuggccaccggccccaucacaacgcucugggaagguagcccaggcaaauuuuggaauaccacuauugcagugucgauggcuaacaucuucagagggucuuaccuggccggagccggcuuagcguuuuccauaaugaagagcgucgggacaggaaaaaggggcaccgguucacaaggggagacucuuggagaaaaguggaagaaaaagcugaaucagcucagucggaaagauuucgaccuauauaagaaaucuggcaucacagagguugaucgaaccgaggcuaaggaaggucugaaaagaggcgagauuacgcaucacgcagugucccgcgggagcgccaaguugcagugguuugucgaaaggaacauggugauccccgagggacggguaauugaccugggcugugggcguggaggcuggucauacuauugcgcuggucucaagaaagugaccgaaguuagaggguacacaaagggaggcccuggccacgaggagccggugcccaugaguacuuauggguggaauaucgucaaacuuaugagcggaaaggauguguucuaccugccaccugaaaaaugugacaccuugcugugcgauauuggugaguccucucccagcccuacagucgaagaguccaggacuauccgcgugcucaagaugguugagccaugguuaaagaacaaucaguucuguauaaaaguacugaaccccuacaugccuaccgugauugaacaucuugagcggcugcaacgaaagcacggcgggaugcuagucagaaauccacucucaaggaacucuacacaugaaauguauuggaucaguaauggaaccggcaacaucguggccucgguuaauauggugagccgccuguugcugaaccgguuuacuaugauucacagacgucccacgauagagaaagacgucgaucucggugcagggacaaggcacgugaacgccgaaccggagaccccuaauauggacguaaucggagagcggauuaagcgcaucaaagaagagcauaacuccacuuggcacuacgacgaugaaaauccauauaagaccugggcuuaccauggcucuuaugaggugaaggcgacaggcucagccagcuccaugauuaacgggguugucaaacuucugacgaagcccugggacguggugccuauggucacccagauggcaaugacugauacaaccccauucggacagcaacgaguuuuuaaagaaaagguggacacuagaacacccaggaguaugccggguacccggcgcguaaugggcaucacagcugagugguuauggagaacucuggggaggaauaaaaagccucgauugugcacccgggaggaauucacgaagaaagugcguaccaacgccgcaaugggagccgucuuuacagaggaaaaucagugggauucugcuaaggccgcgguggaggacgaagauuucuggaaacucguugacagagagcgcgagcugcacaagcuaggcaaaugugguagcugcguguacaacaugauggggaagagggaaaaaaagcuuggagaguuuggcaaggcaaaaggcucacgggccauaugguauauguggcugggggcuagauaccucgaauucgaggcccugggauuuuugaaugaggaucauugguucucccgcgaaaacaguuacagcggugucgagggcgaagggcugcacaagcucggauauauccuuagggacauuucuaaaauccccggcggugcaauguacgcugaugacacugccgggugggacacccgaauuacagaggaugaccugcacaaugaagagaagaucacucagcagauggauccagagcaucggcaauuagcuaacgccauauuuaaacugaccuaucagaauaaggugguaaagguucagagaccuacgcccacaggaaccgugauggacauuaucuccaggaaagaucagcgcggcucaggccaagucgggacuuacggauugaacacauucaccaauauggaagcacagcucauccgucagauggagggugaaggcgugcugagcaaggcggaccuagagaacccacaccuucccgaaaaaaagauuacucaguggcuggagaccaaagggguggagcggcucaagagaauggccauaucgggagaugacugcgucguuaagccuaucgaugacagguuugcuaacgcccuguuggcauuaaaugauaugggcaaagugcgcaaggacauuccacaauggcagccgucuaaagguuggcaugauuggcagcagguacccuucuguagucaccacuuccaugaacugaucaugaaggacgggcgaaaacucguggucccuugccggccacaagacgagcuuauuggaagagcuaggaucucccagggcgccggcuggagccugaaggaaacagcaugucuagggaaggccuaugcgcagauguggucacugauguacuuucaccgcagagaucuccgguuggcuuccaacgccauaugcucugcagugcccguucauugggugccuacgagcaggaccacuuggaguauccacgcccaucaccaauggaugacaaccgaggacaugcugacugucuggaaucguguguggauugaagauaacccauggauggaggacaaaacacccguaaccacgugggagaauguuccuuaucuuggaaagcgagaagaucaguggugugguucccugaucggccucacaagccgcgcuaccugggcccagaacauuccgacugcaauccagcaagugagaucuuuaauugggaaugaggaauuccuggacuacaugccaucaaugaaacgguuuaggaaggaggaggaaagugagggagcuauaugguga

SEQ ID NO: 15293 - RNA, 9873 nt, Artificial Sequence
  derived and/or modified CDS sequence (opt3) from DENV-3__HM631864__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagaaagccgugcacgcugacaugggauacuggaucgagagucagaagaacggcagcuggaaacuggaaaaggccucccuaauagagguaaagacuugcaccuggccuaaaucucauacacuguggucgaaugguguccucgaaagcgauaugaucauuccaaagucccuggcaggcccgaucucacagcacaaccauagacccggguaucacacucaaaccgcgggaccuuggcaccuuggcaaauuggagcuggacuuuaauuacugcgaggggacaacgguggugauuaccgaaaacuguggaacuaggggcccaaguuuacguacaaccacugucucugguaagcucauccaugaguggugcugucggagcugcacacugcccccucuucgauauaugggggaagauggauguugguacggcauggagauaagaccaauuuccgaaaaagaggagaauaugguuaagucacuggugagcgccgguucuggcaagguagacaacuccaccauggggguguugugccucgcuauccuguucgaagaggucaugaggggaaaauuuggcaagaaacacaugaucgccgggguguucuucacguuuguucuacugcucaguggacagauuacuuggcgcgauauggcacauacccugaucaugauuggcagcaaugcuucugaccggauggguaugggggugacauaucuugccuugauagcaaccuucaagauccagcccuuucuggccuuaggauucuuucucagaaaacugacuuccagggaaaaccuucugcuaggcgucggccucgcuauggcgacaacccugcaauugccggaggauauugaacagauggccaaugggaucgcacugggauuaauggcucucaagcugauuacacaguucgagacuuaccagcuuuggaccgcccugaucucauugacguguaguaacacaauauuuacccucacuguggccuggcgcaccgcuacacugauccuagcagguguuagccugcuuccugugugccaaucguccucuaugcgaaagacugacuggcucccaauggccgucgcggcuaugggcguacccccucugcccuuguucauuuuuagccugaaagauaccuuaaagcggcguucauggccacucaaugagggggugauggccguuggacuggugaguauccuugcauccucucuguugagaaacgacgucccuauggccggcccccucguggcuggugggcugcuaauugcauguuauguaaucacgggaacaagcgccgaucugaccguggaaaaagcggcugacauaacuugggaggaagaggccgaacagacaggcgucucccacaaccuuaugauugcaguugacgaugacggcaccaugaggaucaaggaugacgagacugagaauauccucacagugcuguugaaaaccgccuuacugauugugucagggauauucccauacagcaucccggcuacgcuccuggucuggcauacuuggcagaagcagacccaacgcaguggagugcuuugggauguuccuucucccccagaaacacagaaagccgagcuggaagaggguguauaccggauuaagcagcagggcaucuuugggaagacccaagugggagucggcgugcagaaagaggguguuuuccacacaauguggcacgugacuagaggggcagucuugaccuauaacggaaagaggcuagaacccaauugggcuuccgugaaaaaggaccugauuagcuacggcggcggguggcgacucucggcccaguggcaaaaaggagaggaaguacaggucaucgcgguggagccugguaagaacccaaagaauuuucagacgaugcccggcacauuccagacuaccacaggggaaauaggagccaucgcacuggauuucaaaccuggcaccucagguucuccgauuaucaaccgcgaggggaagguugugggacuuuauggcaauggcgucgugacuaaaaacgggggauacguuagugguauugcucaaaccaaugccgagccagacggccccacaccugaauuagaggaagagauguuuaagaaacggaaccugacgaucauggaucuccauccaggguccggaaagacuagaaaguauuugcccgcuauagugagggaagcaauuaaacgucgccugcggacccucauccuggccccuacaagagucguggccgcugagauggaggaagcgcuuaagggccugccgaucagguaccagaccacugcaacaaaaagcgagcacaccggucgagaaauuguagacuugaugugccaugccacguucacuaugcggcuacugucucccgugcgcguuccaaauuauaaccucaucauaauggaugaggcucacuuuacagacccugccagcauugcagccagaggguacaucuccaccagggucggaaugggcgaagcugcggccauuuucaugaccgcaacucccccaggcacagcugaugccuuuccucagucaaaugcacccauccaggacgaggagcgggacauaccagaacgaaguuggaacagcgggaaugaguggauuaccgauuucgccggaaagacagugugguuugugccgucuaucaaagcugguaacgacaucgccaacuguuuaagaaagaauggcaagaaagucauucaacugucccgcaagacuuucgauacggaauaccagaaaaccaagcuuaacgacugggauuuuguagugacaacugacaucucagagaugggggcgaauuucaaagcagauaggguuauugacccucgucggugccugaagcccgugauacucaccgauggaccagagagagucaucuuggccggccccaugccugugacagcugccagugcugcacagaggcgcggucgaguugggagaaacccacagaaggaaaaugaccaauauauuuuuaccggccagccccugaacaaugaugaggaccaugcccacuggacugaagcuaaaaugcuccuggacaacaucaauacgccugagggaaucauuccggcccuuuucgaaccagagcgggagaagagcgcagcgauagauggcgaauacaggcuaaaaggggagucccgcaagaccuucguggaacugaugcguagaggagacuugcccgucugguuagcccacaaaguggcuucugaggguaucaaguauacagaucggaaauggugcuuugacggccagaggaacaaucagauucuggaagagaacauggauguagagaucuggacuaaggaaggggagaagaaaaagcuccgcccucgauggcuggacgccagaaccuacucggauccccuugcacugaaagaauucaaggaguuugcugccggacggaaaagcauugcacucgacuuggugacagaaaucggcaggguuccaucacaucuggcccaccgcaccagaaaugcucuagauaaccuggucaugcuccauacuuccgagcacggugggagggcguaucggcacgccguggaggaacuuccugagacaauggaaacgcuguuauugcugggccucaugauacugcuuaccggaggcgcaaugcuguuccucaucagugggaagggaauugguaagacuucuaucggcuugauuugugugaucgcuagcuccgggaugcuguggauggccgagauacccuuacaauggauugccucagcaaucguccuagaguuuuucaugaugguucugcucauuccagaaccugagaaacagcguacaccgcaggacaaucaacuugcuuacgugguaaucggaauacugaccuuggccgcggugaucgcugccaacgaaaugggccugcucgagaccacaaagcgcgaucuggguaugucuaaagaacccggggucgugagcccaacuaguuaucuugacguugaucuccauccugcauccgccuggacgcuguacgcuguggcaaccacagucauuacucccauguugcgacacaccaucgagaauagcacagccaacguaucucuggcggcuauugccaaccaggcagugguuuuaaugggccuagacaagggauggccaaucucaaaaauggaccugggcgugccucuccuugcccuggggugcuacucccaggucaaucccuugacccugacugcugccgugcuccugcuuauaacgcauuaugcaauuaucggaccgggcuuacaggcuaaggccacaagagaggcgcaaaagaggaccgccgcagguaucaugaaaaacccaacugucgaugggauuaugaccaucgaccuggauccugugauauacgacaguaaguuugaaaaacagcucggacagguuauguugcuggugcuaugugcuguacagcugcuccuuaugcggacaagcugggcccugugcgaggcauugacucuggcuaccggccccauuacaacgcucugggaagguucgccaggcaaguucuggaauaccacuaucgccgugucuauggccaacauuuuucgcggguccuaucuggcgggagcuggcuuagcauucagcaucaugaaaucagucgggacaggaaagagaggcaccgguagucaaggggagacucuuggagaaaaguggaaaaagaaacugaaucagcucucuaggaaggauuuugaccuauacaaaaaguccggcauaacagagguugaucggaccgaggccaaagaaggucugaagcgaggcgagaucacgcaccaugcugugagcagagggucagccaaguugcagugguucgucgaacgcaacauggugauucccgagggaaggguaaucgaccugggcugugggcggggaggcuggaguuauuacugcgcaggucucaaaaaggugaccgaaguucguggguauacaaaaggaggcccuggccacgaggagccggugcccaugagcacuuacggguggaauauugucaagcuuauguccggaaaagauguguuuuaccugccaccugaaaagugugacaccuugcugugcgauaucggugagucuagccccuccccuacagucgaagagucaagaacuauuagggugcucaagaugguugagccaugguuaaaaaacaaucaguucuguaucaagguacugaaccccuauaugccuaccgugauagaacaccuugagcgccugcaacggaaacauggcgggaugcuaguccgaaauccacucucuagaaacaguacacacgaaauguacuggauuucgaauggaaccggcaacaucguggccagcguuaauaugguguccaggcuguugcugaaccgcuucacuaugacgcaucggagacccacaaucgagaaggacgucgaucucggugcugggacccgucacgugaacgcggaaccggagacuccuaauauggacguaauuggagagaggauaaaacggaucaaggaagagcacaacucuaccuggcauuaugacgaugaaaauccauacaagacaugggccuaucacggcucauacgaggugaaagcaacgggcagcgcuuccaguaugauuaacgggguugucaagcuucugaccaaacccugggacguggugccuauggucacucagauggccaugacagauaccacuccauuuggacagcaacgcguuuucaaggaaaaaguggacacacgaacccccagaucuaugccggguacaaggcggguaaugggcaucacugcagagugguuauggcgcacccuggggagaaauaagaagccuagguugugcacgcgagaggaauuuaccaaaaaggugcggacaaacgccgcuaugggagccgucuucacugaggaaaaucagugggauagcgcgaaagcagccguggaggacgaagauuuuuggaagcucguugaccgugagagagagcugcauaaacuaggcaagugugguucaugcguguauaacaugauggggaaacgcgaaaagaagcuuggagaguucggcaaagcuaagggcuccagggccauuugguacauguggcugggggcacgguaccucgaauuugaggcucugggauucuugaaugaggaucacugguuuaguagagaaaacagcuauucuggugucgagggcgaagggcugcauaaacucggauacauccuucgcgacauauccaagauccccggcggugccauguaugcugaugacaccgccgggugggacacaaggauuacugaggaugaccugcacaaugaagagaaaaucacccagcagauggauccagagcaccgacaauuagcaaacgcgauuuucaagcugacguaccagaauaaggugguaaaaguucagcggccuacacccaccggaacugugauggacaucauaucaagaaaggaucagaggggcagcggccaagucgggacauauggauugaacaccuuuacuaauauggaagcccagcucauucgccagauggagggugaaggcgugcugucgaaagcugaccuagagaacccacaucuucccgaaaagaaaaucacccaguggcuggagacaaaggggguggagcgucucaagcggauggccaucucuggagaugacugcgucguuaaaccuauugaugacagauucgcaaacgcucuguuggccuuaaaugauaugggcaaggugaggaaagacauaccacaauggcagccgaguaaggguuggcacgauuggcagcagguacccuuuuguucccaucacuuccacgaacugaucaugaaagacgggcgcaagcucguggucccuugccgaccacaagacgagcuuauuggacgggcaagaaucagccagggcgccggcuggucacugaaggaaacggcgugucuagggaaagcuuacgcccagauguggucccugauguauuuccauaggcgcgaucucagauuggcaucuaacgccauuugcagcgcugugcccguucacugggugccuaccagucggacuacaugguccauccaugcccaccaucaauggaugaccacugacgauaugcugacagucuggaauaggguguggauagaggacaacccauggauggaagauaagacccccguaacgacaugggagaauguuccuuaccuuggaaaacgugaggaccaguggugugguagccugaucggccucaccucucgagcaacuugggcucagaacauuccgaccgccauccagcaagugcgcucauuaauugggaaugaagaguuucuggauuacaugccaaguaugaagagauuccggaaagaagaggaguccgaaggagcgaucugguga

SEQ ID NO: 15294 - RNA, 9873 nt, Artificial Sequence
  derived and/or modified CDS sequence (opt3) from DENV-3__HM631859__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcagcaugaaaaucugaaguauacugucauuaucaccgugcacacaggugaccagcaucagguuggcaacgagacccaaggggugacugcagaaauuacgccucaggcuuccacaaccgaggccauccucccagaauacggaacucuuggccuggagugcucuccgcgaaccgguuuggacuucaaugagaugauccuacugacaaugaaaaacaaggcguggaugguccacagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcauacagcucucaccggcgccacagaaauucagaauucagggggaacuaguauauucgcaggucaccugaagugucgguuaaaaauggacaagcuggagcuaaaaggcaugagcuaugccaugugcaccaacacguuuguccucaagaaagaggugucugaaacccagcaugggacaauccugauuaaggucgaguacaagggagaagaugugcccuguaaaaucccuuucuccacugaggacggccaagguaaggcucacaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguacaagaaggggagcaguauuggaaaaauguuugaagcuacugcccgcggugcaagaaggauggccauacugggcgacaccgcuugggauuucgggucugugggaggcguucucaacucccuggguaagauggugcaucagaucuuugggagcgccuauacggcacuuuucucgggcgucucuugggugaugaaaauuggaaucggcguacuguugacauggaucgggcucaauuccaagaacaccucaaugaguuuuagcugcauugcgauaggaaucauuacucuguacuuaggcgcugugguucaggccgacauggguugugucaucaauuggaaagggaaggagcugaagugcggauccggcauuuucgugacaaacgaggugcacaccuggacugaacaguauaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuacauuuugugggaaaauaacaucaagcugaccguuguggugggagacauuaucggcguacucgagcaggggaaaagaacucugacaccacagccuauggaguuaaaguauucauggaaaaccuggggaaaggccaagauagucacagcggaaacucaaaacaguuccuucauuaucgauggccccaauaccccagagugccccagcgugucuagggccuggaacguuugggaaguggaggacuacgguuuuggggucuucacgacaaauauuuggcugaaacuucgggaaguguauacccaguugugugaccaccgccucaugucagcugcaguuaaggaugagagagccgugcaugcugacaugggauacuggaucgagagucagaaaaacggcagcuggaagcuggaaaaagccucccuaauagagguaaagacuugcaccuggccuaagucucacacacuguggucgaaugguguccucgaaagcgauaugaucauuccaaaaucccuggcaggcccgaucucacagcauaaccacaggcccggguaccacacucaaaccgcgggaccuuggcaucuuggcaaguuggagcuggacuuuaauuauugcgaggggacaacgguggugauuaccgaaaacuguggaacucguggcccaaguuuacggacaaccacugucucugguaaacucauccacgaguggugcugucgaagcugcacacugcccccucuuagauacaugggggaagauggauguugguauggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcauaugaucgccgggguguucuuuacguucguucuacugcucuccggacagauuacuuggcgggauauggcacacacccugaucaugauuggcaguaaugcuagcgacagaauggguaugggggugacauaccuugccuugauagcaaccuuuaaaauccagcccuuccuggccuuaggauuuuuccucaggaagcugacuucucgcgaaaaccuucugcuaggcgucggccucgcuauggcgacaacccugcaauugccggaggauauugaacagauggccaaugggaucgcacugggauuaauggcucucaaacugauuacacaguuugagaucuaucagcuuuggacugcccugauauccuugaccuguucaaacacgaucuucacacucaccguggccuggcgaacugcuacccugauucuagcagguguuagucugcuuccuaugugccaaagcucguccaugcggaagacagacuggcucccaauggccguggcggcuaugggcguccccccucugcccuuguuuaucuucucucugaaggauacuuuaaaacguagaagcuggccacucaaugaggggguaauggccgugggacugguuucaauucuugcaaguucccuguugaggaacgacgugccuauggccggcccccucgucgcuggugggcugcuaaucgcauguuacgugauaaccggaacgucugccgaucugacaguagaaaaggcggcugacauuaccugggaggaagaggccgaacagacuggcgugagccauaaccuuaugaucacagucgacgaugacggcaccaugcgcaucaaagaugacgagacugagaauauucucacaguucuguugaagaccgcauuacugauaguguccgggaucuuuccauauucaauuccggccacgcuccugguguggcacacuuggcagaaacagacccaacggagcggaguccuuugggaugugccuagucccccagaaacacagaaggcugagcuggaagaggguguuuacagaaucaaacagcagggcauuuucgggaagacccaaguaggagugggcguccagaaggaggguguguuucacacaauguggcauguuacuaggggggccguguugaccuacaacggaaaacgacuagaacccaauugggcaucugucaagaaagaccugaucuccuauggcggcggguggcgccucagcgcucaguggcaaaagggagaggaagugcagguaauagccgucgagccugguaaaaacccaaagaauuuccagacgaugcccggcacauuccagacuaccacaggggaaaucggagcgauugcccuggauuuuaagccuggcaccucggguucaccgaucauuaaccgggaggggaaagugguuggacuuuacggcaauggcguggucacuaagaacgggggauaugugucugguaucgcacaaaccaaugcugagccagacggccccacaccugaauuagaggaagagauguucaaaaagagaaaccugacgauaauggaucuccacccagggaguggaaaaacuaggaaguacuugcccgccauuguucgugaagcuaucaagcgccggcugagaacccucauccuggcaccuacaaggguggucgccgccgagauggaggaagcucuuaaaggccugccgauucgauaucagaccacugcgacaaaguccgagcauaccggucgggaaaucguggacuugaugugccacgcaacguuuacuaugcgccuacugagccccguaagagugccaaauuacaaccucauaauuauggaugaggcccauuucacagacccugcuucuaucgccgcaaggggguauauuagcacccggguuggaaugggcgaagccgcugcgaucuuuaugaccgccacucccccaggcacagcagaugcuuucccucaguccaaugcccccauacaggacgaggagcgagacauuccagaaagaucauggaacagugggaaugaguggaucaccgauuuugcaggaaaaacagucugguucgugccgagcaucaaggccgguaacgacauugcuaacuguuuacgcaaaaauggcaagaaggugauccaacugucuaggaaaacuuuugauacggaauaccagaagaccaaacuuaacgacugggauuucgucguaacaacugacauuuccgagaugggggccaauuuuaaggcggaucgugugauagacccucggagaugccugaaacccguuauccucaccgauggaccagagagggugauuuuggcaggccccaugccugucacagccgcuucagccgcucagcgccgagguagaguggggcggaacccacagaaggaaaaugaccaauacaucuucaccggccagccccugaacaaugaugaggaccacgcacacuggacugaagccaagaugcuccuggacaacaucaauacgccugagggaauuauaccggcucuuuucgaaccagagagggagaaaagugccgcaaucgauggcgaauaucgccuaaagggggagagccguaaaaccuuuguugaacugaugagacggggagacuugcccgugugguuagcgcauaaggucgccuccgaggguauuaaauacacagauaggaaguggugcuucgacggccagcgcaacaaucagauccuggaagagaacauggauguggagauuuggacuaaagaaggggagaagaagaaacuccgaccuagauggcuggacgcucggaccuauucugauccccuugcccugaaggaauuuaaagaguucgcagcuggaaggaagucgaucgcccucgacuugguaacagaaauaggccgcgugccaagccaccuggcacauagaaccaggaaugcccuagauaaccugguuaugcuccacacuucagagcacggugggcgggcuuaccgucaugcggucgaggaacuuccugagacaauggaaacgcuguuauugcugggccucaugauccugcuuaccggaggcgccaugcuguuucucauuuccgggaaaggaaucgguaagacuaguauuggcuugaucugugugauagcaucuagcgggaugcuguggauggcugagauucccuuacaauggaucgccuccgccauugugcuagaguucuuuaugaugguccugcucaucccagaaccugagaagcagcgcacaccgcaggacaaucaacuugcauauguugugauaggaauccugaccuuggcugccauuaucgcggcuaacgaaaugggccugcucgagaccacaaaacgagaucuggguaugucaaaggaacccgggguagugucuccaacuagcuaccuugacgucgaucuccacccugccagugcauggacgcuguaugccguggcuaccacaguuauuacucccauguugagacauaccaucgagaauuccacagcaaacgugagccuggccgcgauagcuaaccaggccgucguauuaaugggccuagacaaaggauggccaauuucuaagauggaccugggcgugccucuccuugcacuggggugcuacucacagguuaaucccuugacccugacugccgcugugcuccugcuuaucacgcacuacgccaucauuggaccgggcuuacaggcaaaagcuacaagggaggcccaaaagcggaccgcggccgguaucaugaagaacccaacugucgaugggauaaugaccauugaccuggauccugugaucuaugacuccaaauucgaaaagcagcucggacaggucauguugcuggugcuauguguugugcagcugcuccuuaugcgcacaaguugggcacugugcgaggcuuugacucuggccaccggccccauuacaacgcucugggaagguagcccaggcaaauuuuggaauaccacuaucgcaguaucgauggcuaacauauucagagggucuuaccuggccggagccggcuuagcguuuuccaucaugaagagcguggggacaggaaaaaggggcaccgguucacaaggggagacucuuggagaaaaguggaagaaaaagcugaaucagcucagucggaaagauuucgaccuauauaagaaaucuggcauuacagaggucgaucgaaccgaggcuaaggaaggucugaaaagaggcgagaucacgcaucacgcaguuucccgcgggagcgccaaguugcagugguuuguggaaaggaacauggucauucccgagggacgggugaucgaccugggcugugggcguggaggcuggucauacuauugcgcuggucucaagaaaguaaccgaagugagaggguacacaaagggaggcccuggccacgaggagccgguucccaugaguacuuauggguggaauauugugaaacuuaugagcggaaaggaugucuucuaccugccaccugaaaaaugugacaccuugcugugcgauaucggugaguccucucccagcccuacaguggaagaguccaggacuauacgcguccucaagaugguggagccaugguuaaagaacaaucaguucuguauuaaaguucugaaccccuacaugccuaccguaaucgaacaucuugagcggcugcaacgaaagcacggcgggaugcuagugagaaauccacucucaaggaacucuacacaugaaauguauuggaucaguaauggaaccggcaacauugucgccucggugaauaugguuagccgccuguugcugaaccgguuuacuaugacgcacagacgucccacaauagagaaagacguggaucucggugcagggaccaggcacgucaacgccgaaccggagacuccuaauauggacgugaucggagagcggauuaagcgcaucaaagaagagcauaacuccaccuggcacuacgacgaugaaaauccauauaagacaugggcuuaccauggcucuuaugagguaaaggcgacgggcucagccagcuccaugauuaacggggugguuaaacuucugaccaagcccugggacgucgugccuauggugacucagauggcaaugacagauaccacuccauucggacagcaacgagucuuuaaagaaaagguugacacaagaacccccaggaguaugccggguacacggcgcgugaugggcaucacugcugagugguuauggagaacccuggggaggaauaaaaagccucgauugugcacgcgggaggaauucaccaagaaaguacguacaaacgccgcaaugggagccguguuuacugaggaaaaucagugggauucugcuaaggccgcggucgaggacgaagauuucuggagacucguggaccgcgagagggagcugcacaaacuaggcaagugugguagcugcguuuacaacaugauggggaaacgggaaaagaaacuuggagaguuuggcaaggcaaagggcucaagagccauaugguauauguggcugggggcucgcuaccucgaauucgaggcccugggauuuuugaaugaggaucauugguucuccagggaaaacaguuacagcgguguggagggcgaagggcugcacaaacucggauauauccuucgagacauuucuaagauccccggcggugcaauguacgcugaugacaccgccgggugggacacacggauuacugaggaugaccugcacaaugaagagaaaaucacccagcagauggauccagagcauagacaauuagcuaacgccauauuuaagcugacguaucagaauaaagucgugaagguacagaggccuacacccaccggaacuguuauggacauuaucucccgcaaggaucagcguggcucaggccaaguggggacauacggauugaacaccuucacuaauauggaagcacagcucauccggcagauggagggugaaggcguccugagcaaagcggaccuagagaacccacaccuucccgaaaagaaaauuacccaguggcuggagacaaaggggguggagagacucaaaaggauggccauaucgggagaugacugcguggucaagccuaucgaugaccgcuuugcuaacgcccuguuggcauuaaaugauaugggcaagguucgaaaagacauuccacaauggcagccgucuaaggguuggcaugauuggcagcaggugcccuucuguagucaccacuuccaugaacugaucaugaaagacgggcggaagcucguagugccuugcagaccacaagacgagcuuauuggaagggcucgcaucucccagggcgccggcuggagccugaaagaaacggcaugucuagggaaggccuaugcgcagauguggucacugauguacuuucacagacgggaucucagguuggcuuccaacgccauaugcucugcaguccccgugcauuggguuccuaccagccguacuacauggaguauccacgcccaucaccaauggaugaccacugaggacaugcugacaguguggaaucgagucuggauugaagauaacccauggauggaggacaagacccccgugacgacaugggagaauguaccuuaucuuggaaaacgcgaagaucaguggugugguucccugaucggccucaccagcagagcuacuugggcccagaacauuccgaccgcaauccagcaaguucggucuuuaauugggaaugaggaauuccuggacuacaugccaucaaugaagagguuucgcaaagaggaggaaagugagggagcuauaugguga

SEQ ID NO: 15295 - RNA, 9870 nt, Artificial Sequence
  derived and/or modified CDS sequence (opt3) from DENV-3__HM631856__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucgugaauuggaaagggaaggagcugaagugcggauccggcaucuucgugacaaacgagguccauaccuggacugaacaguacaaauuucaagcagauucucccaagcggcuagccaccgcuauugccggugcaugggagaauggcguuugugggauccgaagcacaacgcgcauggaaaaccuccuguggaaacagauagcuaaugagcuuaacuauaucuugugggaaaauaacauuaagcugaccguggugguaggagacaucauuggcguccucgagcaggggaaaagaacucugacaccacagccuaaggaguuaaaauacucauggaagaccuggggaaaggccaaaaucgugacagcggaaacucaaaacaguuccuucauaauugauggccccaauaccccagagugccccagcguuucuagggccuggaacgugugggaagucgaggacuaugguuuugggguguucacgacaaauaucuggcugaagcuucgggaaguuuacacccaguugugugaccaccgccucaugucagcugcagugaaagaugagagagccguacacgcugacaugggauacuggauugagagucagaagaacggcagcuggaaacuggaaaaggccucccuaaucgaggucaagacuugcaccuggccuaaaucucauacacuguggucgaauggugugcucgaaagcgauaugauaaucccaaagucccuggcaggcccgauuucacagcacaaccauaggcccggguaucacacucaaaccgcgggaccuuggcaccuuggcaaauuggagcuggacuuuaauuacugcgaggggacaacgguggucaucaccgaaaacuguggaacucguggcccaaguuuacggacaaccacuguuucugguaagcucauucaugaguggugcugucgaagcugcacacugcccccucuuagauauaugggggaagauggauguugguacggcauggagaucaggccaauauccgaaaaagaggagaauauggugaagucacugguaagcgccgguucuggcaagguggacaacuucaccaugggggucuugugccucgcuauucuguuugaagaggugaugcgcggaaaauucggcaagaaacacaugaucgccgggguuuucuuuacguucgugcuacugcucuccggacagaucacuuggcgggauauggcacauacccugauuaugaucggcaguaaugcuagcgacagaauggguaugggggucacauaucuugccuugauugcaaccuuuaagauacagcccuuccuggccuuaggauuuuuccucaggaaacugacuucucgcgaaaaccuucugcuaggcgugggccucgcuauggcgacaacccugcaauugccggaggauaucgaacagauggccaaugggauugcacugggauuaauggcucucaagcugaucacacaguuugagacuuaccagcuuuggaccgcccugauuuccuugacguguucaaacacaaucuucacccucacuguugccuggcgaaccgcuacacugauacuagcaggugugagucugcuuccugucugccaaagcucguccaugcggaagacugacuggcucccaauggccguagcggcuaugggcgugcccccucugcccuuguuuaucuucucucugaaagauaccuuaaagcguagaagcuggccacucaaugaggggguuauggccgugggacuggucucaauucuugcaaguucccuguugaggaacgacgugccuauggccggcccccucguagcuggugggcugcuaaucgcauguuaugugauuacgggaacaucugccgaucugaccgucgaaaaagcggcugacaucacuugggaggaagaggccgaacagacaggcguuagccacaaccuuaugauaaccguggacgaugacggcacuaugcgcauuaaggaugacgagacagagaauauccucaccgugcuguugaaaacggcauuacugaucgucuccgggauuuuuccauacucaauaccggccacucuccugguguggcauaccuggcagaagcagacacaacggagcggaguucuuugggauguaccuagucccccagaaacccagaaagcugagcuggaagaggguguguacagaaucaagcagcagggcauuuucgggaagacacaagucggagugggcguucagaaagaggguguguuucacacuauguggcacgucaccaggggggccguguugacguauaacggaaagcgacuagaacccaauugggcaucuguaaaaaaggaccugaucuccuacggcggcggguggcgccucagcgcucaguggcaaaaaggagaggaaguccaggugauugccguugagccugguaagaacccaaagaauuuccagacaaugcccggcacuuuccagaccacaaccggggaaaucggagcgauagcccuggauuuuaaaccuggcacuucggguucaccgaucauuaaccgggaggggaagguggucggacuuuauggcaauggcgugguuaccaaaaacgggggauacgugucugguaucgcacaaacaaaugcugagccagacggccccacgccugaauuagaggaagagauguucagaaagaggaaccugacuauuauggaucuccauccagggaguggaaaaacccguaaguauuugcccgccaucguccgcgaagcuauaaagcggagacugaggacacucauucuggcaccuacccgagugguagccgccgagauggaggaagcucuuaaaggccugccgauccgguaccagacuacagcgaccaaguccgagcacacgggucgcgaaaucguggacuugaugugccaugcaacuuuuacaaugagacuacugagccccguuagggucccaaauuauaaccucauuaucauggaugaggcccacuucaccgacccugcuucuauagccgcacggggguacauuagcacccgagugggaaugggcgaagccgcugcgaucuuuaugacugccacacccccaggcaccgcagaugcuuucccucaguccaaugcccccauucaggacgaggagagagacaucccagaacgcucauggaacagugggaaugaguggauaacagauuuugcaggaaaaacugugugguucgucccgagcauuaaggccgguaacgacaucgcuaacuguuuaaggaaaaauggcaagaagguaauccaacugucucguaaaacguuugauaccgaauaccagaagacaaaacuuaacgacugggauuucgugguuacuaccgacauuuccgagaugggggccaauuuuaaggcggaucgggugaucgacccuagaaggugccugaaacccgucauucucacagauggaccagagcgcgugauauuggcaggccccaugccuguuaccgccgcuucagccgcucagcgaagaggucggguggggaggaacccacagaaggaaaaugaccaauauaucuucacuggccagccccugaacaaugaugaggaccaugcacacuggacggaagccaagaugcuccuggacaacauuaauaccccugagggaaucaucccggcucuuuucgaaccagagcgcgagaaaagugccgcaauugauggcgaauaccgucuaaagggggagagcagaaaaacauuugucgaacugaugcggaggggagacuugcccgugugguuagcgcacaagguagccuccgaggguauaaaauauacugaucgcaaguggugcuucgacggccagcgaaacaaucagauccuggaagagaacauggauguggagauuuggaccaaagaaggggagaagaagaaacucagaccucgguggcuggacgcuaggacauacucugauccccuugcccugaaggaauuuaaagaguucgcagcuggacgcaagucgaucgcccucgacuugguuaccgaaauuggcagagucccaagccaucuggcacacaggacucggaaugcccuagauaaccuggugaugcuccauacaucagagcacggugggcgugcuuaucgccacgcgguggaggaacuuccugagacgauggaaacccuguuauugcugggccucaugauccugcuuacuggaggcgccaugcuguuucucauauccgggaaaggaaucgguaagacaaguauuggcuugaucugugucauugcaucuagcgggaugcuguggauggcugagauccccuuacaauggauagccuccgccauuguucuagaguucuuuaugauggugcugcucaucccagaaccugagaagcagcgaaccccgcaggacaaucaacuugcauacguagugauuggaauccugaccuuggcugccauaaucgcggcuaacgaaaugggccugcucgagacaacuaaaagagaucuggguaugucaaaggaacccggggucgugucuccaacgagcuaucuugacguugaucuccauccugccagugcauggacccuguacgccguggcuacaacugucauuacccccauguugaggcacacaaucgagaauuccaccgcaaacguaagccuggccgcgauugcuaaccaggccgugguuuuaaugggccuagacaaaggauggccaaucucuaagauggaccugggcgugccucuccuugcacuggggugcuacucacaggucaaucccuugacucugacggccgcugugcuccugcuuauaacacauuaugccauuaucggaccgggcuuacaggcaaaagcuacccgggaggcccaaaagcgcacugcggccgguaucaugaagaacccaaccgucgaugggauuaugacaaucgaccuggauccugugauauacgacuccaaauucgaaaagcagcucggacagguuauguugcuggugcuaugugcaguacagcugcuccuuaugagaacuaguugggcucugugcgaggccuugacccuggcaacaggccccauuacgacccucugggaagguagcccaggcaaauuuuggaauacuacaaucgcugugucgauggccaacauuuucagggggucuuaucuggccggagcgggcuuagcuuuuuccaucaugaagagcgucgggaccggaaaacggggcacugguucacaaggggagacacuuggagaaaaguggaagaaaaagcugaaucagcucagucgaaaagauuucgaccuauacaagaaaucuggcauaaccgagguugauagaacggaggcaaaggaaggucugaaacgcggcgagaucacccaccaugccguguccagggggagcgcuaaguugcagugguuugucgaacggaacauggugauucccgagggacguguaaucgaccugggcugugggagaggaggcuggucauauuacugcgccggucucaagaaagugacagaaguuaggggguauacuaagggaggcccuggccacgaggagccggugcccaugaguaccuacggguggaauauugucaaacuuaugagcggaaaggauguguucuaccugccaccugaaaaaugugacacauugcugugcgauaucggugaguccucucccagcccuacugucgaagagucccgcaccauucgggugcucaagaugguugagccaugguuaaagaacaaucaguucuguaucaaaguacugaaccccuauaugccuacagugauagaacaccuugagcgacugcaaagaaagcauggcgggaugcuagucaggaauccacucucacgcaacucuacccacgaaauguacuggauuaguaauggaacuggcaacaucguggcaucgguuaauauggugagccggcuguugcugaacagauuuacgaugacacaucguaggcccaccaucgagaaagacgucgaucucggugccgggacucggcacgugaacgcugaaccggagaccccuaauauggacguaauuggagagcgcauaaagcgaaucaaagaagagcacaacuccacauggcauuaugacgaugaaaauccauacaagacgugggcguaucacggcucuuacgaggugaaggccaccggcucagcaagcuccaugauuaacgggguugucaaacuucugacuaagcccugggacguggugccuauggucacacagauggcuaugaccgauacuacaccauucggacagcaaagaguuuuuaaagaaaagguggacaccaggacaccccggaguaugccggguacucgcagaguaaugggcaucaccgccgagugguuauggaggacgcuggggcgaaauaaaccucgguugugcacccgugaggaauucacaaagaaggugagaacuaacgcagccaugggagcugucuuuaccgaggaaaaucagugggauucugccaaagcggcaguggaggacgaagauuucuggaagcucguugaccgcgagagggagcugcauaaacuaggcaagugugguagcugcguguauaacaugauggggaaacgggaaaagaaacuuggagaguuuggcaaggccaagggcucaagagcuauuugguacauguggcugggggcccgcuaccucgaauucgaggcacugggauuuuugaaugaggaucacugguucuccagggaaaacaguuauagcggugucgagggcgaagggcugcauaaacucggauacauccuucgagacauaucuaagauccccggcggugcuauguaugccgaugacacagcugggugggacacucggauuaccgaggaugaccugcacaaugaagagaaaaucacgcagcagauggauccagagcacagacaauuagccaacgcaauuuuuaagcugacauaccagaauaaagugguaaagguucagaggccuacccccacuggaacagugauggacaucauaucccgcaaggaucagcguggcucaggccaagucgggaccuauggauugaacacuuucaccaauauggaagcgcagcucauucggcagauggagggugaaggcgugcugagcaaagccgaccuagagaacccacaucuucccgaaaagaaaaucacacaguggcuggagacgaaggggguggagagacucaaaaggauggcuaucucgggagaugacugcgucguuaagccuauugaugaccgcuuugccaacgcacuguuggcuuuaaaugauaugggcaaggugcgaaaagacauaccacaauggcagccgucuaaggguuggcacgauuggcagcagguacccuucuguagucaucacuuccacgaacugaucaugaaagacgggcggaagcucguggucccuugcagaccacaagacgagcuuauuggaagggcccgcaucucccagggcgcaggcuggagccugaaagaaaccgccugucuagggaaggcguacgcucagauguggucacugauguauuuucauagacgggaucucagguuggccuccaacgcaauuugcucugccgugcccguucacugggugccuacuagccguacaaccuggaguauccaugcucaccaucaauggaugacuacagaggacaugcugaccgucuggaaucgaguguggauagaagauaacccauggauggaggacaagacgcccguaacaaccugggagaauguuccuuaccuuggaaaacgcgaagaucaguggugugguucccugaucggccucacuagcagagccaccugggcacagaacauuccgacagcuauccagcaagugcggucuuuaauugggaaugaggaauuccuggacuacaugccaucaaugaagagguuucgcaaagaggaggaaagugagggagccaucugguga

SEQ ID NO: 15296 - RNA, 9873 nt, Artificial Sequence
  derived and/or modified CDS sequence (opt3) from DENV-3__HM756276__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucgugaauuggaaagggaaggagcugaagugcggauccggcaucuucgugacaaacgagguccauaccuggacugaacaguacaaauuucaagcagauucucccaagcggcuagccaccgcuauugccggugcaugggagaauggcguuugugggauccgaagcacaacgcgcauggaaaaccuccuguggaaacagauagcuaaugagcuuaacuauaucuugugggaaaauaacauuaagcugaccguggugguaggagacaucauuggcguccucgagcaggggaaaagaacucugacaccacagccuauggaguuaaaguacucauggaaaaccuggggaaaggccaagaucgugacagcggaaacucaaaacaguuccuucauaauugauggccccaauaccccagagugccccagcguuucuagggccuggaacgugugggaagucgaggacuaugguuuugggguguucacgacaaauaucuggcugaaacuucgggaaguuuacacccaguugugugaccaccgccucaugucagcugcagugaaggaugagagagccguacacgcugacaugggauacuggauugagagucagaaaaacggcagcuggaagcuggaaaaagccucccuaaucgaggucaagacuugcaccuggccuaagucucauacacuguggucgaauggugugcucgaaagcgauaugauaaucccaaaaucccuggcaggcccgauuucacagcacaaccauaggcccggguaucacacucaaaccgcgggaccuuggcaccuuggcaaguuggagcuggacuuuaauuacugcgaggggacaacgguggucaucaccgaaaacuguggaacucguggcccaaguuuacggacaaccacuguuucugguaaacucauucaugaguggugcugucgaagcugcacacugcccccucuuagauauaugggggaagauggauguugguacggcauggagaucaggccaauauccgaaaaggaggagaauauggugaaaucacugguaagcgccgguucuggcaagguggacaacuucaccaugggggucuugugccucgcuauucuguuugaagaggugaugcgcggaaaguucggcaaaaagcacaugaucgccgggguuuucuuuacguucgugcuacugcucuccggacagaucacuuggcgggauauggcacauacccugauuaugaucggcaguaaugcuagcgacagaauggguaugggggucacauaucuugccuugauugcaaccuuuaaaauacagcccuuccuggccuuaggauuuuuccucaggaagcugacuucucgcgaaaaccuucugcuaggcgugggccucgcuauggcgacaacccugcaauugccggaggauaucgaacagauggccaaugggauugcacugggauuaauggcucucaaacugaucacacaguuugagacuuaccagcuuuggaccgcccugauuuccuugacguguucaaacacaaucuucacccucacuguugccuggcgaaccgcuacacugauacuagcaggugugagucugcuuccugucugccaaagcucguccaugcggaagacugacuggcucccaauggccguagcggcuaugggcgugcccccucugcccuuguuuaucuucucucugaaggauaccuuaaaacguagaagcuggccacucaaugaggggguuauggccgugggacuggucucaauucuugcaaguucccuguugaggaacgacgugccuauggccggcccccucguagcuggugggcugcuaaucgcauguuaugugauuacgggaacaucugccgaucugaccgucgaaaaggcggcugacaucacuugggaggaagaggccgaacagacaggcguuagccacaaccuuaugauaaccguggacgaugacggcacuaugcgcauuaaagaugacgagacagagaauauccucaccgugcuguugaagacggcauuacugaucgucuccgggauuuuuccauacucaauaccggccacucuccugguguggcauaccuggcagaaacagacacaacggagcggaguucuuugggauguaccuagucccccagaaacccagaaggcugagcuggaagaggguguguacagaaucaaacagcagggcauuuucgggaagacacaagucggagugggcguucagaaggaggguguguuucacacuauguggcacgucaccaggggggccguguugacguauaacggaaaacgacuagaacccaauugggcaucuguaaagaaagaccugaucuccuacggcggcggguggcgccucagcgcucaguggcaaaagggagaggaaguccaggugauugccguugagccugguaaaaacccaaagaauuuccagacaaugcccggcacuuuccagaccacaaccggggaaaucggagcgauagcccuggauuuuaagccuggcacuucggguucaccgaucauuaaccgggaggggaaaguggucggacuuuauggcaauggcgugguuaccaagaacgggggauacgugucugguaucgcacaaacaaaugcugagccagacggccccacgccugaauuagaggaagagauguucaaaaagagaaaccugacuauuauggaucuccauccagggaguggaaaaaccaggaaguauuugcccgccaucguccgugaagcuauaaagcgccggcugagaacacucauucuggcaccuaccagggugguagccgccgagauggaggaagcucuuaaaggccugccgauccgauaccagacuacagcgaccaaguccgagcacacgggucgggaaaucguggacuugaugugccaugcaacuuuuacaaugcgccuacugagccccguuagagucccaaauuauaaccucauuaucauggaugaggcccacuucaccgacccugcuucuauagccgcaaggggguacauuagcacccgggugggaaugggcgaagccgcugcgaucuuuaugacugccacacccccaggcaccgcagaugcuuucccucaguccaaugcccccauucaggacgaggagcgagacaucccagaaagaucauggaacagugggaaugaguggauaacagauuuugcaggaaaaacugugugguucgucccgagcauuaaggccgguaacgacaucgcuaacuguuuacgcaaaaauggcaagaagguaauccaacugucuaggaaaacguuugauaccgaauaccagaagacaaaacuuaacgacugggauuucgugguuacuaccgacauuuccgagaugggggccaauuuuaaggcggaucgugugaucgacccucggagaugccugaaacccgucauucucacagauggaccagagagggugauauuggcaggccccaugccuguuaccgccgcuucagccgcucagcgccgagguagaguggggcggaacccacagaaggaaaaugaccaauauaucuucacuggccagccccugaacaaugaugaggaccaugcacacuggacggaagccaagaugcuccuggacaacauuaauaccccugagggaaucaucccggcucuuuucgaaccagagagggagaaaagugccgcaauugauggcgaauaccgccuaaagggggagagccguaaaacauuugucgaacugaugagacggggagacuugcccgugugguuagcgcacaagguagccuccgaggguauaaaauauacugauaggaaguggugcuucgacggccagcgcaacaaucagauccuggaagagaacauggauguggagauuuggaccaaagaaggggagaagaagaaacuccgaccuagauggcuggacgcucggacauacucugauccccuugcccugaaggaauuuaaagaguucgcagcuggaaggaagucgaucgcccucgacuugguuaccgaaauuggccgcgucccaagccaucuggcacacagaacuaggaaugcccuagauaaccuggugaugcuccauacaucagagcacggugggcgggcuuaucgucacgcgguggaggaacuuccugagacgauggaaacccuguuauugcugggccucaugauccugcuuacuggaggcgccaugcuguuucucauauccgggaaaggaaucgguaagacaaguauuggcuugaucugugucauugcaucuagcgggaugcuguggauggcugagauccccuuacaauggauagccuccgccauuguucuagaguucuuuaugauggugcugcucaucccagaaccugagaagcagcgcaccccgcaggacaaucaacuugcauacguagugauuggaauccugaccuuggcugccauaaucgcggcuaacgaaaugggccugcucgagacaacuaaacgagaucuggguaugucaaaggaacccggggucgugucuccaacgagcuaucuugacguugaucuccauccugccagugcauggacccuguacgccguggcuacaacugucauuacccccauguugagacacacaaucgagaauuccaccgcaaacguaagccuggccgcgauugcuaaccaggccgugguuuuaaugggccuagacaaaggauggccaaucucuaagauggaccugggcgugccucuccuugcacuggggugcuacucacaggucaaucccuugacucugacggccgcugugcuccugcuuauaacacauuaugccauuaucggaccgggcuuacaggcaaaagcuaccagggaggcccaaaagcggacugcggccgguaucaugaagaacccaaccgucgaugggauuaugacaaucgaccuggauccugugauauacgacuccaaauucgaaaagcagcucggacagguuauguugcuggugcuaugugcaguacagcugcuccuuaugcgcacuaguugggcucugugcgaggccuugacccuggcaacaggccccauuacgacccucugggaagguagcccaggcaaauuuuggaauacuacaaucgcugugucgauggccaacauuuucagagggucuuaucuggccggagcgggcuuagcuuuuuccaucaugaagagcgucgggaccggaaaaaggggcacugguucacaaggggagacacuuggagaaaaguggaagaaaaagcugaaucagcucagucggaaagauuucgaccuauacaagaaaucuggcauaaccgagguugaucgaacggaggcaaaggaaggucugaaaagaggcgagaucacccaccaugccgugucccgcgggagcgcuaaguugcagugguuugucgaaaggaacauggugauucccgagggacggguaaucgaccugggcugugggcguggaggcuggucauauuacugcgccggucucaagaaagugacagaaguuagaggguauacuaagggaggcccuggccacgaggagccggugcccaugaguaccuacggguggaauauugucaaacuuaugagcggaaaggauguguucuaccugccaccugaaaaaugugacacauugcugugcgauaucggugaguccucucccagcccuacugucgaagaguccaggaccauucgcgugcucaagaugguugagccaugguuaaagaacaaucaguucuguaucaaaguacugaaccccuauaugccuacagugauagaacaccuugagcggcugcaacgaaagcauggcgggaugcuagucagaaauccacucucaaggaacucuacccacgaaauguacuggauuaguaauggaacuggcaacaucguggcaucgguuaauauggugagccgccuguugcugaaccgguuuacgaugacacauagacgucccaccaucgagaaagacgucgaucucggugccgggacuaggcacgugaacgcugaaccggagaccccuaauauggacguaauuggagagcggauaaagcgcaucaaagaagagcacaacuccacauggcauuaugacgaugaaaauccauacaagacgugggcguaucacggcucuuacgaggugaaggccaccggcucagcaagcuccaugauuaacgggguugucaaacuucugacuaagcccugggacguggugccuauggucacacagauggcuaugaccgauacuacaccauucggacagcaacgaguuuuuaaagaaaagguggacaccagaacacccaggaguaugccggguacucggcgcguaaugggcaucaccgccgagugguuauggagaacgcuggggaggaauaaaaagccucgauugugcacccgggaggaauucacaaagaaagugcguacuaacgcagccaugggagcugucuuuaccgaggaaaaucagugggauucugccaaggcggcaguggaggacgaagauuucuggaaacucguugacagagagcgcgagcugcauaagcuaggcaaaugugguagcugcguguauaacaugauggggaagagggaaaaaaagcuuggagaguuuggcaaggccaaaggcucacgggcuauuugguacauguggcugggggccagauaccucgaauucgaggcacugggauuuuugaaugaggaucacugguucucccgcgaaaacaguuauagcggugucgagggcgaagggcugcauaagcucggauacauccuuagggacauaucuaaaauccccggcggugcuauguaugccgaugacacagcugggugggacacucgaauuaccgaggaugaccugcacaaugaagagaagaucacgcagcagauggauccagagcaccggcaauuagccaacgcaauuuuuaaacugacauaccagaauaaggugguaaagguucagagaccuacccccacuggaacagugauggacaucauauccaggaaagaucagcgcggcucaggccaagucgggaccuauggauugaacacuuucaccaauauggaagcgcagcucauucgucagauggagggugaaggcgugcugagcaaggccgaccuagagaacccacaucuucccgaaaaaaagaucacacaguggcuggagacgaaagggguggagcggcucaagagaauggcuaucucgggagaugacugcgucguuaagccuauugaugacagguuugccaacgcacuguuggcuuuaaaugauaugggcaaagugcgcaaggacauaccacaauggcagccgucuaaagguuggcacgauuggcagcagguacccuucuguagucaucacuuccacgaacugaucaugaaggacgggcgaaaacucguggucccuugccggccacaagacgagcuuauuggaagagccaggaucucccagggcgcaggcuggagccugaaggaaaccgccugucuagggaaggcguacgcucagauguggucacugauguauuuucaucgcagagaucuccgguuggccuccaacgcaauuugcucugccgugcccguucacugggugccuacuagcaggacaaccuggaguauccaugcucaccaucaauggaugacuacagaggacaugcugaccgucuggaaucguguguggauagaagauaacccauggauggaggacaaaacgcccguaacaaccugggagaauguuccuuaccuuggaaagcgagaagaucaguggugugguucccugaucggccucacuagccgcgccaccugggcacagaacauuccgacagcuauccagcaagugagaucuuuaauugggaaugaggaauuccuggacuacaugccaucaaugaaacgguuuaggaaggaggaggaaagugagggagccaucugguga

SEQ ID NO: 15297 - RNA, 9873 nt, Artificial Sequence
  derived and/or modified CDS sequence (opt3) from DENV-3__HM756279__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauacugucaucggaaucggcgauaacgccuugaaaauuaauugguauaagaaggggagcaguaucggaaaaauguuugaagcuaccgcccgcggugcaagaaggauggccauucugggcgacacggcuugggauuucgggucugugggaggcguucucaacucccuggguaagauggugcaccagauauuugggagcgccuacacagcacuuuucucgggcgucucuugggugaugaaaaucggaauuggcguacuguugaccuggaucgggcucaauuccaagaacacuucaaugaguuuuagcugcaucgcgauuggaauaaucacacuguauuuaggcgcugugguucaggccgacauggguugugucauuaauuggaaagggaaggagcugaagugcggauccggcaucuucgugaccaacgaggugcauacuuggaccgaacaguacaaauuucaagcagauucucccaagcggcuagccacagcuauugccggugcaugggagaauggcgucugugggauccgaagcacgacccgcauggaaaaccuccuguggaaacagauagcuaaugagcuuaacuauaucuugugggaaaauaacauuaagcugacuguuguggugggagacaucauuggcguacucgagcaggggaaaagaacacugaccccacagccuauggaguuaaaguacucauggaaaacauggggaaaggccaagaucgucacugcggaaacccaaaacaguuccuucauaauugauggccccaauacgccagagugccccagcgugucuagggccuggaacguuugggaaguggaggacuaugguuuuggggucuucacaaccaauaucuggcugaaacuucgggaaguguacacucaguugugugaccaccgccucaugucagcugcaguuaaggaugagagagccgugcacgcugacaugggauacuggauugagagucagaaaaacggcagcuggaagcuggaaaaagccucccuaaucgagguaaagaccugcacauggccuaagucucauacucuguggucgaaugguguccucgaaagcgauaugauaaucccaaaaucccuggcaggcccgauuucacagcacaaccauaggcccggguaucacacccaaacagcgggaccuuggcaccuuggcaaguuggagcuggacuuuaauuacugcgaggggacgaccguggugaucacugaaaacuguggaacacguggcccaaguuuacggaccacuacagucucugguaaacucauucaugaguggugcugucgaagcugcacccugcccccucuuagauauaugggggaagauggauguugguacggcauggagaucaggccaauauccgaaaaggaggagaauaugguuaaaucacuggugagcgccgguucuggcaagguagacaacuucacgauggggguguugugccucgcuauucuguuugaagaggucaugcgcggaaaguucggcaaaaagcacaugaucgccgggguguucuuuacuuucguucuacugcucuccggacagaucaccuggcgggauauggcacauacacugauuaugaucggcaguaaugcuagcgacagaauggguaugggggugaccuaucuugccuugauugcaacuuuuaaaauacagcccuuccuggccuuaggauuuuuccucaggaagcugacaucucgcgaaaaccuucugcuaggcgucggccucgcuauggcgaccacacugcaauugccggaggauaucgaacagauggccaaugggauugcacugggauuaauggcucucaaacugaucacucaguuugagaccuaccagcuuuggacggcccugauuuccuugacauguucaaacaccaucuucacucucaccguggccuggcgaacagcuacucugauacuagcagguguuagucugcuuccugugugccaaagcucguccaugcggaagaccgacuggcucccaauggccgucgcggcuaugggcguacccccucugcccuuguuuaucuucgggcugaaggauacguuaaaacguagaucuuggccacucaaugagggagugauggccguuggccuggugagcauucuugcaucaagucuguugaggaacgacgucccuauggccgguccccucguggcugggggacugcuaaucgcauguuauguaauuacaggcaccuccgccgaucugacuguggaaaaggcggcugacaucacaugggaggaagaggccgaacagaccggcgucucucacaaccuuaugauaacuguugacgaugacgggacaaugcgcauuaaagaugacgagaccgagaauauccucacggugcuguugaagacugcauuacugaucgugagcggaauuuuuccauacuccauaccggccacccuccuggucuggcauacauggcagaaacagacccaacggucaggugugcuuugggauguuccuagccccccagaaacacagaaggcugagcuggaagagggcguauacagaaucaaacagcaggggaacuucugggagacucaagugggagucggcgugcagaaggaagguguuuuucacaccauguggcacgugacgaggggggccgucuugacauauaauggaaagcgacuagagcccaacugggcaagugugaaaaaggaccugauuucuuacggcggcggguggcgccucuccgcucaguggcaaaaaggagaagagguacaggucaucgccguggaaccugguaagaauccaaaaaacuuccagacuaugcccggcaccuuccagacaaccacuggggagauuggagcgaucgcccuggauuuuaagccuggcaccagcgguucgccgauaaucaaucgggaggggaagguugugggacuuuauggcaacggcgucgugacaaaaaaugggggauacguuucagguauugcacaaacgaacgcugaaccagacggccccacuccugaguuagaagaggaaauguucaagaaaagaaaucugaccaucauggaucuccauccagggucuggaaagacaaggaaauauuugcccgccauugugcgugaggcuaucaagcgccggcugagaacccucauacuggcaccuacuagggucguggccgccgagauggaagaggcucuuaagggccugccgauucgauaccagacaaccgcgacgaaaagugaacacacuggucgggagaucguagacuugaugugccaugcaacauuuaccaugcgccuacugucccccgugagaguuccaaacuauaaucucaucauuauggaugaagcccacuucaccgacccugcuagcaucgccgcaaggggguacauaucuacucgggucggaaugggcgaggccgcugcgauuuuuaugacagccacccccccaggcacagcagaugcuuucccucagagcaacgcccccauccaggacgaggaacgagacauuccagagagauccuggaauucagggaacgaauggaucacugauuuugcaggaaagacggugugguucgugccgaguauaaaagccgguaacgacauugcuaauuguuuacgcaagaacggcaaaaaggucauccaacugagcaggaagaccuuugauacagaguaccagaaaacuaagcuuaaugacugggauuucguagugaccacagacaucucugagaugggggccaacuuuaaagcggaucguguuauugacccucggagaugccugaagcccgugauccucaccgauggaccagaaagggucauuuuggcaggccccaugccugugacugccgcuuccgccgcucagcgccgagguagaguugggcggaauccacagaaagagaacgaccaauauauauucacgggccagccccugaauaacgaugaagaccaugcacacuggaccgaggccaagaugcuccuggacaauaucaacacaccugaaggaauuaucccggcucuuuucgagccagagagggaaaagucagccgcaaucgauggcgaguaccgccuaaaaggggaaagucguaagacuuuuguggagcugaugagacggggagacuugaccgucugguuagcgcacaaaguggccagcgaagguauuaaguauacagauaggaaauggugcuucgacggccagcgcaauaaccagauacuggaggagaauauggauguagaaaucuggaccaaggagggggaaaaaaagaagcuccgacccagauggcuggacgcucggacuuacuccgauccucuugcccugaaagaguuuaaggaauucgcagcuggaaggaaaucuauugcccucgacuuggugacagagaucggccgcguucccucgcaucuggcacacagaacgaggaacgcccuagauaaucuggucaugcuccauaccagcgagcacggugggcgggcuuaucgucacgcgguggaagagcuuccagaaacuauggagacacuguuauugcugggccucaugauucugcuuaccggaggcgccaugcuguuucucaucucagggaagggaauagguaaaaccuccaucggcuugauuugugugaucgcaaguucugggaugcuguggauggcugagauuccuuuacaauggaucgccagcgccauaguccuagaauucuuuaugaugguucugcucauucccgagccagaaaagcagcgcacaccucaggacaaccaacuugcauacgugguaaucggaauucugacuuuggcugccaucauagcggcuaaugagaugggccugcucgaaacgaccaagcgagaucuggguauguccaaagagccggggguggucucacccacaucuuaucuugacguggaucuccauccagccagcgcauggacucuguacgccguugcuaccacagugaucaccccuauguugagacacacuauugagaacaguacggcaaacgucucccuggccgcgaucgcuaaucaggccguaguguuaaugggccuagacaagggauggcccauuagcaaaauggaccugggcguuccacuccuugcacuggggugcuacucucaggugaacccuuugacacugaccgccgcuguccuccugcuuaucacucauuaugccauaauuggacccggcuuacaggcaaaggcuaccagggaagcccaaaaacggacagcggccgguaucaugaagaauccgacuguggaugggaucaugaccauugaccuggauccagucaucuacgacucaaaguucgagaaacagcucggacaggugauguugcugguucuaugugcagugcagcugcuccuuaugcgcacauccugggcucugugcgaagccuugacgcuggcaaccggcccuauaacuacacucugggaggguagucccggcaaguuuuggaacaccacuauugcuguaagcauggccaauaucuucagagggucguaucuggccggagcgggcuuagcuuuuucuauuaugaaauccguggggacaggaaagaggggcaccgguagccaaggggaaacgcuuggagagaaauggaagaagaaacugaaccagcucucacggaaggauuucgaccuauacaaaaagaguggcaucaccgaggucgaucgaacagaagcaaaagagggucugaagagaggcgaaauaacucaccaugccguuucucgcggguccgcuaaauugcagugguuuguggagaggaauauggucaucccagaaggacgggugauugaccugggcugugggcguggaggcuggagcuauuacugcgccggucucaagaagguaaccgaggugagaggguauacaaaaggaggccccggccacgaggaaccuguuccgaugucaacuuacggguggaacaucgugaagcuuaugaguggaaaagaugucuucuaccugcccccagagaagugugacaccuugcugugcgauauuggugaaagcuccccuucucccacaguggaggagagcaggaccauccgcguccucaaaaugguggaaccuugguuaaagaauaaccaguucuguauuaagguucugaauccauauaugcccacuguaaucgagcaccuugaacggcugcaacgaaaacauggcgggaugcuagugagaaacccucucuccaggaauucaacgcacgagauguacuggauaucuaacggaacaggcaauauugucgcaagugugaacaugguuucgcgccuguugcugaaccgguuuaccaugacucauagacguccaaccaucgaaaaggacguggaucucggugccgggacaaggcacgucaaugcugagcccgagacgccgaacauggacgugaucggagaacggauuaaacgcauaaaggaggaacacaauagcaccuggcauuaugacgaugagaacccuuacaaaacuugggcguaucacggcuccuacgaaguaaaggccacaggcucugcaucaagcaugaucaauggggugguuaagcuucugaccaaaccaugggacgucgugcccauggugacucagauggcuaugacagauaccacaccuuucggacagcaacgagucuuuaaggagaaaguugacacuagaaccccaagguccaugcccgguacgcggcgcgugaugggcauuaccgccgagugguuauggagaacacuggggaggaacaagaaaccgcgauugugcacucgggaagaguucaccaagaagguacguacaaaugcagccaugggagcuguguuuacugaagagaaccagugggauagugccaaagcggcagucgaagacgaggauuucuggaagcucguggacagagagcgcgaacugcauaaacuaggcaagugugguucuugcguuuauaauaugauggggaaaagggagaagaaacuuggagaauuuggcaaggccaagggcagccgggcuaucugguacauguggcugggggccagauaccucgaguucgaggcacugggauuuuugaacgaagaucacugguucucacgcgagaauuccuauagugguguggaaggcgaggggcugcauaaacucggauacauucuuagggacaucagcaagauaccuggcggugcuauguaugccgaugacaccgcugggugggacacgcgaaucacagaagaugaccugcacaacgaggagaaaauuacccagcagauggaucccgaacaccggcaauuagccaaugcaaucuuuaagcugacuuaccagaacaaagucgugaagguacagagaccaacaccuaccggaacuguuauggacauuaucucuaggaaggaucagcgcggcuccggccaaguggggaccuauggauugaauacauucacgaacauggaggcgcagcucauacgucagauggaaggugagggcguccugucaaaagccgaccuagaaaacccccaucuuccagagaagaaaauuacccaguggcuggagacuaaggggguggaacggcucaaaagaauggcuaucagcggagaugacugcguggucaagcccaucgaugacagguuugccaaugcacuguuggcuuuaaacgauaugggcaagguucgcaaagacauuccucaauggcagccaucgaaggguuggcacgauuggcagcaggugccguucuguucucaucacuuccacgagcugauaaugaaagacgggcgaaagcucguagugcccugccggccucaagacgaacuuaucggaagagccaggauuagucagggcgcaggcuggucccugaaagagacagccugucuagggaaggcguacgcucagauguggagccugauguauuuucaucgcagagaucuccgguuggccucaaaugcaaucugcuccgccgucccagugcacuggguucccaccucuaggacuacauggagcauucaugcucaccaucaauggaugaccacggaagacaugcugacaguguggaaccgugucuggaucgaggauaauccuuggauggaggacaagaccccagugacuaccugggaaaacguacccuaccuuggaaaacgagaggaucaguggugugguagucugauaggccucacaucccgcgccacuugggcacagaauaucccuaccgcuauucagcaaguuagaagcuuaaucgggaacgaagaguuccuggacuacaugccgucuaugaagcgguuuaggaaagaggaagagucagaaggagccauuugguga

SEQ ID NO: 15298 - RNA, 9873 nt, Artificial Sequence
  derived and/or modified CDS sequence (opt3) from DENV-3__HQ891025__SS-prME
accagccugugccucaugaugauccuucccgcagcucuggcauuccacuugacauccagagacggcgaaccuagaaugauuguggggaagaacgaacgggguaaaucuuuacuguuuaagacugccucagguauaaauauguguacgcuaaucgcgauggaucucggcgaaaugugcgacgauaccgucacauacaaauguccacauauuacugaaguugaaccggaagacaucgauugcugguguaaccugaccaguacaugggugaccuaugggacuugcaaucaggcuggagaacaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucaaaauucagggggaacaagcauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacuaagaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauaugggggaagauggauguugguacggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcacaugaucgccgggguguucuuuacguucguucuacugcucuccggacagauuacuuggcgggauauggcacauacccugaucaugauuggcaguaaugcuagcgacagaauggguaugggggugacauaucuugccuugauagcaaccuuuaaaauccagcccuuccuggccuuaggauuuuuccucaggaagcugacuucucgcgaaaaccuucugcuaggcgucggccucgcuauggcgacaacccugcaauugccggaggauauugaacagauggccaaugggaucgcacugggauuaauggcucucaaacugauuacacaguuugagacuuaccagcuuuggaccgcccugaucuccuugacguguucaaacacaauauucacccucacuguggccuggcgaaccgcuacacugauccuagccgguguuagucugcuuccugugugccaaagcucguccaugcggaagacugacuggcucccaauggccgucgcggcuaugggcguacccccucugcccuuguuuauuuucgggcugaaggauaccuuaaaacguagaucuuggccacucaaugagggagugauggccguuggccuggugagcauccuugcaucaagucuguugaggaacgacgucccuauggccgguccccucguggcugggggacugcuaauugcauguuauguaaucacgggcacauccgccgaucugaccguggaaaaggcggcugacauaacuugggaggaagaggccgaacagacaggcgucucucacaaccuuaugauuaccguugacgaugacgggacuaugcgcaucaaagaugacgagacagagaauauccucaccgugcuguugaagacggcauuacugauugugagcggaauauuuccauacuccaucccggccacucuccuggucuggcauaccuggcagaaacagacacaacggucaggugugcuuugggauguuccuagucccccagaaacccagaaggcugagcuggaagagggcguauacagaauuaaacagcaggggaucuucggaaagacacaagugggcgucggugugcagaaggaggggguuuuucacacuauguggcacgugaccaggggagccgucuugacguauaacggcaaacgacuagaacccaauugggcaagugugaagaaagaccugauuucuuacggcgggggauggcgccucuccgcucaguggcaaaagggugaggaaguacaggucaucgccguggagccuggcaaaaacccaaagaauuuccagacaaugcccgggacuuuccagaccacaaccggagaaauaggcgcgaucgcccuggauuuuaagccugguacuagcgggucgccgauuaucaaccgggagggaaaaguugugggccuuuauggcaauggggucgugaccaagaacggagguuacguuucaggcauugcacaaacaaaugcugagccagacgggcccacgccugaauuagaggaagagauguucaaaaagagaaaccugacuaucauggaucuccauccaggaucuggcaaaaccaggaaguauuugcccgccauagugcgugaagcuauuaagcgccggcugagaacacucauccuggcaccuaccagggucguggccgccgagauggaggaagcucuuaaaggucugccgauccgauaccagacuacagcgaccaagagugagcacacggggcgggaaauuguagacuugaugugccaugcaacuuuuacaaugcgccuacugucccccgugagaguuccaaauuauaaccucaucauaauggaugaggcccacuucaccgacccugcuagcauugccgcaaggggauacaucucuacccgggucggcaugggcgaagccgcugcgauuuuuaugacugccacacccccagggaccgcagaugcuuucccucagagcaaugcccccauccaggacgaggagcgagacauaccagaaagauccuggaacucaggaaaugaguggauuacagauuuugcagguaaaacugugugguucgugccgaguaucaaggccggcaacgacaucgcuaacuguuuacgcaaaaaugggaagaaggucauucaacugagcaggaaaacguuugauaccgaauaccagaagacaaaacuuaacgacugggauuucguagugacuaccgacaucucugagaugggagccaauuuuaaggcggaucguguuauugacccucggagaugccugaaacccgugauacucacagauggcccagagagggucaucuuggcaggucccaugccugugaccgccgcuuccgccgcucagcgccgagggagaguuggccggaacccacagaaggaaaaugaccaauauauuuucacuggacagccccugaacaaugaugaggaccaugcacacuggacggaagccaagaugcuccuggacaacaucaauaccccugagggcaucauuccggcucuuuucgaaccagagagggagaaaucagccgcaauagauggggaauaccgccuaaagggagagagucguaaaacauuuguggaacugaugagacggggugacuugcccgucugguuagcgcacaagguggccagcgagggcaucaaauauacugauaggaaguggugcuucgacgggcagcgcaacaaucagauucuggaagagaacauggauguagagaucuggaccaaagaaggagagaagaagaaacuccgaccuagauggcuggacgcucggacauacuccgauccccuugcccugaaggaauuuaaagaguucgcagcuggcaggaagucuauugcccucgacuuggugaccgaaaucggucgcguuccaucgcaucuggcacacagaacuaggaaugcccuagauaaccuggucaugcuccauacaagcgagcacgggggccgggcuuaucgucacgcgguggaggaacuuccugagacgauggaaacccuguuauugcugggacucaugauacugcuuacuggcggggccaugcuguuucucaucucaggaaaagguauuggcaagacauccaucggguugauuugugugaucgcaaguucuggaaugcuguggauggcugagauacccuuacaauggauugccagcgccaucguccuagaguucuuuaugaugguucugcucauuccagaaccugagaagcagcgcaccccgcaggacaaucaacuugcauacgugguaaucggcauacugaccuuggcugccaucauugcggcuaacgaaaugggucugcucgagacaacuaaacgagaucuggggauguccaaggaacccggcguggucucaccaacgucuuaucuugacguggaucuccauccugccagcgcauggacccuguacgccguugcuacaacugugaucacccccauguugagacacacaauugagaauaguaccgcaaacgucucccuggccgcgaucgcuaaccaggccguaguguuaaugggacuagacaaaggcuggccaauaagcaagauggaccuggggguuccucuccuugcacugggaugcuacucucaggugaaucccuugacucugacggccgcuguccuccugcuuauuacacauuaugccaucaucggcccggguuuacaggcaaaagcuaccagggaggcccaaaagcggacugcggccgggauuaugaagaacccaaccguggauggaaucaugacaauagaccuggauccugucauuuacgacucaaaauucgaaaagcagcucggccaggugauguugcugguucuaugugcagugcagcugcuccuuaugcgcacuuccugggcucugugcgaggccuugacccuggcaacaggucccaucacgacccucugggaaggcaguccagggaaauuuuggaauacuacaauugcuguaagcauggccaacaucuucagaggaucguaucuggccggcgcgggguuagcuuuuucuauaaugaaguccgugggaaccggcaaaagggguacugggagccaaggagagacacuuggcgaaaaguggaagaaaaagcugaaucagcucucacggaaagauuucgaccuauacaagaaaagugguaucaccgaggucgaucgaacggaggcaaaggaaggccugaaaagaggggagauuacccaccaugccguuucucgcggauccgcuaaguugcagugguuuguggaaaggaacauggucauccccgagggccgggugauugaccugggguguggacguggcgguuggagcuauuacugcgccgggcucaagaaaguaacagaagugagaggauauacuaagggcggcccugggcacgaggagccgguucccaugucaaccuacggauggaauaucgugaaacuuaugagugguaaggaugucuucuaccugccaccugaaaaaugugacacauugcugugcgauauuggcgagagcucccccucuccuacuguggaagagagcaggaccauccgcguccucaagaugguggagccaugguuaaagaacaaucaguucuguauaaaaguucugaaccccuauaugccuacaguaauugaacaccuugagcggcugcaacgaaagcaugggggaaugcuagugagaaauccacucuccaggaacucaacccacgaaauguacuggaucucuaauggcacugguaacaucgucgcaagugugaauaugguuucgcgccuguugcugaaccgguuuacgaugacacauagacgucccaccauugagaaagacguggaucucggggccggaacuaggcacgucaacgcugaaccggagaccccuaauauggacgugauaggcgagcggaucaagcgcauuaaagaagaacacaacagcacauggcauuaugacgaugaaaauccauacaagacgugggcguaucacggcuccuacgagguaaaggccaccgggucugcaucaagcaugaucaacggagugguuaaacuucugacuaagcccugggacgucgugccuauggugacacagauggcuaugaccgauacuacaccauucggucagcaacgagucuuuaaagaaaagguugacaccagaacacccagguccaugccgggcacucggcgcgugauggggauuaccgccgagugguuauggagaacgcugggaaggaauaaaaagccucgauugugcacccgggaggaguucacaaagaaaguacguacuaacgcagccaugggcgcuguguuuaccgaggaaaaucagugggauagugccaaggcggcagucgaggacgaagauuucuggaaacucguggacagagagcgcgagcugcauaagcuagguaaaugugggucuugcguuuauaacaugaugggaaagagggagaagaaacuuggcgaguuuggcaaagccaaagggagccgggcuaucugguacauguggcugggagccagauaccucgaguucgaggcacugggauuuuugaaugaggaucacugguucucacgcgaaaacuccuauaguggcguggagggggaaggacugcauaagcucggcuacauacuuagggacaucagcaaaauucccgguggggcuauguaugccgaugacacagcuggaugggacacucgaaucaccgaggaugaccugcacaaugaagagaagauuacgcagcagauggauccagagcaccggcaauuagccaacgcaaucuuuaaacugacauaccagaauaaggucgugaagguacagagaccuacccccacuggcacaguuauggacauaauuucuaggaaagaucagcgcggcuccgggcaagugggaaccuaugguuugaacacuuucaccaauauggaagcgcagcucauccgucagauggagggcgaagggguccugucaaaggccgaccuagagaacccacaucuucccgagaaaaagaucacacaguggcuggagacgaaaggaguggagcggcucaagagaauggcuauuagcggcgaugacugcguggucaagccuauagaugacagguuugccaacgcacuguuggcuuuaaaugauauggguaaaguucgcaaggacaucccacaauggcagccgucgaaaggguggcacgauuggcaacaggugcccuucuguucucaucacuuccacgaacugauuaugaaggacggacgaaaacucguagugccuugccggccacaagacgagcuuaucggcagagccaggauuagucagggcgcaggguggucccugaaggaaaccgccugucuaggaaaggcguacgcucagauguggagccugaugaacuuucaucgcagagaucuccgguuggccucaaaugcaaucugcuccgccguccccgugcacuggguuccuacuucuaggacaaccuggagcauacaugcucaccaucaauggaugacuacagaggacaugcugaccguguggaaccgugucuggaucgaagauaauccauggauggaggacaaaacgcccgugacaaccugggagaacguaccuuaucuugguaagcgagaagaucagugguguggcagucugauugggcucacuucccgcgccaccugggcacagaauaucccgacagcuauucagcaaguuaggagcuuaaucggaaacgaggaguuccuggacuacaugccaucuaugaaacgguuuaggaaggaggaggaaucagagggcgccauuugguga

SEQ ID NO: 15299 - RNA, 9873 nt, Artificial Sequence
  derived and/or modified CDS sequence (opt3) from DENV-3__HQ705617__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauaugggggaagauggauguugguacggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcacaugaucgccgggguguucuuuacguucguucuacugcucuccggacagauuacuuggcgggauauggcacauacccugaucaugauuggcaguaaugcuagcgacagaauggguaugggggugacauaucuugccuugauagcaaccuuuaggauccagcccuuccuggccuuaggauuuuuccuccgcaaacugacuucucgagaaaaccuucugcuaggcgucggccucgcuauggcgacaacccugcaauugccggaggauauugaacagauggccaaugggaucgcacugggauuaauggcucucaagcugauuacacaguuugagacuuaccagcuuuggaccgcccugaucuccuugacguguucaaacacaauauucacccucacuguggccuggcggaccgcuacacugauccuagcagguguuagucugcuuccugugugccaaagcucguccaugcguaaaacugacuggcucccaauggccgucgcggcuaugggcguacccccucugcccuuguuuauuuucgggcugaaggauaccuuaaagagaaggucuuggccacucaaugagggagugauggccguuggccuggugagcauccuugcaucaagucuguugcgcaacgacgucccuauggccgguccccucguggcugggggacugcuaauugcauguuauguaaucacgggcacauccgccgaucugaccguggaaaaagcggcugacauaacuugggaggaagaggccgaacagacaggcgucucucacaaccuuaugauuaccguugacgaugacgggacuaugcggaucaaggaugacgagacagagaauauccucaccgugcuguugaaaacggcauuacugauugugagcggaauauuuccauacuccaucccggccacucuccuggucuggcauaccuggcagaagcagacacaaagaucaggugugcuuugggauguuccuagccccccagaaacccagaaagcugagcuggaagagggcguauacaggauuaagcagcaggggaucuucggaaaaacacaagugggcgucggugugcagaaggaggggguuuuucacacuauguggcacgugacccgaggagccgucuugacguauaacggcaagcgccuagaacccaauugggcaagugugaaaaaggaccugauuucuuacggcgggggauggcggcucuccgcucaguggcaaaaaggugaggaaguacaggucaucgccguggagccuggcaagaacccaaaaaauuuccagacaaugcccgggacuuuccagaccacaaccggagaaauaggcgcgaucgcccuggauuuuaagccugguacuagcgggucgccgauuaucaacagagagggaaagguugugggccuuuauggcaauggggucgugaccaaaaacggagguuacguuucaggcauugcacaaacaaaugcugagccagacgggcccacgccugaauuagaggaagagauguucaagaaaaggaaccugacuaucauggaucuccauccaggaucuggcaagacccguaaauauuugcccgccauagugcgcgaagcuauuaagcggagacugaggacacucauccuggcaccuacccgagucguggccgccgagauggaggaagcucuuaagggucugccgauccgguaccagacuacagcgaccaaaagugagcacacggggcgcgaaauuguagacuugaugugccaugcaacuuuuacaaugagacuacugucccccgugaggguuccaaauuauaaccucaucauaauggaugaggcccacuucaccgacccugcuagcauugccgcacggggauacaucucuacccgagucggcaugggcgaagccgcugcgauuuuuaugacugccacacccccagggaccgcagaugcuuucccucagagcaaugcccccauccaggacgaggagagagacauaccagaacgcuccuggaacucaggaaaugaguggauuacagauuuugcagguaagacugugugguucgugccgaguaucaaagccggcaacgacaucgcuaacuguuuaaggaagaaugggaaaaaggucauucaacugagccguaagacguuugauaccgaauaccagaaaacaaagcuuaacgacugggauuucguagugacuaccgacaucucugagaugggagccaauuuuaaagcggaucggguuauugacccuagaaggugccugaagcccgugauacucacagauggcccagagcgcgucaucuuggcaggucccaugccugugaccgccgcuuccgccgcucagcgaagagggcggguuggcaggaacccacagaaagaaaaugaccaauauauuuucacuggacagccccugaacaaugaugaggaccaugcacacuggacggaagccaagaugcuccuggacaacaucaauaccccugagggcaucauuccggcucuuuucgaaccagagcgcgagaagucagccgcaauagauggggaauaccgucuaaaaggagagaguagaaagacauuuguggaacugaugcggaggggugacuugcccgucugguuagcgcacaaaguggccagcgagggcaucaaguauacugaucgcaaauggugcuucgacgggcagcgaaacaaucagauucuggaagagaacauggauguagagaucuggaccaaggaaggagagaaaaagaagcucagaccucgguggcuggacgcuaggacauacuccgauccccuugcccugaaagaauuuaaggaguucgcagcuggccgcaaaucuauugcccucgacuuggugaccgaaaucgguagaguuccaucgcaucuggcacacaggacucggaaugcccuagauaaccuggucaugcuccauacaagcgagcacgggggccgugcuuaucgccacgcgguggaggaacuuccugagacgauggaaacccuguuauugcugggacucaugauacugcuuacuggcggggccaugcuguuucucaucucaggaaaggguauuggcaaaacauccaucggguugauuugugugaucgcaaguucuggaaugcuguggauggcugagauacccuuacaauggauugccagcgccaucguccuagaguucuuuaugaugguucugcucauuccagaaccugagaagcagcgaaccccgcaggacaaucaacuugcauacgugguaaucggcauacugaccuuggcugccaucauugcggcuaacgaaaugggucugcucgagacaacuaagagagaucuggggauguccaaagaacccggcguggucucaccaacgucuuaucuugacguggaucuccauccugccagcgcauggacccuguacgccguugcuacaacugugaucacccccauguugaggcacacaauugagaauaguaccgcaaacgucucccuggccgcgaucgcuaaccaggccguaguguuaaugggacuagacaagggcuggccaauaagcaaaauggaccuggggguuccucuccuugcacugggaugcuacucucaggugaaucccuugacucugacggccgcuguccuccugcuuauuacacauuaugccaucaucggcccggguuuacaggcaaaggcuacccgggaggcccaaaaacgcacugcggccgggauuaugaagaacccaaccguggauggaaucaugacaauagaccuggauccugucauuuacgacucaaaguucgaaaaacagcucggccaggugauguugcugguucuaugugcagugcagcugcuccuuaugagaacuuccugggcucugugcgaggccuugacccuggcaacaggucccaucacgacccucugggaaggcaguccagggaaguuuuggaauacuacaauugcuguaagcauggccaacaucuucaggggaucguaucuggccggcgcgggguuagcuuuuucuauaaugaaauccgugggaaccggcaagcgggguacugggagccaaggagagacacuuggcgaaaaauggaagaagaaacugaaucagcucucacgaaaggauuucgaccuauacaaaaagagugguaucaccgaggucgauagaacggaggcaaaagaaggccugaagcgcggggagauuacccaccaugccguuucuaggggauccgcuaaauugcagugguuuguggaacggaacauggucauccccgagggccgugugauugaccugggguguggaagaggcgguuggagcuauuacugcgccgggcucaagaagguaacagaagugaggggauauacuaaaggcggcccugggcacgaggagccgguucccaugucaaccuacggauggaauaucgugaagcuuaugagugguaaagaugucuucuaccugccaccugaaaagugugacacauugcugugcgauauuggcgagagcucccccucuccuacuguggaagagagccgcaccauccggguccucaaaaugguggagccaugguuaaagaacaaucaguucuguauaaagguucugaaccccuauaugccuacaguaauugaacaccuugagcgacugcaaagaaaacaugggggaaugcuagugaggaauccacucucccgcaacucaacccacgaaauguacuggaucucuaauggcacugguaacaucgucgcaagugugaauaugguuucgcggcuguugcugaacagauuuacgaugacacaucguaggcccaccauugagaaggacguggaucucggggccggaacucggcacgucaacgcugaaccggagaccccuaauauggacgugauaggcgagcgcaucaaacgaauuaaggaagagcacaacagcacauggcauuaugacgaugaaaauccauacaaaacgugggcguaucacggcuccuacgagguaaaggccaccgggucugcaucaagcaugaucaacggagugguuaagcuucugacuaaacccugggacgucgugccuauggugacacagauggcuaugaccgauacuacaccauucggucagcaaagagucuuuaaggaaaaaguugacaccaggacaccccgguccaugccgggcacucgcagagugauggggauuaccgccgagugguuauggaggacgcugggacgaaauaagaaaccucgguugugcacccgugaggaauucacaaagaagguaagaacuaacgcagccaugggcgcuguguuuaccgaggaaaaucagugggauagugccaaagcggcagucgaggacgaagauuucuggaagcucguggaccgcgagagggagcugcauaaacuagguaagugugggucuugcguuuauaacaugaugggaaaacgggaaaagaaacuuggcgaguuuggcaaggccaaggggagcagagcuaucugguacauguggcugggagcccgcuaccucgaauucgaggcacuggguuuuuugaaugaggaucacugguucucaagggaaaacuccuauaguggcguggagggggaaggacugcauaaacucggcuacauacuucgagacaucagcaagauucccgguggggcuauguaugccgaugacacagcuggaugggacacucggaucaccgaggaugaccugcacaaugaagagaaaauuacgcagcagauggauccagagcacagacaauuagccaacgcaaucuuuaagcugacauaccagaauaaagucgugaagguacagaggccuacccccacuggcacaguuauggacauaauuucucgcaaggaucagcguggcuccgggcaagugggaaccuaugguuugaacacuuucaccaauauggaagcgcagcucauccggcagauggagggcgaagggguccugucaaaagccgaccuagagaacccacaucuucccgaaaagaaaaucacacaguggcuggagacgaagggaguggagagacucaaaaggauggcuauuagcggcgaugacugcguggucaagccuauagaugaccgcuuugccaacgcacuguuggcuuuaaaugauauggguaagguucgaaaagacaucccacaauggcagccgucgaagggguggcacgauuggcagcaggugcccuucuguucucaucacuuccacgaacugauuaugaaagacggacggaagcucguagugccuugcagaccacaagacgagcuuaucggcagggcccgcauuagucagggcgcaggguggucccugaaagaaaccgccugucuaggaaaggcguacgcucagauguggagccugauguauuuucauagacgggaucucagguuggccucaaacgcaaucugcuccgccguccccgugcacuggguuccuacuucucguacaaccuggagcauacaugcucaccaucaauggaugacuacagaggacaugcugaccguguggaaucgagucuggaucgaagauaacccauggauggaggacaagacgcccgugacaaccugggagaauguaccuuaccuugguaaacgcgaagaucagugguguggcagucugauugggcucacuuccagagccaccugggcacagaacaucccgacagcuauucagcaaguucggagcuuaaucggaaaugaggaauuccuggacuacaugccaucuaugaagagguuucgcaaagaggaggaaucagagggcgccauuugguga

SEQ ID NO: 15300 - RNA, 9873 nt, Artificial Sequence
  derived and/or modified CDS sequence (opt3) from DENV-3__HQ705619__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgcuuaccuggaauaggaaagagcuguuggugacuuuuaagaacgcacacgcuaaaaagcaagaaguaguugugcucggcucccaggagggagccaugcacacagcucugaccggcgccacagaaauucagaauucagggggaacuaguauauucgcaggucauuuaaagugucggcugaaaauggacaagcuagagcucaaaggcaugagcuacgccaugugcaccaacacguuuguccugaagaaagaggugucugaaacccagcacgggacaauccuuauuaaggucgaguacaagggagaagaugugccauguaaaauccccuucuccacugaggacggccaagguaaggcucauaacgggcguuugauaaccgcgaauccuguugugacaaaaaaggaggaaccaguaaacauugaggcagaacccccguucggcgagucaaauaucgucaucggaauuggcgauaacgcccugaaaaucaauugguauaagaaggggagcaguauuggaaaaauguuugaagcuacugcccgcggugcaagaaggauggccauacucggcgacaccgcuugggauuucgggucugugggaggcguucugaacucccuugguaagauggugcaccagaucuuugggagcgccuacacggcacuguucucgggcgucucuugggugaugaaaauuggaaucggcguauugcucacauggaucgggcugaauuccaagaacaccucaaugaguuuuagcugcauugcgauaggaaucauuacuuuauaucugggcgcugugguucaggccgacauggguugugucaucaauuggaaagggaaggagcuaaagugcggauccggcauuuucgugacaaacgaggugcauaccuggacugaacaguacaaauuucaagcagauucuccuaagcggcucgccaccgcuaucgccggugcaugggagaauggcgucugugggauacgaagcacaacgcgcauggaaaaccugcuuuggaaacagaucgcuaaugaguugaacuauauucugugggaaaauaacaucaagcucaccguuguggugggagacauuaucggcguacuggagcaggggaaaagaacuuuaacaccccagccaauggagcugaaguacucauggaaaaccuggggaaaggccaagauagucacagcggaaacucaaaacaguuccuucauuaucgauggcccuaauacccccgagugcccaagcgugucuagggccuggaacguuugggaaguggaggacuaugguuuuggggucuucacgacaaauauuuggcuuaaauugcgggaaguguacacccagcucugugaccaccgccugaugucagcugcaguuaaggaugagagagccgugcacgcugacaugggauacuggaucgagagucagaaaaacggcagcuggaagcuagaaaaagccucccugauagagguaaagacuugcaccuggcccaagucucauacacucuggucgaaugguguccuggaaagcgauaugaucauuccuaaaucccuugcaggcccaaucucacagcacaaccauaggccgggguaucacacucaaaccgcgggacccuggcacuugggcaagcuggaguuagacuuuaauuacugcgaggggacaacgguggugauuaccgaaaacuguggaacucguggcccuagucuccggacaaccacugucucugguaaacugauccaugaguggugcugucgaagcugcacacuuccaccccugagauauaugggggaagauggauguugguacggcauggagauaaggccuauuuccgaaaaggaggagaauaugguuaaaucauuggugagcgccgguucuggcaagguagacaacuucaccaugggggugcucugccuggcuauccuauuugaagaggucaugcgcggaaaguucggcaaaaagcacaugaucgccgggguguucuuuacguucguucugcuccuguccggacagauuacuuggcgggauauggcacauacccuuaucaugauuggcaguaaugcuagcgacagaauggguaugggggugacauauuuggcccugauagcaaccuuuaaaauccagccauucuuagcccucggauuuuuccugaggaagcuuacuucucgcgaaaaccugcuacucggcgucggccuggcuauggcgacaaccuugcaacugcccgaggauauugaacagauggccaaugggaucgcauuaggacucauggcucugaaacuuauuacacaguuugagacuuaccagcuguggaccgccuugaucucccucacguguucaaacacaauauucacccugacuguggccuggcgaaccgcuacacuaauccuggcagguguuagucuucucccggugugccaaagcucguccaugcggaagacugacuggcugccuauggccgucgcggcuaugggcguaccacccuugccucuguuuauuuucggguuaaaggauacccucaaacguagaucuuggccccugaaugagggagugauggccguuggccuugugagcauccuggcaucaaguuugcucaggaacgacgucccaauggccgguccucugguggcugggggacuacugauugcauguuauguaaucacgggcacauccgccgaucuuaccguggaaaaggcggcugacauaacuugggaggaagaggccgaacagacaggcgucucucacaaccucaugauuaccguugacgaugacgggacuaugcgcaucaaagaugacgagacagagaauauccugaccguguuguuaaagacggcacugcucauugugagcggaauauuucccuacuccaucccagccacucugcuugucuggcauaccuggcagaaacagacacaacggucaggugugcugugggauguuccgagcccucccgaaacccagaaggcugaguuggaagagggcguauacagaauuaaacagcaggggaucuucggaaagacacaagugggcgucggugugcagaaggaggggguuuuucacacuauguggcacgugaccaggggagccguccuaacguauaacggcaaacgacuggaaccaaauugggcaagugugaagaaagaccucauuucuuacggcgggggauggcgccuguccgcucaguggcaaaagggugaggaaguacaggucaucgccguggagcccggcaaaaacccuaagaauuuccagacaaugccagggacuuuccagaccacaaccggagaaauaggcgcgaucgcccuugauuuuaagcccgguacuagcgggucgccuauuaucaaccgggagggaaaaguugugggcuuauauggcaauggggucgugaccaagaacggagguuacguuucaggcauugcacaaacaaaugcugagccggacgggccaacgcccgaacuggaggaagagauguucaaaaagagaaaccucacuaucauggauuugcauccuggaucuggcaaaaccaggaaguaucugccagccauagugcgugaagcuauuaagcgccggcucagaacacugauccuugcacccaccagggucguggccgccgagauggaggaagcucugaaagguuugccuauccgauaccagacuacagcgaccaagagugagcacacggggcgggaaauuguagaccuaaugugccaugcaacuuuuacaaugcgccugcucuccccggugagaguucccaauuauaacuuaaucauaauggaugaggcccacuucaccgacccagcuagcauugccgcaaggggauacaucucuacccgggucggcaugggcgaagccgcugcgauuuuuaugacugccacaccucccgggaccgcagaugcuuucccacagagcaaugccccuauccaggacgaggagcgagacauacccgaaagauccuggaacucaggaaaugaguggauuacagauuuugcagguaaaacugugugguucgugccaaguaucaaggccggcaacgacaucgcuaacugucugcgcaaaaaugggaagaaggucauucaacuuagcaggaaaacguuugauaccgaauaccagaagacaaaacugaacgacugggauuucguagugacuaccgacaucucugagaugggagccaauuuuaaggcggaucguguuauugacccgcggagaugccucaaaccugugauauugacagauggccccgagagggucauccuggcagguccaaugcccgugaccgccgcuuccgccgcucagcgccgagggagaguuggccggaacccucagaaggaaaaugaccaauauauuuucacuggacagccacucaacaaugaugaggaccaugcacacuggacggaagccaagaugcugcuugacaacaucaauacccccgagggcaucauuccugcucuauucgaaccggagagggagaaaucagccgcaauagauggggaauaccgccugaagggagagagucguaaaacauuuguggaauugaugagacggggugacuuaccagucuggcuggcgcacaagguggccagcgagggcaucaaauauacugauaggaaguggugcuucgacgggcagcgcaacaaucagauucucgaagagaacauggauguagagaucuggaccaaagaaggagagaagaagaaacugcgacccagauggcuugacgcucggacauacuccgauccucuggcccucaaggaauuuaaagaguucgcagcuggcaggaagucuauugccuuggaccuggugaccgaaaucggucgcguucccucgcaucuagcacacagaacuaggaaugcccuggauaaccucgucaugcuucauacaagcgagcacgggggccgggcuuaucgucacgcgguggaggaacugccagagacgauggaaaccuuauugcugcucggacugaugauacuucugacuggcggggccaugcucuuuuugaucucaggaaaagguauuggcaagacauccaucgggcugauuugugugaucgcaaguucuggaauguuauggauggcugagauaccucuacaauggauugccagcgccaucguccuggaguucuuuaugaugguucuccuuauucccgaaccagagaagcagcgcaccccucaggacaaucaacuggcauacgugguaaucggcauauugacccuggcugccaucauugcggcuaacgaaaugggucuccuggagacaacuaaacgagaucuugggauguccaaggaaccgggcguggucucacccacgucuuaucucgacguggaucugcauccagccagcgcauggaccuuguacgccguugcuacaacugugaucaccccuaugcugagacacacaauugagaauaguaccgcaaacgucuccuuagccgcgaucgcuaaccaggccguagugcuaaugggacuggacaaaggcuggcccauaagcaagauggaccucgggguuccacuucuggcauugggaugcuacucucaggugaauccucugacucucacggccgcuguccugcuuuuaauuacacauuaugccaucaucggccccggucugcaggcaaaagcuaccagggaggcccaaaagcggacugcggccgggauuaugaagaacccgaccguggauggaaucaugacaauagaccucgauccagucauuuacgacucaaaauucgaaaagcaguugggccaggugaugcugcuaguucugugugcagugcagcuccuucugaugcgcacuuccugggcuuugugcgaggcccugacccucgcaacagguccuaucacgacccugugggaaggcagucccgggaaauuuuggaauacuacaauugcuguaagcauggccaacaucuucagaggaucguauuuagccggcgcggggcuugcuuuuucuauaaugaaguccgugggaaccggcaaaagggguacugggagccaaggagagacacugggcgaaaaguggaagaaaaagcucaaucagcuaucacggaaagauuucgaccuguacaagaaaagugguaucaccgaggucgaucgaacggaggcaaaggaaggcuugaaaagaggggagauuacccaccaugccguuucucgcggauccgcuaagcugcagugguuuguggaaaggaacauggucaucccagagggccgggugauugaccucggguguggacguggcgguuggagcuauuacugcgccgggcuuaagaaaguaacagaagugagaggauauacuaagggcggccccgggcacgaggagccuguuccgaugucaaccuacggauggaauaucgugaaacugaugagugguaaggaugucuucuacuugcccccagaaaaaugugacacacugcucugcgauauuggcgagagcuccccuucucccacuguggaagagagcaggaccauccgcgucuuaaagaugguggagccuuggcugaagaacaaucaguucuguauaaaaguucuuaacccauauaugcccacaguaauugaacaccuggagcggcuacaacgaaagcaugggggaaugcucgugagaaauccucuguccaggaacucaacccacgaaauguacuggaucucuaauggcacugguaacaucgucgcaagugugaauaugguuucgcgcuugcugcucaaccgguuuacgaugacacauagacguccaaccauugagaaagacguggaucuuggggccggaacuaggcacgucaacgcugaacccgagaccccgaauauggacgugauaggcgagcggaucaagcgcauuaaagaagagcacaacagcacauggcauuaugacgaugaaaauccuuacaagacgugggcguaucacggcuccuacgagguaaaggccaccgggucugcaucaagcaugaucaacggagugguuaaacuguuaacuaagccaugggacgucgugcccauggugacacagauggcuaugaccgauacuacaccuuucggucagcaacgagucuuuaaagaaaagguugacaccagaacaccaagguccaugcccggcacucggcgcgugauggggauuaccgccgaguggcuguggagaacguugggaaggaauaaaaagccgcgacucugcacccgggaggaauucacaaagaaaguacguacuaacgcagccaugggcgcuguguuuaccgaggaaaaucagugggauagugccaaggcggcagucgaggacgaagauuucuggaaacugguggacagagagcgcgagcuacauaagcuugguaaaugugggucuugcguuuauaacaugaugggaaagagggaaaaaaagcugggcgaguuuggcaaggccaaagggagccgggcuaucugguacauguggcucggagccagauaccuggaauucgaggcauuggguuuucugaaugaggaucacugguucucacgcgaaaacuccuauaguggcguggagggggaaggacuccauaagcuuggcuacauacugagggacaucagcaaaauuccugguggggcuauguaugccgaugacacagcuggaugggacacucgaaucaccgaggaugacuuacacaaugaagagaagauuacgcagcagauggaucccgagcaccggcaacuggccaacgcaaucuuuaaauugacauaccagaauaaggucgugaagguacagagaccaaccccuacuggcacaguuauggacauaauuucuaggaaagaucagcgcggcuccgggcaagugggaaccuauggucucaacacuuucaccaauauggaagcgcagcugauccgucagauggagggcgaagggguccuaucaaaggccgaccuugagaacccccaucugccagaaaaaaagaucacacaguggcucgagacgaaaggaguggagcggcugaagagaauggcuauuagcggcgaugacugcguggucaagcccauagaugacagguuugccaacgcauuguuagcucugaaugauauggguaaaguucgcaaggacaucccucaauggcagccaucgaaaggguggcacgauuggcagcaggugccguucuguucucaucacuuccacgaacucauuaugaaggacggacgaaaacuuguagugcccugccggccucaagacgagcugaucggcagagccaggauuagucagggcgcaggguggucccuaaaggaaaccgccugucugggaaaggcguacgcucagauguggagccucauguauuuucaucgcagagauuugcggcuggccucaaacgcaaucugcuccgccgucccagugcacuggguucccacuucuaggacaaccuggagcauacaugcucaccaucaauggaugacuacagaggacaugcuuaccguguggaaucgugucuggaucgaagauaacccuuggauggaggacaaaacgccagugacaaccugggagaauguacccuaccuggguaagcgagaagaucagugguguggcagucucauuggguuaacuucccgcgccaccugggcacagaacaucccuacagcuauucagcaaguuagaagccugaucggaaaugaggaauucuuggacuacaugccgucuaugaaacgguuuaggaaggaggaggaaucagagggcgccauuugguga

SEQ ID NO: 15301 - RNA, 9873 nt, Artificial Sequence
  derived and/or modified CDS sequence (opt3) from DENV-3__HQ705620__SS-prME
accagccugugccucaugaugauccuuccagcagcucuggcauuccacuugacauccagagacggcgaaccuaggaugauuguggggaagaacgaacggggaaaaucuuuacuguuuaagacugccucagguauaaauauguguacguuaaucgcgauggaucucggcgaaaugugcgacgauaccguaacauacaaauguccacauauuacugaaguugaaccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcagcaugaaaaucugaaguauacugucauuaucaccgugcacacaggugaccagcaucagguuggcaacgagacccaaggggugacugcagaaauuacgccucaggcuuccacaaccgaggccauccucccagaauacggaacucuuggccuggagugcucuccgcgaaccgguuuggacuucaaugagaugauccuacugacaaugaaaaacaaggcguggaugguccacagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcauacagcucucaccggcgccacagaaauucaaaauucagggggaacaaguauauucgcaggucaccugaagugucgguuaaaaauggacaagcuggagcuaaaaggcaugagcuaugccaugugcaccaacacguuuguccucaagaaagaggugucugaaacccagcaugggacaauccugauuaaggucgaguacaagggagaagaugugcccuguaaaaucccuuucuccacugaggacggccaagguaaggcucacaacgggcgucuuauaaccgcgaauccaguugugacuaagaaggaggaacccguaaacauugaggcagaaccgccuuucggcgagucaaauaucgucaucggaauuggcgauaacgccuugaaaaucaauugguacaagaaggggagcaguauuggaaaaauguuugaagcuacugcccgcggugcaagaaggauggccauacugggcgacaccgcuugggauuucgggucugugggaggcguucucaacucccuggguaagauggugcaucagaucuuugggagcgccuauacggcacuuuucucgggcgucucuugggugaugaaaauuggaaucggcguacuguugacauggguggggcucaauuccaagaacaccucaaugaguuuuagcugcaucgcgauuggaauaaucacucuguacuuaggcgcuguuguccaggccgacauggguugugugauuaauuggaaagggaaggagcugaagugcggauccggcaucuucgugacaaacgagguccacaccuggacugaacaguauaaauuucaagcagauucucccaagcggcuagccaccgcuauugccggugcaugggagaauggcguuugugggauccgaagcacaacgcgcauggaaaaccuccuguggaaacagauagcuaaugagcuuaacuacaucuugugggaaaauaacauuaagcugaccguggugguaggagacaucauuggcguccucgagcaggggaaaagaacucugacaccacagccuauggaguuaaaguauucauggaaaaccuggggaaaggccaagaucgugacagcggaaacucaaaacaguuccuucauaauugauggccccaauaccccagagugccccagcguuucuagggccuggaacgugugggaagucgaggacuacgguuuugggguguucacgacaaauaucuggcugaaacuucgggaaguuuauacccaguugugugaccaccgccucaugucagcugcagugaaggaugagagagccguacaugcugacaugggauacuggauugagagucagaaaaacggcagcuggaagcuggaaaaagccucccuaaucgaggucaagacuugcaccuggccuaagucucacacacuguggucgaauggugugcucgaaagcgauaugauaaucccaaaaucccuggcaggcccgauuucacagcauaaccacaggcccggguaccacacucaaaccgcgggaccuuggcaucuuggcaaguuggagcuggacuuuaauuauugcgaggggacaacgguggucaucaccgaaaacuguggaacucguggcccaaguuuacggacaaccacuguuucugguaaacucauucacgaguggugcugucgaagcugcacacugcccccucuuagauacaugggggaagauggauguugguauggcauggagaucaggccaauauccgaaaaggaggagaauauggugaaaucacugguaagcgccgguucuggcaagguggacaacuucaccaugggggucuugugccucgcuauucuguuugaagaggugaugcgcggaaaguucggcaaaaagcauaugaucgccgggguuuucuuuacguucgugcuacugcucuccggacagaucacuuggcgggauauggcacacacccugauuaugaucggcaguaaugcuagcgacagaauggguaugggggucacauaccuugccuugauugcaaccuuuaaaauacagcccuuccuggccuuaggauuuuuccucaggcgccugacuucucgagaaaaccuucugcuaggcgugggccucgcuauggcgacaacccugcaauugccggaggauaucgaacagauggccaaugggauugcacugggauuaauggcucucaagcugaucacacaguuugagacuuaucagcuuuggaccgcccugauuuccuugacguguucaaacacaaucuucacccucacuguugccuggcggaccgcuacacugauacuagccggugugagucugcuuccugucugccaaagcucguccaugcguaaaacugacuggcucccaauggccguagcggcuaugggcgugcccccucugcccuuguuuaucuucucucugaaggauaccuuaaagagaaggagcuggccacucaaugaggggguuauggccgugggacuggucucaauucuugcaaguucccuguugcgcaacgacgugccuauggccggcccccucguagcuggugggcugcuaaucgcauguuacgugauuacgggaacaucugccgaucugaccgucgaaaaagcggcugacaucacuugggaggaagaggccgaacagacaggcguuagccauaaccuuaugauaaccguggacgaugacggcacuaugcggauuaaggaugacgagacagagaauauccucaccgugcuguugaaaacggcauuacugaucgucuccgggauuuuuccauauucaauaccggccacucuccugguguggcacaccuggcagaagcagacacaaagaagcggaguucuuugggauguaccuagucccccagaaacccagaaagcugagcuggaagaggguguguacaggaucaagcagcagggcauuuucgggaaaacacaagucggagugggcguucagaaggaggguguguuucacacuauguggcaugucacccgaggggccguguugacguacaacggaaagcgccuagaacccaauugggcaucugucaagaaggaccugaucuccuauggcggcggguggcggcucagcgcucaguggcaaaaaggagaggaaguccaggugauugccguugagccugguaagaaccccaagaauuuccagacaaugcccggcacuuuccagaccacaaccggggaaaucggagcgauagcccuggauuuuaagccuggcacuucggguucaccgaucauuaacagagaggggaagguggucggacuuuacggcaauggcgugguuaccaaaaacgggggauaugugucugguaucgcacaaacaaaugcugagccagacggccccacgccugaauuagaggaagagauguucaagaaaaggaaccugacuauuauggaucuccacccagggaguggaaagacccguaaauacuugcccgccaucguccgcgaagcuauaaagcggagacugaggacacucauucuggcaccuacccgagugguagccgccgagauggaggaagcucuuaagggccugccgauccgguaucagacuacagcgaccaaauccgagcauacgggucgcgaaaucguggacuugaugugccacgcaacuuuuacaaugagacuacugagccccguuagggucccaaauuacaaccucauuaucauggaugaggcccauuucaccgacccugcuucuauagccgcacggggguauauuagcacccgagugggaaugggcgaagccgcugcgaucuuuaugacugccacacccccaggcaccgcagaugcuuucccucaguccaaugcccccauucaggacgaggagagagacaucccagaacgcucauggaacagugggaaugaguggauaacagauuuugcaggaaagacugugugguucgucccgagcauuaaagccgguaacgacaucgcuaacuguuuaaggaagaauggcaaaaagguaauccaacugucucguaagacguuugauaccgaauaccagaaaacaaaacuuaacgacugggauuucgugguuacuaccgacauuuccgagaugggggccaauuuuaaagcggaucgggugaucgacccuagaaggugccugaagcccgucauucucacagauggaccagagcgcgugauauuggcaggccccaugccuguuaccgccgcuucagccgcucagcgaagaggucggguggggaggaacccacagaaagaaaaugaccaauacaucuucacuggccagccccugaacaaugaugaggaccacgcacacuggacggaagccaagaugcuccuggacaacauuaauaccccugagggaaucaucccggcucuuuucgaaccagagcgcgagaagagugccgcaauugauggcgaauaucgucuaaaaggggagagcagaaagacauuugucgaacugaugcggaggggagacuugcccgugugguuagcgcauaaaguagccuccgaggguauaaaguacacugaucgcaaauggugcuucgacggccagcgaaacaaucagauccuggaagagaacauggauguggagauuuggaccaaggaaggggagaaaaagaagcucagaccucgguggcuggacgcuaggacauauucugauccccuugcccugaaagaauuuaaggaguucgcagcuggacgcaaaucgaucgcccucgacuugguuaccgaaauuggcagagucccaagccaccuggcacauaggacucggaaugcccuagauaaccuggugaugcuccacacaucagagcacggugggcgugcuuaccgccaugcgguggaggaacuuccugagacgauggaaacccuguuauugcugggccucaugauccugcuuacuggaggcgccaugcuguuucucauauccgggaagggaaucgguaaaacaaguauuggcuugaucugugucauugcaucuagcgggaugcuguggauggcugagauccccuuacaauggauagccuccgccauuguucuagaguucuuuaugauggugcugcucaucccagaaccugagaagcagcgaaccccgcaggacaaucaacuugcauauguagugauuggaauccugaccuuggcugccauaaucgcggcuaacgaaaugggccugcucgagacaacuaagagagaucuggguaugucaaaagaacccggggucgugucuccaacgagcuaccuugacguugaucuccacccugccagugcauggacccuguaugccguggcuacaacugucauuacccccauguugaggcauacaaucgaaaauuccaccgcaaacguaagccuggccgcgauugcuaaccaggccgugguuuuaaugggccuagacaagggauggccaaucucuaaaauggaccugggcgugccucuccuugcacuggggugcuacucacaggucaaucccuugacucugacggccgcugugcuccugcuuauaacacacuacgccauuaucggaccgggcuuacaggcaaaggcuacccgggaggcccaaaaacgcacugcggccgguaucaugaagaacccaaccgucgaugggauuaugacaaucgaccuggauccugugauauaugacuccaaguucgaaaaacagcucggacagguuauguugcuggugcuaugugcaguacagcugcuccuuaugagaacaaguugggcucugugcgaggccuugacccuggcaacaggccccauuacgacccucugggaagguagcccaggcaaguuuuggaauacuacaaucgcugugucgauggccaacauuuucagggggucuuaccuggccggagcgggcuuagcuuuuuccaucaugaaaagcgucgggaccggaaagcggggcacugguucacaaggggagacacuuggagaaaaauggaagcgaaagcugaaucagcucaguagaaaagauuucgaccuauauaagaaaucuggcauaaccgagguugaucgcacggaggcaaaggaaggucugaaaaggggcgagaucacccaucacgccgugucccgggggagcgcuaaguugcagugguuugucgaacguaacauggugauucccgagggaagaguaaucgaccugggcugugggaggggaggcuggucauacuauugcgccggucucaaaaaggugacagaaguucgcggguacacuaagggaggcccuggccacgaggagccggugcccaugaguaccuauggguggaauauugucaaacuuaugagcggaaaggauguguucuaccugccaccugaaaaaugugacacauugcugugcgauaucggugaguccucucccagcccuacugucgaagagucccggaccauucgagugcucaagaugguugagccauggcugaaaaacaaucaguucuguaucaagguacuaaaccccuacaugccuacagugauagaacaucuugagagacugcaaaggaagcacggcgggaugcuaguccgcaauccacucucacggaacucuacccaugaaauguauuggauuaguaauggaacuggcaacaucguggcaucgguuaauauggugagcagacuguugcugaaccguuuuacgaugacacacaggcggcccaccaucgagaaagacgucgaucucggugccgggacucgccacgugaacgcugaaccggagaccccuaauauggacguaauuggagagcgaauaaagagaaucaaagaagaacauaacuccacauggcacuacgacgaugaaaauccauauaagacgugggcguaccauggcucuuaugaggugaaagccaccggcucagcaagcuccaugauuaacgggguugucaaacuucugacuaagcccugggacguggugccuauggucacacagauggcuaugaccgauacuacaccauucggacagcaaaggguuuuuaaagaaaagguggacacccggacaccccgcaguaugccggguacuagaaggguaaugggcaucaccgccgagugguuauggcgaacgcuggggcggaauaaaaagccucguuugugcaccagagaggaguucacuaaaaaggugcgcacuaacgcagccaugggagcugucuuuaccgaggaaaaucagugggauucugccaaggcggcaguggaggacgaagauuucuggaaacucguugacagggagcgggagcugcacaagcuaggcaaaugugguagcugcguguacaacaugauggggaagagagagaagaaacuuggagaguuuggcaaagccaaaggcucacgcgcuauuugguauauguggcugggggccagguaccucgaguucgaggcacugggauuuuugaaugaggaucauugguucucccgagaaaacaguuacagcggugucgagggcgaagggcugcacaagcucggauauauccuucgggacauaucuaaaauccccggcggugcuauguacgccgaugacacagcugggugggacacuagaauuaccgaggaugaccugcacaaugaagagaagaucacgcagcagauggauccagagcauaggcaauuagccaacgcaauuuuuaaacugacauaucagaauaaggugguaaaaguucagcgcccuacccccacuggaacagugauggacaucauaucccguaaggaucagcggggcucaggccaagucgggaccuacggauugaacacuuucaccaauauggaagcgcagcucauuagacagauggagggugaaggcgugcugagcaaggccgaccuagagaacccacaccuucccgagaaaaagaucacacaguggcuggagacgaaagggguggagaggcucaagcgcauggcuaucucgggagaugacugcgucguuaaaccuauugaugaccgauuugccaacgcacuguuggcuuuaaaugauaugggcaaggugcggaaggacauaccacaauggcagccgucuaaagguuggcaugauuggcagcagguacccuucuguagucaccacuuccaugaacugaucaugaaggacgggagaaaacucguggucccuugcaggccacaagacgagcuuauuggacgcgccagaaucucccagggcgcaggcuggagccugaaggaaaccgccugucuagggaaagcguaugcucagauguggucacugauguacuuucaccggagggaucuccguuuggccuccaacgcaauuugcucugccgugcccguucauugggugccuacuagccgaacaaccuggaguauccacgcucaucaccaauggaugacuacagaggacaugcugaccgucuggaaucgcguguggauagaagauaacccauggauggaggacaagacgcccguaacaaccugggagaauguuccuuaucuuggaaagagagaagaucaguggugugguucccugaucggccucacuagccgggccaccugggcacagaacauuccgacagcuauccagcaagugaggucuuuaauugggaaugaggaguuccuggacuacaugccaucaaugaaacgcuuuagaaaggaggaggaaagugagggagccaucugguga

SEQ ID NO: 15302 - RNA, 9873 nt, Artificial Sequence
  derived and/or modified CDS sequence (opt3) from DENV-3__HQ705621__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcagcaugaaaaucugaaguauacugucauuaucaccgugcacacaggugaccagcaucagguuggcaacgagacccaaggggugacugcagaaauuacgccucaggcuuccacaaccgaggccauccucccagaauacggaacucuuggccuggagugcucuccgcgaaccgguuuggacuucaaugagaugauccuacugacaaugaaaaacaaggcguggaugguccacagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcauacagcucucaccggcgccacagaaauucagaauucagggggaacuaguauauucgcaggucaccugaagugucgguuaaaaauggacaagcuggagcuaaaaggcaugagcuaugccaugugcaccaacacguuuguccucaagaaagaggugucugaaacccagcaugggacaauccugauuaaggucgaguacaagggagaagaugugcccuguaaaaucccuuucuccacugaggacggccaagguaaggcucacaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguacaagaaggggagcaguauuggaaaaauguuugaagcuacugcccgcggugcaagaaggauggccauacugggcgacaccgcuugggauuucgggucugugggaggcguucucaacucccuggguaagauggugcaucagaucuuugggagcgccuauacggcacuuuucucgggcgucucuugggugaugaaaauuggaaucggcguacuguugacauggaucgggcucaauuccaagaacaccucaaugaguuuuagcugcauugcgauaggaaucauuacucuguacuuaggcgcugugguucaggccgacauggguugugucaucaauuggaaagggaaggagcugaagugcggauccggcauuuucgugacaaacgaggugcacaccuggacugaacaguauaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuacauuuugugggaaaauaacaucaagcugaccguuguggugggagacauuaucggcguacucgagcaggggaaaagaacucugacaccacagccuauggaguuaaaguauucauggaaaaccuggggaaaggccaagauagucacagcggaaacucaaaacaguuccuucauuaucgauggccccaauaccccagagugccccagcgugucuagggccuggaacguuugggaaguggaggacuacgguuuuggggucuucacgacaaauauuuggcugaaacuucgggaaguguauacccaguugugugaccaccgccucaugucagcugcaguuaaggaugagagagccgugcaugcugacaugggauacuggaucgagagucagaaaaacggcagcuggaagcuggaaaaagccucccuaauagagguaaagacuugcaccuggccuaagucucacacacuguggucgaaugguguccucgaaagcgauaugaucauuccaaaaucccuggcaggcccgaucucacagcauaaccacaggcccggguaccacacucaaaccgcgggaccuuggcaucuuggcaaguuggagcuggacuuuaauuauugcgaggggacaacgguggugauuaccgaaaacuguggaacucguggcccaaguuuacggacaaccacugucucugguaaacucauccacgaguggugcugucgaagcugcacacugcccccucuuagauacaugggggaagauggauguugguauggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcauaugaucgccgggguguucuuuacguucguucuacugcucuccggacagauuacuuggcgggauauggcacacacccugaucaugauuggcaguaaugcuagcgacagaauggguaugggggugacauaccuugccuugauagcaaccuuuaaaauccagcccuuccuggccuuaggauuuuuccucaggaagcugacuucucgcgaaaaccuucugcuaggcgucggccucgcuauggcgacaacccugcaauugccggaggauauugaacagauggccaaugggaucgcacugggauuaauggcucucaaacugauuacacaguuugagaucuaucagcuuuggacugcccugauauccuugaccuguucaaacacgaucuucacacucaccguggccuggcgaacugcuacccugauucuagcagguguuagucugcuuccuaugugccaaagcucguccaugcggaagacagacuggcucccaauggccguggcggcuaugggcguccccccucugcccuuguuuaucuucucucugaaggauacuuuaaaacguagaagcuggccacucaaugaggggguaauggccgugggacugguuucaauucuugcaaguucccuguugaggaacgacgugccuauggccggcccccucgucgcuggugggcugcuaaucgcauguuacgugauaaccggaacgucugccgaucugacaguagaaaaggcggcugacauuaccugggaggaagaggccgaacagacuggcgugagccauaaccuuaugaucacagucgacgaugacggcaccaugcgcaucaaagaugacgagacugagaauauucucacaguucuguugaagaccgcauuacugauaguguccgggaucuuuccauauucaauuccggccacgcuccugguguggcacacuuggcagaaacagacccaacggagcggaguccuuugggaugugccuagucccccagaaacacagaaggcugagcuggaagaggguguuuacagaaucaaacagcagggcauuuucgggaagacccaaguaggagugggcguccagaaggaggguguguuucacacaauguggcauguuacuaggggggccguguugaccuacaacggaaaacgacuagaacccaauugggcaucugucaagaaagaccugaucuccuauggcggcggguggcgccucagcgcucaguggcaaaagggagaggaagugcagguaauagccgucgagccugguaaaaacccaaagaauuuccagacgaugcccggcacauuccagacuaccacaggggaaaucggagcgauugcccuggauuuuaagccuggcaccucggguucaccgaucauuaaccgggaggggaaagugguuggacuuuacggcaauggcguggucacuaagaacgggggauaugugucugguaucgcacaaaccaaugcugagccagacggccccacaccugaauuagaggaagagauguucaaaaagagaaaccugacgauaauggaucuccacccagggaguggaaaaacuaggaaguacuugcccgccauuguucgugaagcuaucaagcgccggcugagaacccucauccuggcaccuacaaggguggucgccgccgagauggaggaagcucuuaaaggccugccgauucgauaucagaccacugcgacaaaguccgagcauaccggucgggaaaucguggacuugaugugccacgcaacguuuacuaugcgccuacugagccccguaagagugccaaauuacaaccucauaauuauggaugaggcccauuucacagacccugcuucuaucgccgcaaggggguauauuagcacccggguuggaaugggcgaagccgcugcgaucuuuaugaccgccacucccccaggcacagcagaugcuuucccucaguccaaugcccccauacaggacgaggagcgagacauuccagaaagaucauggaacagugggaaugaguggaucaccgauuuugcaggaaaaacagucugguucgugccgagcaucaaggccgguaacgacauugcuaacuguuuacgcaaaaauggcaagaaggugauccaacugucuaggaaaacuuuugauacggaauaccagaagaccaaacuuaacgacugggauuucgucguaacaacugacauuuccgagaugggggccaauuuuaaggcggaucgugugauagacccucggagaugccugaaacccguuauccucaccgauggaccagagagggugauuuuggcaggccccaugccugucacagccgcuucagccgcucagcgccgagguagaguggggcggaacccacagaaggaaaaugaccaauacaucuucaccggccagccccugaacaaugaugaggaccacgcacacuggacugaagccaagaugcuccuggacaacaucaauacgccugagggaauuauaccggcucuuuucgaaccagagagggagaaaagugccgcaaucgauggcgaauaucgccuaaagggggagagccguaaaaccuuuguugaacugaugagacggggagacuugcccgugugguuagcgcauaaggucgccuccgaggguauuaaauacacagauaggaaguggugcuucgacggccagcgcaacaaucagauccuggaagagaacauggauguggagauuuggacuaaagaaggggagaagaagaaacuccgaccuagauggcuggacgcucggaccuauucugauccccuugcccugaaggaauuuaaagaguucgcagcuggaaggaagucgaucgcccucgacuugguaacagaaauaggccgcgugccaagccaccuggcacauagaaccaggaaugcccuagauaaccugguuaugcuccacacuucagagcacggugggcgggcuuaccgucaugcggucgaggaacuuccugagacaauggaaacgcuguuauugcugggccucaugauccugcuuaccggaggcgccaugcuguuucucauuuccgggaaaggaaucgguaagacuaguauuggcuugaucugugugauagcaucuagcgggaugcuguggauggcugagauucccuuacaauggaucgccuccgccauugugcuagaguucuuuaugaugguccugcucaucccagaaccugagaagcagcgcacaccgcaggacaaucaacuugcauauguugugauaggaauccugaccuuggcugccauuaucgcggcuaacgaaaugggccugcucgagaccacaaaacgagaucuggguaugucaaaggaacccgggguagugucuccaacuagcuaccuugacgucgaucuccacccugccagugcauggacgcuguaugccguggcuaccacaguuauuacucccauguugagacauaccaucgagaauuccacagcaaacgugagccuggccgcgauagcuaaccaggccgucguauuaaugggccuagacaaaggauggccaauuucuaagauggaccugggcgugccucuccuugcacuggggugcuacucacagguuaaucccuugacccugacugccgcugugcuccugcuuaucacgcacuacgccaucauuggaccgggcuuacaggcaaaagcuacaagggaggcccaaaagcggaccgcggccgguaucaugaagaacccaacugucgaugggauaaugaccauugaccuggauccugugaucuaugacuccaaauucgaaaagcagcucggacaggucauguugcuggugcuauguguugugcagcugcuccuuaugcgcacaaguugggcacugugcgaggcuuugacucuggccaccggccccauuacaacgcucugggaagguagcccaggcaaauuuuggaauaccacuaucgcaguaucgauggcuaacauauucagagggucuuaccuggccggagccggcuuagcguuuuccaucaugaagagcguggggacaggaaaaaggggcaccgguucacaaggggagacucuuggagaaaaguggaagaaaaagcugaaucagcucagucggaaagauuucgaccuauauaagaaaucuggcauuacagaggucgaucgaaccgaggcuaaggaaggucugaaaagaggcgagaucacgcaucacgcaguuucccgcgggagcgccaaguugcagugguuuguggaaaggaacauggucauucccgagggacgggugaucgaccugggcugugggcguggaggcuggucauacuauugcgcuggucucaagaaaguaaccgaagugagaggguacacaaagggaggcccuggccacgaggagccgguucccaugaguacuuauggguggaauauugugaaacuuaugagcggaaaggaugucuucuaccugccaccugaaaaaugugacaccuugcugugcgauaucggugaguccucucccagcccuacaguggaagaguccaggacuauacgcguccucaagaugguggagccaugguuaaagaacaaucaguucuguauuaaaguucugaaccccuacaugccuaccguaaucgaacaucuugagcggcugcaacgaaagcacggcgggaugcuagugagaaauccacucucaaggaacucuacacaugaaauguauuggaucaguaauggaaccggcaacauugucgccucggugaauaugguuagccgccuguugcugaaccgguuuacuaugacgcacagacgucccacaauagagaaagacguggaucucggugcagggaccaggcacgucaacgccgaaccggagacuccuaauauggacgugaucggagagcggauuaagcgcaucaaagaagagcauaacuccaccuggcaccaugacgaugaaaauccauacaagacaugggcuuaucacggcucuuacgagguaaaggcgacgggcucagccagcuccaugauuaacggggugguuaaacuucugaccaagcccugggacgucgugccuauggugacucagauggcaaugacagauaccacuccauucggacagcaacgagucuuuaaagaaaagguugacacaagaacccccaggaguaugccggguacacggcgcgugaugggcaucacugcugagugguuauggagaacccuggggaggaauaaaaagccucgauugugcacgcgggaggaauucaccaagaaaguacguacaaacgccgcaaugggagccguguuuacugaggaaaaucagugggauucugcuaaggccgcggucgaggacgaagauuucuggaaacucguggacagagagcgcgagcugcauaagcuaggcaaaugugguagcugcguuuauaacaugauggggaagagggaaaaaaagcuuggagaguuuggcaaggcaaaaggcucacgggccauaugguacauguggcugggggcuagauaucucgaauucgaggcccugggauuuuugaaugaggaucacugguucucccgcgaaaacaguuacagcgguguggagggcgaagggcugcacaagcucggauacauccuuagggacauuucuaaaauccccggcggugcaauguaugcugaugacaccgccgggugggacacacgaauuacugaggaugaccugcauaaugaagagaagaucacccagcagauggauccagagcaccggcaauuagcuaacgccauauuuaaacugacguaccagaauaaggucgugaagguacagagaccuacacccaccggaacuguuauggacauuaucuccaggaaagaucagcgcggcucaggccaaguggggacauauggauugaacaccuucacuaauauggaagcacagcucauccgucagauggagggugaaggcguccugagcaaggcggaccuagagaacccacaucuucccgaaaaaaagauuacccaguggcuggagacaaaagggguggagcggcucaagagaauggccauaucgggagaugacugcguggucaagccuaucgaugacagguuugcuaacgcccuguuggcauuaaaugauaugggcaaaguucgcaaggacauuccacaauggcagccgucuaaagguuggcacgauuggcagcaggugcccuucuguagucaccauuuccacgaacugaucaugaaggacgggcgaaaacucguagugccuugccggccacaagacgagcuuauuggaagagcuaggaucucccagggcgccggcuggagccugaaggaaacggcaugucuagggaaggccuacgcgcagauguggucacugauguauuuucaucgcagagaucuccgguuggcuuccaacgccauaugcucugcaguccccgugcacuggguuccuaccagcaggacuacauggaguauccaugcccaccaccaauggaugaccacugaggacaugcugacaguguggaaucgugucuggauugaagauaacccauggauggaggacaaaacccccgugacgacaugggagaauguaccuuaccuuggaaagcgagaagaucaguggugugguucccugaucggccucaccagccgcgcuacuugggcccagaacauuccgaccgcaauccagcaaguuagaucuuuaauugggaaugaggaauuccuggacuauaugccaucaaugaaacgguuuaggaaggaggaggaaagugagggagcuauaugguga

SEQ ID NO: 15303 - RNA, 9873 nt, Artificial Sequence
  derived and/or modified CDS sequence (opt3) from DENV-3__HQ671176__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcagcaugaaaaucugaaguauacugucauuaucaccgugcacacaggugaccagcaucagguuggcaacgagacccaaggggugacugcagaaauuacgccucaggcuuccacaaccgaggccauccucccagaauacggaacucuuggccuggagugcucuccgcgaaccgguuuggacuucaaugagaugauccuacugacaaugaaaaacaaggcguggaugguccacagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcauacagcucucaccggcgccacagaaauucagaauucagggggaacuaguauauucgcaggucaccugaagugucgguuaaaaauggacaagcuggagcuaaaaggcaugagcuaugccaugugcaccaacacguuuguccucaagaaagaggugucugaaacccagcaugggacaauccugauuaaggucgaguacaagggagaagaugugcccuguaaaaucccuuucuccacugaggacggccaagguaaggcucacaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguacaagaaggggagcaguauuggaaaaauguuugaagcuacugcccgcggugcaagaaggauggccauacugggcgacaccgcuugggauuucgggucugugggaggcguucucaacucccuggguaagauggugcaucagaucuuugggagcgccuauacggcacuuuucucgggcgucucuugggugaugaaaauuggaaucggcguacuguugacauggaucgggcucaauuccaagaacaccucaaugaguuuuagcugcauugcgauaggaaucauuacucuguacuuaggcgcugugguucaggccgacauggguugugucaucaauuggaaagggaaggagcugaagugcggauccggcauuuucgugacaaacgaggugcacaccuggacugaacaguauaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuacauuuugugggaaaauaacaucaagcugaccguuguggugggagacauuaucggcguacucgagcaggggaaaagaacucugacaccacagccuauggaguuaaaguauucauggaaaaccuggggaaaggccaagauagucacagcggaaacucaaaacaguuccuucauuaucgauggccccaauaccccagagugccccagcgugucuagggccuggaacguuugggaaguggaggacuacgguuuuggggucuucacgacaaauauuuggcugaaacuucgggaaguguauacccaguugugugaccaccgccucaugucagcugcaguuaaggaugagagagccgugcaugcugacaugggauacuggaucgagagucagaaaaacggcagcuggaagcuggaaaaagccucccuaauagagguaaagacuugcaccuggccuaagucucacacacuguggucgaaugguguccucgaaagcgauaugaucauuccaaaaucccuggcaggcccgaucucacagcauaaccacaggcccggguaccacacucaaaccgcgggaccuuggcaucuuggcaaguuggagcuggacuuuaauuauugcgaggggacaacgguggugauuaccgaaaacuguggaacucguggcccaaguuuacggacaaccacugucucugguaaacucauccacgaguggugcugucgaagcugcacacugcccccucuuagauacaugggggaagauggauguugguauggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcauaugaucgccgggguguucuuuacguucguucuacugcucuccggacagauuacuuggcgggauauggcacacacccugaucaugauuggcaguaaugcuagcgacagaauggguaugggggugacauaccuugccuugauagcaaccuuuaaaauccagcccuuccuggccuuaggauuuuuccucaggaagcugacuucucgcgaaaaccuucugcuaggcgucggccucgcuauggcgacaacccugcaauugccggaggauauugaacagauggccaaugggaucgcacugggauuaauggcucucaaacugauuacacaguuugagaucuaucagcuuuggacugcccugauauccuugaccuguucaaacacgaucuucacacucaccguggccuggcgaacugcuacccugauucuagcagguguuagucugcuuccuaugugccaaagcucguccaugcggaagacagacuggcucccaauggccguggcggcuaugggcguccccccucugcccuuguuuaucuucucucugaaggauacuuuaaaacguagaagcuggccacucaaugaggggguaauggccgugggacugguuucaauucuugcaaguucccuguugaggaacgacgugccuauggccggcccccucgucgcuggugggcugcuaaucgcauguuacgugauaaccggaacgucugccgaucugacaguagaaaaggcggcugacauuaccugggaggaagaggccgaacagacuggcgugagccauaaccuuaugaucacagucgacgaugacggcaccaugcgcaucaaagaugacgagacugagaauauucucacaguucuguugaagaccgcauuacugauaguguccgggaucuuuccauauucaauuccggccacgcuccugguguggcacacuuggcagaaacagacccaacggagcggaguccuuugggaugugccuagucccccagaaacacagaaggcugagcuggaagaggguguuuacagaaucaaacagcagggcauuuucgggaagacccaaguaggagugggcguccagaaggaggguguguuucacacaauguggcauguuacuaggggggccguguugaccuacaacggaaaacgacuagaacccaauugggcaucugucaagaaagaccugaucuccuauggcggcggguggcgccucagcgcucaguggcaaaagggagaggaagugcagguaauagccgucgagccugguaaaaacccaaagaauuuccagacgaugcccggcacauuccagacuaccacaggggaaaucggagcgauugcccuggauuuuaagccuggcaccucggguucaccgaucauuaaccgggaggggaaagugguuggacuuuacggcaauggcguggucacuaagaacgggggauaugugucugguaucgcacaaaccaaugcugagccagacggccccacaccugaauuagaggaagagauguucaaaaagagaaaccugacgauaauggaucuccacccagggaguggaaaaacuaggaaguacuugcccgccauuguucgugaagcuaucaagcgccggcugagaacccucauccuggcaccuacaaggguggucgccgccgagauggaggaagcucuuaaaggccugccgauucgauaucagaccacugcgacaaaguccgagcauaccggucgggaaaucguggacuugaugugccacgcaacguuuacuaugcgccuacugagccccguaagagugccaaauuacaaccucauaguuauggaugaggcccauuucacagacccugcuucuauugccgcaaggggguauaucagcacccgggucggaaugggcgaagccgcugcgauuuuuaugaccgccacucccccaggcacagcagaugcuuucccucaguccaaugcccccauccaggacgaggagcgagacauaccagaaagaucauggaacagugggaaugaguggauuaccgauuuugcaggaaaaacagugugguucgugccgagcaucaaggccgguaacgacaucgcuaacuguuuacgcaaaaauggcaagaaggucauucaacugucuaggaaaacuuuugauacggaauaccagaagaccaaacuuaacgacugggauuucguagugacaacugacaucuccgagaugggggccaauuuuaaggcggaucguguuauugacccucggagaugccugaaacccgugauacucaccgauggaccagagagggucaucuuggcaggccccaugccugugacagccgcuucagccgcucagcgccgagguagaguugggcggaacccacagaaggaaaaugaccaauacauuuucaccggccagccccugaacaaugaugaggaccacgcacacuggacugaagccaagaugcuccuggacaacaucaauacgccugagggaaucauuccggcucuuuucgaaccagagagggagaaaagugccgcaauagauggcgaauaucgccuaaagggggagagccguaaaaccuuuguggaacugaugagacggggagacuugcccgucugguuagcgcauaagguggccuccgaggguaucaaauacacagauaggaaguggugcuucgacggccagcgcaacaaucagauucuggaagagaacauggauguagagaucuggacuaaagaaggggagaagaagaaacuccgaccuagauggcuggacgcucggaccuauucugauccccuugcccugaaggaauuuaaagaguucgcagcuggaaggaagucgauugcccucgacuuggugacagaaaucggccgcguuccaagccaccuggcacauagaaccaggaaugcccuagauaaccuggucaugcuccacacuucagagcacggugggcgggcuuaccgucaugcgguggaggaacuuccugagacaauggaaacgcuguuauugcugggccucaugauacugcuuaccggaggcgccaugcuguuucucaucuccgggaaaggaauugguaagacuaguaucggcuugauuugugugaucgcaucuagcgggaugcuguggauggcugagauacccuuacaauggauugccuccgccaucguccuagaguucuuuaugaugguucugcucauuccagaaccugagaagcagcgcacaccgcaggacaaucaacuugcauaugugguaaucggaauacugaccuuggcugccaucauugcggcuaacgaaaugggccugcucgagaccacaaaacgagaucuggguaugucaaaggaacccgggguggucucuccaacuagcuaccuugacguggaucuccacccugccagugcauggacgcuguaugccguugcuaccacagugaucacucccauguugagacauaccauugagaauuccacagcaaacgucagccuggccgcgaucgcuaaccaggccguaguguuaaugggccuagacaaaggauggccaauaucuaagauggaccugggcguuccucuccuugcacuggggugcuacucacaggugaaucccuugacccugacugccgcuguccuccugcuuauuacgcacuacgccaucaucggaccgggcuuacaggcaaaagcuacaagggaggcccaaaagcggaccgcggccgguauuaugaagaacccaacuguggaugggaucaugaccauagaccuggauccugucauuuaugacuccaaauucgaaaagcagcucggacaggugauguugcugguucuaugugcagugcagcugcuccuuaugcgcacaaguugggcucugugcgaggccuugacucuggcaaccggccccaucacaacgcucugggaagguagcccaggcaaauuuuggaauaccacuauugcuguaucgauggccaacaucuucagagggucuuaccuggccggagcgggcuuagcuuuuuccauaaugaagagcguggggacaggaaaaaggggcaccgguucacaaggggagacucuuggagaaaaguggaagaaaaagcugaaucagcucagucggaaagauuucgaccuauauaagaaaucuggcaucacagaggucgaucgaaccgaggcaaaggaaggucugaaaagaggcgagauuacgcaucacgccguuucccgcgggagcgcuaaguugcagugguuuguggaaaggaacauggucauccccgagggacgggugauugaccugggcugugggcguggaggcuggucauacuauugcgccggucucaagaaaguaaccgaagugagaggguacacaaagggaggcccuggccacgaggagccgguucccaugaguacuuauggguggaauaucgugaaacuuaugagcggaaaggaugucuucuaccugccaccugaaaaaugugacaccuugcugugcgauauuggugaguccucucccagcccuacaguggaagaguccaggacuauccgcguccucaagaugguggagccaugguuaaagaacaaucaguucuguauaaaaguucugaaccccuacaugccuaccguaauugaacaucuugagcggcugcaacgaaagcacggcgggaugcuagugagaaauccacucucaaggaacucuacacaugaaauguauuggaucaguaauggaaccggcaacaucgucgcaucggugaauaugguuagccgccuguugcugaaccgguuuacuaugacgcacagacgucccacaauugagaaagacguggaucucggugccgggaccaggcacgucaacgcugaaccggagacuccuaauauggacgugauaggagagcggaucaagcgcauuaaagaagagcauaacuccaccuggcacuacgacgaugaaaauccauauaagacaugggcguaccauggcucuuaugagguaaaggccacgggcucagcaagcuccaugaucaacggggugguuaaacuucugaccaagcccugggacgucgugccuauggugacucagauggcuaugacagauaccacuccauucggacagcaacgagucuuuaaagaaaagguugacacaagaacccccaggaguaugccggguacacggcgcgugaugggcauuacugccgagugguuauggagaacccuggggaggaauaaaaagccucgauugugcacgcgggaggaauucaccaagaaaguacguacaaacgcagccaugggagcuguguuuacugaggaaaaucagugggauucugccaaggcggcagucgaggacgaagauuucuggaaacucguggacagagagcgcgagcugcacaagcuaggcaaaugugguagcugcguuuacaacaugauggggaagagggaaaaaaagcuuggagaguuuggcaaggccaaaggcucacgggcuaucugguauauguggcugggggccagauaccucgaauucgaggcacugggauuuuugaaugaggaucauugguucucccgcgaaaacaguuacagcgguguggagggcgaagggcugcacaagcucggauauauacuuagggacaucucuaaaauucccggcggugcuauguacgccgaugacaccgcugggugggacacacgaaucacugaggaugaccugcacaaugaagagaagauuacccagcagauggauccagagcaucggcaauuagccaacgcaaucuuuaaacugacguaucagaauaaggucgugaagguacagagaccuacacccaccggaacuguuauggacauaauuuccaggaaagaucagcgcggcucaggccaaguggggacauacggauugaacaccuucacuaauauggaagcgcagcucauccgucagauggagggugaaggcguccugagcaaggccgaccuagagaacccacaccuucccgaaaaaaagaucacccaguggcuggagacaaaagggguggagcggcucaagagaauggcuauuucgggagaugacugcguggucaagccuauagaugacagguuugccaacgcacuguuggcuuuaaaugauaugggcaaaguucgcaaggacaucccacaauggcagccgucuaaagguuggcaugauuggcagcaggugcccuucuguagucaccacuuccaugaacugauuaugaaggacgggcgaaaacucguagugccuugccggccacaagacgagcuuaucggaagagccaggauuucccagggcgcaggcuggagccugaaggaaacggccugucuagggaaggcguaugcucagauguggucacugauguacuuucaccgcagagaucuccgguuggccuccaacgcaaucugcucugccguccccgugcauuggguuccuaccagcaggacuacauggaguauacacgcucaucaccaauggaugaccacugaggacaugcugacaguguggaaucgugucuggaucgaagauaacccauggauggaggacaaaacccccgugacgacaugggagaauguaccuuaucuuggaaagcgagaagaucaguggugugguucccugauuggccucaccagccgcgccacuugggcacagaacaucccgaccgcuauucagcaaguuagaucuuuaaucgggaaugaggaauuccuggacuacaugccaucaaugaaacgguuuaggaaggaggaggaaagugagggagccauuugguga

SEQ ID NO: 15304 - RNA, 9873 nt, Artificial Sequence
  derived and/or modified CDS sequence (opt3) from DENV-3__HQ705609__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucgugaauuggaaagggaaggagcugaagugcggauccggcaucuucgugacaaacgagguccauaccuggacugaacaguacaaauuucaagcagauucucccaagcggcuagccaccgcuauugccggugcaugggagaauggcguuugugggauccgaagcacaacgcgcauggaaaaccuccuguggaaacagauagcuaaugagcuuaacuauaucuugugggaaaauaacauuaagcugaccguggugguaggagacaucauuggcguccucgagcaggggaaaagaacucugacaccacagccuaaggaguuaaaauacucauggaagaccuggggaaaggccaaaaucgugacagcggaaacucaaaacaguuccuucauaauugauggccccaauaccccagagugccccagcguuucuagggccuggaacgugugggaagucgaggacuaugguuuugggguguucacgacaaauaucuggcugaagcuucgggaaguuuacacccaguugugugaccaccgccucaugucagcugcagugaaagaugagagagccguacacgcugacaugggauacuggauugagagucagaagaacggcagcuggaaacuggaaaaggccucccuaaucgaggucaagacuugcaccuggccuaaaucucauacacuguggucgaauggugugcucgaaagcgauaugauaaucccaaagucccuggcaggcccgauuucacagcacaaccauaggcccggguaucacacucaaaccgcgggaccuuggcaccuuggcaaauuggagcuggacuuuaauuacugcgaggggacaacgguggucaucaccgaaaacuguggaacucguggcccaaguuuacggacaaccacuguuucugguaagcucauucaugaguggugcugucgaagcugcacacugcccccucuuagauauaugggggaagauggauguugguacggcauggagaucaggccaauauccgaaaaagaggagaauauggugaagucacugguaagcgccgguucuggcaagguggacaacuucaccaugggggucuugugccucgcuauucuguuugaagaggugaugcgcggaaaauucggcaagaaacacaugaucgccgggguuuucuuuacguucgugcuacugcucuccggacagaucacuuggcgggauauggcacauacccugauuaugaucggcaguaaugcuagcgacagaauggguaugggggucacauaucuugccuugauugcaaccuuuaagauacagcccuuccuggccuuaggauuuuuccucaggaaacugacuucucgcgaaaaccuucugcuaggcgugggccucgcuauggcgacaacccugcaauugccggaggauaucgaacagauggccaaugggauugcacugggauuaauggcucucaagcugaucacacaguuugagacuuaccagcuuuggaccgcccugauuuccuugacguguucaaacacaaucuucacccucacuguugccuggcgaaccgcuacacugauacuagcaggugugagucugcuuccugucugccaaagcucguccaugcggaagacugacuggcucccaauggccguagcggcuaugggcgugcccccucugcccuuguuuaucuucucucugaaagauaccuuaaagcguagaagcuggccacucaaugaggggguuauggccgugggacuggucucaauucuugcaaguucccuguugaggaacgacgugccuauggccggcccccucguagcuggugggcugcuaaucgcauguuaugugauuacgggaacaucugccgaucugaccgucgaaaaagcggcugacaucacuugggaggaagaggccgaacagacaggcguuagccacaaccuuaugauaaccguggacgaugacggcacuaugcgcauuaaggaugacgagacagagaauauccucaccgugcuguugaaaacggcauuacugaucgucuccgggauuuuuccauacucaauaccggccacucuccugguguggcauaccuggcagaagcagacacaacggagcggaguucuuugggauguaccuagucccccagaaacccagaaagcugagcuggaagaggguguguacagaaucaagcagcagggcauuuucgggaagacacaagucggagugggcguucagaaagaggguguguuucacacuauguggcacgucaccaggggggccguguugacguauaacggaaagcgacuagaacccaauugggcaucuguaaaaaaggaccugaucuccuacggcggcggguggcgccucagcgcucaguggcaaaaaggagaggaaguccaggugauugccguugagccugguaagaacccaaagaauuuccagacaaugcccggcacuuuccagaccacaaccggggaaaucggagcgauagcccuggauuuuaaaccuggcacuucggguucaccgaucauuaaccgggaggggaagguggucggacuuuauggcaauggcgugguuaccaaaaacgggggauacgugucugguaucgcacaaacaaaugcugagccagacggccccacgccugaauuagaggaagagauguucaagaaaagaaaccugacuauuauggaucuccauccagggaguggaaagaccaggaaguauuugcccgccaucguccgugaagcuauaaaacgccggcugagaacacucauucuggcaccuaccagggugguagccgccgagauggaggaagcucuuaagggccugccgauccgauaccagacuacagcgaccaaauccgagcacacgggucgggaaaucguggacuugaugugccaugcaacuuuuacaaugcgccuacugagccccguuagagucccaaauuauaaccucauuaucauggaugaggcccacuucaccgacccugcuucuauagccgcaaggggguacauuagcacccgggugggaaugggcgaagccgcugcgaucuuuaugacugccacacccccaggcaccgcagaugcuuucccucaguccaaugcccccauucaggacgaggagcgagacaucccagaaagaucauggaacagugggaaugaguggauaacagauuuugcaggaaagacugugugguucgucccgagcauuaaagccgguaacgacaucgcuaacuguuuacgcaagaauggcaagaaaguaauccaacugucuaggaagacguuugauaccgaauaccagaaaacaaagcuuaacgacugggauuucgugguuacuaccgacauuuccgagaugggggccaauuuuaaagcggaucgugugaucgacccucggagaugccugaagcccgucauucucacagauggaccagagagggugauauuggcaggccccaugccuguuaccgccgcuucagccgcucagcgccgagguagaguggggcggaacccacagaaggaaaaugaccaauauaucuucacuggccagccccugaacaaugaugaggaccaugcacacuggacggaagccaaaaugcuccuggacaacauuaauaccccugagggaaucaucccggcucuuuucgaaccagagagggagaagagugccgcaauugauggcgaauaccgccuaaaaggggagagccguaagacauuugucgaacugaugagacggggagacuugcccgugugguuagcgcacaaaguagccuccgaggguauaaaguauacugauaggaaauggugcuucgacggccagcgcaacaaucagauccuggaagagaacauggauguggagauuuggaccaaggaaggggagaagaaaaagcuccgaccuagauggcuggacgcucggacauacucugauccccuugcccugaaagaauuuaaggaguucgcagcuggaaggaaaucgaucgcccucgacuugguuaccgaaauuggccgcgucccaagccaucuggcacacagaacuaggaaugcccuagauaaccuggugaugcuccauacaucagagcacggugggcgggcuuaucgucacgcgguggaggaacuuccugagacgauggaaacccuguuauugcugggccucaugauccugcuuacuggaggcgccaugcuguuucucauauccgggaagggaaucgguaagacaaguauuggcuugaucugugucauugcaucuagcgggaugcuguggauggcugagauccccuuacaauggauagccuccgccauuguucuagaguucuuuaugauggugcugcucaucccagaaccugagaaacagcgcaccccgcaggacaaucaacuugcauacguagugauuggaauccugaccuuggcugccauaaucgcggcuaacgaaaugggccugcucgagacaacuaagcgagaucuggguaugucaaaagaacccggggucgugucuccaacgagcuaucuugacguugaucuccauccugccagugcauggacccuguacgccguggcuacaacugucauuacccccauguugagacacacaaucgagaauuccaccgcaaacguaagccuggccgcgauugcuaaccaggccgugguuuuaaugggccuagacaagggauggccaaucucuaaaauggaccugggcgugccucuccuugcacuggggugcuacucacaggucaaucccuugacucugacggccgcugugcuccugcuuauaacacauuaugccauuaucggaccgggcuuacaggcaaaggcuaccagggaggcccaaaagcggacugcggccgguaucaugaaaaacccaaccgucgaugggauuaugacaaucgaccuggauccugugauauacgacuccaaguucgaaaaacagcucggacagguuauguugcuggugcuaugugcaguacagcugcuccuuaugcgcacuaguugggcucugugcgaggccuugacccuggcaacaggccccauuacgacccucugggaagguagcccaggcaaguuuuggaauacuacaaucgcugugucgauggccaacauuuucagagggucuuaucuggccggagcgggcuuagcuuuuuccaucaugaaaagcgucgggaccggaaagaggggcacugguucacaaggggagacacuuggagaaaaguggaaaaagaaacugaaucagcucagucggaaggauuucgaccuauacaaaaagucuggcauaaccgagguugaucgaacggaggcaaaagaaggucugaagagaggcgagaucacccaccaugccgugucccgcgggagcgcuaaguugcagugguuugucgaaaggaacauggugauucccgagggacggguaaucgaccugggcugugggcguggaggcuggucauauuacugcgccggucucaaaaaggugacagaaguuagaggguauacuaaaggaggcccuggccacgaggagccggugcccaugaguaccuacggguggaauauugucaagcuuaugagcggaaaagauguguucuaccugccaccugaaaagugugacacauugcugugcgauaucggugaguccucucccagcccuauugucgaagaguccaggacuauccgcgugcucaagaugguugagccaugguuaaaaaacaaucaguucuguauaaagguacugaaccccuauaugccuaccgugauugaacaccuugagcggcugcaacgaaaacauggcgggaugcuagucagaaauccacucucaaggaacucuacacacgaaauguacuggaucaguaauggaaccggcaacaucguggcaucgguuaauauggugagccgccuguugcugaaccgguuuacuaugacgcauagacgucccacaauugagaaggacgucgaucucggugccgggaccaggcacgugaacgcugaaccggagacuccuaauauggacguaauaggagagcggaucaaacgcauuaaggaagagcacaacuccaccuggcauuaugacgaugaaaauccauacaagacaugggcguaucacggcucuuacgaggugaaagccacgggcucagcaagcuccaugaucaacgggguugucaagcuucugaccaaacccugggacguggugccuauggucacucagauggcuaugacagauaccacuccauucggacagcaacgaguuuuuagagaaaagguggacacaaggaccccccggaguaugccggguacacgcagaguaaugggcauuacugccgagugguuauggaggacccuggggcgaaauaaaaagccucgguugugcacgcgugaggaauucaccaagaaagugagaacaaacgcagccaugggagcugucuuuacugaggaaaaucagugggauucugccaaggcggcaguggaggacgaagauuucuggaaacucguugaccgcgagagggagcugcauaagcuaggcaaaugugguagcugcguguauaacaugauggggaagcgggaaaaaaagcuuggagaguuuggcaaggccaaaggcucaagagcuaucugguacauguggcugggggcccgcuaccucgaauucgaggcacugggauuuuugaaugaggaucacugguucuccagggaaaacaguuauagcggugucgagggcgaagggcugcauaagcucggauacauacuucgagacaucucuaaaauucccggcggugcuauguaugccgaugacaccgcugggugggacacacggaucacugaggaugaccugcacaaugaagagaagauuacccagcagauggauccagagcacagacaauuagccaacgcaaucuuuaaacugacguaccagaauaaggugguaaagguucagaggccuacacccaccggaacugugauggacauaauuucccgcaaagaucagcguggcucaggccaagucgggacauauggauugaacaccuucacuaauauggaagcgcagcucauccggcagauggagggugaaggcgugcugagcaaggccgaccuagagaacccacaucuucccgaaaaaaagaucacccaguggcuggagacaaaagggguggagagacucaagaggauggcuauuucgggagaugacugcgucguuaagccuauagaugaccgcuuugccaacgcacuguuggcuuuaaaugauaugggcaaagugcgaaaggacaucccacaauggcagccgucuaaagguuggcacgauuggcagcagguacccuucuguagucaucacuuccacgaacugauuaugaaggacgggcggaaacucguggucccuugcagaccacaagacgagcuuaucggaagggcccgcauuucccagggcgcaggcuggagccugaaggaaacggccugucuagggaaggcguacgcucagauguggucacugauguauuuucauagacgggaucucagguuggccuccaacgcaaucugcucugccgugcccguucacugggugccuaccagccguacuacauggaguauacaugcucaccaucaauggaugaccacugaggacaugcugacagucuggaaucgaguguggaucgaagauaacccauggauggaggacaaaacccccguaacgacaugggagaauguuccuuaccuuggaaagcgcgaagaucaguggugugguucccugauuggccucaccagcagagccacuugggcacagaacaucccgaccgcuauucagcaagugcggucuuuaaucgggaaugaggaauuccuggacuacaugccaucaaugaaaagguuucgcaaggaggaggaaagugagggagccauuugguga

SEQ ID NO: 15305 - RNA, 9873 nt, Artificial Sequence
  derived and/or modified CDS sequence (opt3) from DENV-3__HQ705610__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacaaucuggucgaaugguguccuggaaagcgauaugauuaucccaaaaucccucgcaggcccgauuucacagcacaaccauaggcccggguaucacacucaaaccgcgggaccuuggcaccugggcaagcuugaguuggacuuuaauuacugcgaggggacaacgguggugaucaccgaaaacuguggaacucguggcccaagucugcggacaaccacugucucugguaaauuaauacaugaguggugcugucgaagcugcacacuccccccucugagauauaugggggaagauggauguugguacggcauggagauuaggccaaucuccgaaaaggaggagaauaugguuaaaucacuugugagcgccgguucuggcaagguagacaacuucaccaugggggugcugugcuuggcuauccucuuugaagaggucaugcgcggaaaguucggcaaaaagcacaugauugccgggguguuccugacguuuguucuacugcucuccggacagaucacuuggaaagauauggcacauacccugauuaugauaggcaguaaugcuagcgaccggauggguaugggggugacauaucuugccuugaucgcaaccuucaagauucagcccuuucuggccuuaggauucuuucucagaaaacugacuucuagggaaaaccuucugcuaggcgucggccucgcuauggcgacaacccugcaauugccggaggauaucgaacagauggccaaugggauugcacugggauuaauggcucucaagcugaucacacaguucgagacuuaccagcuuuggaccgcccugauauccuugacguguucaaacacaaucaguacccucacuguggccuggcgcaccgcuacacugauucuagcagguguuagccugcuuccugugugccaaucguccucuaugcgaaagacugacuggcucccaauggccgucgcggcuaugggcguacccccucugcccuuguuuaucuucagccugaaagauaccuuaaagcggcguucauggccacucaaugagggggugauggccguuggacuggugaguauucuugcauccucucuguugagaaacgacgucccuauggccggcccccucguggcuggugggcugcuaaucgcauguuauguaauaacgggaacaagcgccgaucugaccguggaaaaagcggcugacauuacuugggaggaagaggccgaacagacaggcgucucccacaaccuuaugaucaccguugacgaugacggcacuaugaggaucaaggaugacgagacagagaauauucucaccgugcuguugaaaacggcauuacugauagugucagggaucuuuccauacagcauuccggccacucuccuggucuggcauaccuggcagaagcagacacaacgcaguggagugcuuugggauguuccuucucccccagaaacccagaaagcugagcuggaagaggguguauaccggaucaagcagcagggcauuuucgggaagacacaagugggagucggcgugcagaaagaggguguuuuucacacuauguggcacgugaccagaggggccgucuugacguauaacggaaagaggcuagaacccaauugggcauccgugaaaaaggaccugaucagcuacggcggcggguggcgacucucggcucaguggcaaaaaggagaggaaguacaggucauagccguggagccugguaagaacccaaagaauuuccagacaaugcccggcacuuuucagaccacaaccggggaaaucggagcgauugcccuggauuucaaaccuggcacuucagguucuccgaucauuaaccgcgaggggaagguugugggacuuuauggcaauggcgucgugaccaaaaacgggggauacguuagugguaucgcacaaacaaaugcugagccagacggccccacgccugaauuagaggaagagauguucaagaaacggaaccugacuauaauggaucuccauccaggguccggaaagaccagaaaguauuugcccgccauugugagggaagcuaucaaacgucgccugcggacacucauccuggcaccuaccagagucguggccgccgagauggaggaagcucuuaagggccugccgauuagguaccagacuacagcgaccaaaagcgagcacacgggucgagaaaucguagacuugaugugccaugcaacuuuuacaaugcggcuacugucucccgugcgcguuccaaauuauaaccucauaauuauggaugaggcccacuucaccgacccugcuagcaucgccgcaagaggguacauuuccaccagggucggaaugggcgaagccgcugcgaucuuuaugacugccacacccccaggcaccgcagaugcuuucccucagucaaaugcccccauacaggacgaggagcgggacauuccagaacgaaguuggaacagcgggaaugaguggaucacagauuuugcaggaaagacugugugguucgugccgucuaucaaagccgguaacgacauugcuaacuguuuaagaaagaauggcaagaaagucauccaacugucccgcaagacguuugauaccgaauaccagaaaacaaagcuuaacgacugggauuucguagugacuaccgacauuucagagaugggggccaauuuuaaagcggauaggguuauagacccucgucggugccugaagcccgugauccucacagauggaccagagagagucauuuuggcaggccccaugccugugaccgccgcuagugccgcucagaggcgcggucgaguugggagaaacccacagaaggaaaaugaccaauauaucuucacuggccagccccugaacaaugaugaggaccaugcacacuggacggaagccaaaaugcuccuggacaacaucaauaccccugagggaauuauaccggcucuuuuugaaccagagcgggagaagagcgccgcaaucgauggcgaauacaggcuaaaaggggagucccgcaagacauucguggaacugaugcguagaggagacuugcccgucugguuagcgcacaaaguggccucugaggguauuaaguauacugaucggaaauggugcuucgacggccagaggaacaaucagauccuggaagagaacauggauguagagauuuggaccaaggaaggggagaagaaaaagcuccgcccucgauggcuggacgcuagaacauacucggauccccuugcccugaaagaauuuaaggaguucgcagcuggacggaaaagcaucgcccucgacuuggugaccgaaauaggcaggguuccaucacaucuggcacaccgcacuagaaaugcccuagauaaccuggucaugcuccauacauccgagcacggugggagggcuuaucggcacgcgguggaggaacuuccugagacgauggaaacccuguuauugcugggccucaugauccugcuuacuggaggcgccaugcuguuucucauuagugggaagggaaucgguaagacaucuauuggcuugaucugugugauagcaagcuccgggaugcuguggauggcugagauucccuuacaauggaucgccucagccauuguccuagaguucuuuaugaugguucugcucaucccagaaccugagaaacagcguaccccgcaggacaaucaacuugcauacgugguaauaggaauccugaccuuggcugccauuaucgcggcuaacgaaaugggccugcucgagacaacuaagcgcgaucuggguaugucuaaagaacccgggguggucagcccaacgaguuaucuugacguggaucuccauccugccuccgcauggacccuguacgccguugcuacaacugugauuacccccauguugcgacacacaaucgagaauagcaccgcaaacgucucucuggccgcgauagcuaaccaggccguaguguuaaugggccuagacaagggauggccaauuucaaaaauggaccugggcguuccucuccuugcacuggggugcuacucccaggugaaucccuugacucugacggccgcuguccuccugcuuaucacacauuaugccaucauuggaccgggcuuacaggcaaaggcuaccagagaggcccaaaagaggacugcggccgguaucaugaaaaacccaaccguggaugggauaaugacaauugaccuggauccugucaucuacgacaguaaguucgaaaaacagcucggacaggugauguugcugguucuaugugugguacagcugcuccuuaugcggacuagcugggcacugugcgaggcuuugacccuggccacaggccccauuacgacccucugggaagguucgccaggcaaguuuuggaauacuacaaucgcagugucuauggcuaacauauuccgcggguccuaucuggccggagccggcuuagcguuuagcaucaugaaaucagucgggaccggaaagagaggcacugguagucaaggggagacacuuggagaaaaguggaaaaagaaacugaaucagcucucuaggaaggauuucgaccuauacaaaaaguccggcauuaccgagguugaucggacggaggcuaaagaaggucugaagcgaggcgagaucacccaccaugcagugagcagagggucagccaaguugcagugguuugucgaacgcaacauggugauucccgagggaaggguaaucgaccugggcugugggcggggaggcuggaguuauuacugcgcuggucucaaaaaggugacagaaguucguggguauacuaaaggaggcccuggccacgaggagccggugcccaugagcaccuacggguggaauauugucaagcuuauguccggaaaagauguguucuaccugccaccugaaaagugugacacauugcugugcgauaucggugagucuagccccuccccuacugucgaagagucaagaaccauaagggugcucaagaugguugagccaugguuaaaaaacaaucaguuuuguauuaagguacugaaccccuauaugccuacagugaucgaacaccuugagcgccugcaacggaaacauggcgggaugcuaguccgaaauccacucucuagaaacaguacccacgaaauguacuggaucucgaauggaacuggcaacauuguggccagcguuaauaugguguccaggcuguugcugaaccgcuucacgaugacacaucggagacccaccauagagaaggacgucgaucucggugcagggacucgucacgugaacgccgaaccggagaccccuaauauggacguaaucggagagaggauuaaacggaucaaggaagagcacaacucuacauggcauuaugacgaugaaaauccauacaagacgugggcuuaucacggcucauacgaggugaaagcgaccggcagcgccuccaguaugauuaacgggguugucaagcuucugacuaaacccugggacguggugccuauggucacacagauggcaaugaccgauacuacaccauucggacagcaacgcguuuuuaaggaaaaaguggacacccgaacacccagaucuaugccggguacuaggcggguaaugggcaucaccgcugagugguuauggcgcacgcuggggagaaauaagaagccuagguugugcacccgagaggaauucacaaaaaaggugcggacuaacgccgcaaugggagccgucuuuaccgaggaaaaucagugggauagcgcuaaagccgcgguggaggacgaagauuucuggaagcucguugaccgugagagagagcugcauaaacuaggcaagugugguucaugcguguauaacaugauggggaaacgcgaaaagaagcuuggagaguuuggcaaagcaaagggcuccagggccauaugguacauguggcugggggcucgguaccucgaauucgaggcccugggauuuuugaaugaggaucacugguucaguagagaaaacagcuauucuggugucgagggcgaagggcugcauaaacucggauacauccuucgcgacauuuccaagauccccggcggugcaauguaugcugaugacacagccgggugggacacuaggauuaccgaggaugaccugcacaaugaagagaaaaucacgcagcagauggauccagagcaccgacaauuagcuaacgccauauuuaagcugacauaccagaauaaggugguaaaaguucagcggccuacccccacuggaacagugauggacauuaucucaagaaaggaucagaggggcagcggccaagucgggaccuauggauugaacacuuucaccaauauggaagcacagcucauccgccagauggagggugaaggcgugcugucgaaagcggaccuagagaacccacaucuucccgaaaagaaaauuacacaguggcuggagacgaaggggguggagcgucucaagcggauggccauaucuggagaugacugcgucguuaaaccuaucgaugacagauuugcuaacgcccuguuggcauuaaaugauaugggcaaggugaggaaagacauuccacaauggcagccgaguaaggguuggcacgauuggcagcagguacccuucuguucccaucacuuucacgaacugaucaugaaagacgggcgcaagcucguggucccuugccgaccacaagacgagcuuauuggacgggcuagaaucagccagggcgccggcuggucacugaaggaaaccgcaugucuagggaaagccuacgcgcagauguggucccugauguauuuccauaggcgcgaucucagauuggcuucuaacgccauaugcagcgcagugcccguucacugggugccuacuagucggacaaccugguccauccaugcccaccaucaauggaugacuacagaggacaugcugaccgucuggaauaggguguggauugaagauaacccauggauggaggacaagacgcccguaacaaccugggagaauguuccuuaccuuggaaaacgugaagaucaguggugugguagccugaucggccucacuucucgagcuaccugggcccagaacauuccgacagcaauccagcaagugcgcucauuaauugggaaugaggaauuccuggacuacaugccaaguaugaagagauuucggaaagaggaggaauccgagggagcuauaugguga

SEQ ID NO: 15306 - RNA, 9873 nt, Artificial Sequence
  derived and/or modified CDS sequence (opt3) from DENV-3__HQ705611__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauaugggggaagauggauguugguacggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcacaugaucgccgggguguucuuuacguucguucuacugcucuccggacagauuacuuggcgggauauggcacauacccugaucaugauuggcaguaaugcuagcgacagaauggguaugggggugacauaucuugccuugauagcaaccuuuaaaauccagcccuuccuggccuuaggauuuuuccucaggaagcugacuucucgcgaaaaccuucugcuaggcgucggccucgcuauggcgacaacccugcaauugccggaggauauugaacagauggccaaugggaucgcacugggauuaauggcucucaaacugauuacacaguuugagacuuaccagcuuuggaccgcccugaucuccuugacguguucaaacacaauauucacccucacuguggccuggcgaaccgcuacacugauccuagcagguguuagucugcuuccugugugccaaagcucguccaugcggaagacugacuggcucccaauggccgucgcggcuaugggcguacccccucugcccuuguuuauuuucgggcugaaggauaccuuaaaacguagaucuuggccacucaaugagggagugauggccguuggccuggugagcauccuugcaucaagucuguugaggaacgacgucccuauggccgguccccucguggcugggggacugcuaauugcauguuauguaaucacgggcacauccgccgaucugaccguggaaaaggcggcugacauaacuugggaggaagaggccgaacagacaggcgucucucacaaccuuaugauuaccguugacgaugacgggacuaugcgcaucaaagaugacgagacagagaauauccucaccgugcuguugaagacggcauuacugauugugagcggaauauuuccauacuccaucccggccacucuccuggucuggcauaccuggcagaaacagacacaacggucaggugugcuuugggauguuccuagccccccagaaacccagaaggcugagcuggaagagggcguauacagaauuaaacagcaggggaucuucggaaagacacaagugggcgucggugugcagaaggaggggguuuuucacacuauguggcacgugaccaggggagccgucuugacguauaacggcaaacgacuagaacccaauugggcaagugugaagaaagaccugauuucuuacggcgggggauggcgccucuccgcucaguggcaaaagggugaggaaguacaggucaucgccguggagccuggcaaaaacccaaagaauuuccagacaaugcccgggacuuuccagaccacaaccggagaaauaggcgcgaucgcccuggauuuuaagccugguacuagcgggucgccgauuaucaaccgggagggaaaaguugugggccuuuauggcaauggggucgugaccaagaacggagguuacguuucaggcauugcacaaacaaaugcugagccagacgggcccacgccugaauuagaggaagagauguucaaaaagagaaaccugacuaucauggaucuccauccaggaucuggcaaaaccaggaaguauuugcccgccauagugcgugaagcuauuaagcgccggcugagaacacucauccuggcaccuaccagggucguggccgccgagauggaggaagcucuuaaaggucugccgauccgauaccagacuacagcgaccaagagugagcacacggggcgggaaauuguagacuugaugugccaugcaacuuuuacaaugcgccuacugucccccgugagaguuccaaauuauaaccucaucauaauggaugaggcccacuucaccgacccugcuagcauugccgcaaggggauacaucucuacccgggucggcaugggcgaagccgcugcgauuuuuaugacugccacacccccagggaccgcagaugcuuucccucagagcaaugcccccauccaggacgaggagcgagacauaccagaaagauccuggaacucaggaaaugaguggauuacagauuuugcagguaaaacugugugguucgugccgaguaucaaggccggcaacgacaucgcuaacuguuuacgcaaaaaugggaagaaggucauucaacugagcaggaaaacguuugauaccgaauaccagaagacaaaacuuaacgacugggauuucguagugacuaccgacaucucugagaugggagccaauuuuaaggcggaucguguuauugacccucggagaugccugaaacccgugauacucacagauggcccagagagggucaucuuggcaggucccaugccugugaccgccgcuuccgccgcucagcgccgagggagaguuggccggaacccacagaaggaaaaugaccaauauauuuucacuggacagccccugaacaaugaugaggaccaugcacacuggacggaagccaagaugcuccuggacaacaucaauaccccugagggcaucauuccggcucuuuucgaaccagagagggagaaaucagccgcaauagauggggaauaccgccuaaagggagagagucguaaaacauuuguggaacugaugagacggggugacuugcccgucugguuagcgcacaagguggccagcgagggcaucaaauauacugauaggaaguggugcuucgacgggcagcgcaacaaucagauucuggaagagaacauggauguagagaucuggaccaaagaaggagagaagaagaaacuccgaccuagauggcuggacgcucggacauacuccgauccccuugcccugaaggaauuuaaagaguucgcagcuggcaggaagucuauugcccucgacuuggugaccgaaaucggucgcguuccaucgcaucuggcacacagaacuaggaaugcccuagauaaccuggucaugcuccauacaagcgagcacgggggccgggcuuaucgucacgcgguggaggaacuuccugagacgauggaaacccuguuauugcugggacucaugauacugcuuacuggcggggccaugcuguuucucaucucaggaaaagguauuggcaagacauccaucggguugauuugugugaucgcaaguucuggaaugcuguggauggcugagauacccuuacaauggauugccagcgccaucguccuagaguucuuuaugaugguucugcucauuccagaaccugagaagcagcgcaccccgcaggacaaucaacuugcauacgugguaaucggcauacugaccuuggcugccaucauugcggcuaacgaaaugggucugcucgagacaacuaaacgagaucuggggauguccaaggaacccggcguggucucaccaacgucuuaucuugacguggaucuccauccugccagcgcauggacccuguacgccguugcuacaacugugaucacccccauguugagacacacaauugagaauaguaccgcaaacgucucccuggccgcgaucgcuaaccaggccguaguguuaaugggacuagacaaaggcuggccaauaagcaagauggaccuggggguuccucuccuugcacugggaugcuacucucaggugaaucccuugacucugacggccgcuguccuccugcuuauuacacauuaugccaucaucggcccggguuuacaggcaaaagcuaccagggaggcccaaaagcggacugcggccgggauuaugaagaacccaaccguggauggaaucaugacaauagaccuggauccugucauuuacgacucaaaauucgaaaagcagcucggccaggugauguugcugguucuaugugcagugcagcugcuccuuaugcgcacuuccugggcucugugcgaggccuugacccuggcaacaggucccaucacgacccucugggaaggcaguccagggaaauuuuggaauacuacaauugcuguaagcauggccaacaucuucagaggaucguaucuggccggcgcgggguuagcuuuuucuauaaugaaguccgugggaaccggcaaaagggguacugggagccaaggagagacacuuggcgaaaaguggaagaaaaagcugaaucagcucucacggaaagauuucgaccuauacaagaaaagugguaucaccgaggucgaucgaacggaggcaaaggaaggccugaaaagaggggagauuacccaccaugccguuucucgcggauccgcuaaguugcagugguuuguggaaaggaacauggucauccccgagggccgggugauugaccugggguguggacguggcgguuggagcuauuacugcgccgggcucaagaaaguaacagaagugagaggauauacuaagggcggcccugggcacgaggagccgguucccaugucaaccuacggauggaauaucgugaaacuuaugagugguaaggaugucuucuaccugccaccugaaaaaugugacacauugcugugcgauauuggcgagagcucccccucuccuacuguggaagagagcaggaccauccgcguccucaagaugguggagccaugguuaaagaacaaucaguucuguauaaaaguucugaaccccuauaugccuacaguaauugaacaccuugagcggcugcaacgaaagcaugggggaaugcuagugagaaauccacucuccaggaacucaacccacgaaauguacuggaucucuaauggcacugguaacaucgucgcaagugugaauaugguuucgcgccuguugcugaaccgguuuacgaugacacauagacgucccaccauugagaaagacguggaucucggggccggaacuaggcacgucaacgcugaaccggagaccccuaauauggacgugauaggcgagcggaucaagaaaauuaaggaagagcacaacagcacauggcauuaugacgaugaaaauccauacaagacgugggcguaucacggcuccuacgagguaaaagccaccgggucugcaucaagcaugaucaacggagugguuaagcuucugacuaaacccugggacgucgugccuauggugacacagauggcuaugaccgauacuacaccauucggucagcaacgcgucuuuaaggaaaaaguugacacccgaacacccagauccaugccgggcacuaggcgggugauggggauuaccgccgagugguuauggcgcacgcugggaagaaauaagaagccuagguugugcacccgagaggaauucacaaaaaagguacggacuaacgcagccaugggcgcuguguuuaccgaggaaaaucagugggauagugccaaagcggcagucgaggacgaagauuucuggaagcucguggaccgugagagagagcugcauaaacuagguaagugugggucuugcguuuauaacaugaugggaaaacgcgaaaagaagcuuggcgaguuuggcaaagccaaggggagcagggcuaucugguacauguggcugggagcccgguaccucgaauucgaggcacuggguuuuuugaaugaggaucacugguucucaagagaaaacuccuauaguggcguggagggggaaggacugcauaaacucggcuacauacuucgcgacaucagcaagauucccgguggggcuauguaugccgaugacacagcuggaugggacacuaggaucaccgaggaugaccugcacaaugaagagaaaauuacgcagcagauggauccagagcaccgacaauuagccaacgcaaucuuuaagcugacauaccagaauaaggucgugaaaguacagcggccuacccccacuggcacaguuauggacauaauuucuagaaaggaucagaggggcuccgggcaagugggaaccuaugguuugaacacuuucaccaauauggaagcgcagcucauccgccagauggagggcgaagggguccugucaaaagccgaccuagagaacccacaucuucccgaaaagaaaaucacacaguggcuggagacgaagggaguggagcgucucaagcggauggcuauuagcggcgaugacugcguggucaaaccuauagaugacagauuugccaacgcacuguuggcuuuaaaugauauggguaagguuaggaaagacaucccacaauggcagccgucgaagggguggcacgauuggcagcaggugcccuucuguucucaucacuuccacgaacugauuaugaaagacggacgcaagcucguagugccuugccgaccacaagacgagcuuaucggccgggccagaauuagucagggcgcaggguggucccugaaggaaaccgccugucuaggaaaagcguacgcucagauguggagccugauguauuuucauaggcgcgaucucagauuggccucaaacgcaaucugcuccgccguccccgugcacuggguuccuacuucucggacaaccuggagcauacaugcucaccaucaauggaugacuacagaggacaugcugaccguguggaauagggucuggaucgaagauaacccauggauggaggacaagacgcccgugacaaccugggagaauguaccuuaccuugguaaacgugaagaucagugguguggcagucugauugggcucacuucccgagccaccugggcacagaacaucccgacagcuauucagcaaguucgcagcuuaaucggaaaugaggaauuccuggacuacaugccaucuaugaagagauuucggaaagaggaggaaucagagggcgccauuugguga

SEQ ID NO: 15307 - RNA, 9873 nt, Artificial Sequence
  derived and/or modified CDS sequence (opt3) from DENV-3__HQ705612__SS-prME
accagccugugccucaugaugauccuucccgcagcucuggcauuccacuugacauccagagacggcgaaccuagaaugauuguggggaagaacgaacgggguaaaucuuuacuguuuaagacugccucagguauaaauauguguacgcuaaucgcgauggaucucggcgaaaugugcgacgauaccgucaccuacaaauguccacauauuacugaaguugaaccggaagacaucgauugcugguguaaccugaccaguacaugggugaccuaugggacuugcaaucaggcuggagaacaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucaaaauucagggggaacaagcauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacuaagaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauaugggggaagauggauguugguacggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcacaugaucgccgggguguucuuuacguucguucuacugcucuccggacagauuacuuggcgggauauggcacauacccugaucaugauuggcaguaaugcuagcgacagaauggguaugggggugacauaucuugccuugauagcaaccuuuaaaauccagcccuuccuggccuuaggauuuuuccucaggaagcugacuucucgcgaaaaccuucugcuaggcgucggccucgcuauggcgacaacccugcaauugccggaggauauugaacagauggccaaugggaucgcacugggauuaauggcucucaaacugauuacacaguuugagacuuaccagcuuuggaccgcccugaucuccuugacguguucaaacacaauauucacccucacuguggccuggcgaaccgcuacacugauccuagccgguguuagucugcuuccugugugccaaagcucguccaugcggaagacugacuggcucccaauggccgucgcggcuaugggcguacccccucugcccuuguuuauuuucgggcugaaggauaccuuaaaacguagaucuuggccacucaaugagggagugauggccguuggccuggugagcauccuugcaucaagucuguugaggaacgacgucccuauggccgguccccucguggcugggggacugcuaauugcauguuauguaaucacgggcacauccgccgaucugaccguggaaaaggcggcugacacuacaugggaggaagaggccgaacagaccggcgucucucacaaccuuaugauaacuguugacgaugacgggacaaugcgcauuaaagaugacgagaccgagaauauccucacggugcuguugaagacugcauuacugaucgugagcggaauuuuuccauacuccauaccggccacccuccuggucuggcauacauggcagaaacagacccaacggucaggugugcuuugggauguuccuagucccccagaaacacagaaggcugagcuggaagagggcguauacagaaucaaacagcaggggauuuucggaaagacucaagugggcgucggugugcagaaggaggggguuuuucacaccauguggcacgugacgaggggagccgucuugacacauaacggcaaacgacuagaacccaauugggcaagugugaagaaagaccugaucucuuauggcgggggauggcgccucuccgcucaguggcaaaagggugaggaaguacaggucauugccguggagccuggcaaaaacccaaagaauuuccagacuaugcccgggaccuuccagacaaccacuggagaaaucggcgcgauagcccuggauuuuaagccugguaccagcgggucgccgaucauuaaccgggagggaaaaguugugggccuuuacggcaauggggucgugacaaagaacggagguuauguuucaggcaucgcacaaacgaaugcugagccagacgggcccacuccugaauuagaggaagagauguucaaaaagagaaaccugaccauuauggaucuccacccaggaucuggcaaaacaaggaaguacuugcccgccaucgugcgugaagcuauaaagcgccggcugagaacccucauucuggcaccuacuagggucguggccgccgagauggaggaagcucuuaaaggucugccgauccgauaucagacaaccgcgacgaagagugagcauacugggcgggaaaucguagacuugaugugccacgcaacauuuaccaugcgccuacugucccccgugagaguuccaaauuacaaccucauuaucauggaugaggcccauuucaccgacccugcuagcauagccgcaaggggauauauuucuacucgggucggcaugggcgaagccgcugcgaucuuuaugacagccacacccccagggacagcagaugcuuucccucagagcaaugcccccauucaggacgaggagcgagacaucccagaaagauccuggaacucaggaaaugaguggauaacugauuuugcagguaaaacggugugguucgugccgaguauuaaggccggcaacgacaucgcuaacuguuuacgcaaaaaugggaagaaggucauccaacugagcaggaaaaccuuugauacagaauaccagaagacuaaacuuaacgacugggauuucguagugaccacagacauuucugagaugggagccaauuuuaaggcggaucguguuaucgacccucggagaugccugaaacccgugauucucaccgauggcccagagagggucauauuggcaggucccaugccugugacugccgcuuccgccgcucagcgccgagggagaguuggccggaacccacagaaggaaaaugaccaauacaucuucacgggacagccccugaacaaugaugaggaccacgcacacuggaccgaagccaagaugcuccuggacaacauuaauacaccugagggcaucaucccggcucuuuucgaaccagagagggagaaaucagccgcaauugauggggaauaucgccuaaagggagagagucguaaaacuuuuguggaacugaugagacggggugacuugcccgucugguuagcgcauaagguggccagcgagggcauaaaauacaccgauaggaaguggugcuucgacgggcagcgcaacaaucagauccuggaagagaacauggauguagagauuuggacaaaagaaggagagaagaagaaacuccgaccuagauggcuggacgcucggaccuauuccgauccccuugcccugaaggaauuuaaagaguucgcagcuggcaggaagucuaucgcccucgacuuggugacugaaauuggucgcguuccaucgcaccuggcacauagaacaaggaaugcccuagauaaccuggucaugcuccacacgagcgagcacgggggccgggcuuaccgucaugcgguggaggaacuuccugagaccauggaaacucuguuauugcugggacucaugauccugcuuacaggcggggccaugcuguuucucauaucaggaaaagguaucggcaagaccuccauuggguugaucugugugauugcaaguucuggaaugcuguggauggcugagauccccuuacaauggauagccagcgccauuguccuagaguucuuuaugaugguucugcucaucccagaaccugagaagcagcgcaccccgcaggacaaucaacuugcauaugugguaauuggcauccugacauuggcugccauaaucgcggcuaacgaaaugggucugcucgagacuacgaaacgagaucuggggauguccaaggaacccggcguggucucaccaaccucuuaccuugacguggaucuccacccugccagcgcauggacacuguaugccguugcuacuaccgugauuacacccauguugagacauaccaucgagaauaguacugcaaacgucucccuggccgcgauugcuaaccaggccguaguguuaaugggacuagacaaaggcuggccaaucagcaagauggaccuggggguuccucuccuugcacugggaugcuacucucaggugaaucccuugacgcugacagccgcuguccuccugcuuauaacccacuacgccauuaucggcccggguuuacaggcaaaagcuacuagggaggcccaaaagcggaccgcggccgggaucaugaagaacccaacaguggauggaauuaugacuaucgaccuggauccugucauauaugacucaaaauucgaaaagcagcucggccaggugauguugcugguucuaugugcagugcagcugcuccuuaugcgcaccuccugggcucugugcgaggccuugacacuggcaacgggucccauuaccacucucugggaaggcaguccagggaaauuuuggaauacaaccaucgcuguaagcauggccaacauuuucagaggaucguaccuggccggcgcgggguuagcuuuuucuaucaugaaguccgugggaacuggcaaaagggguacagggagccaaggagagacccuuggcgaaaaguggaagaaaaagcugaaucagcucucacggaaagauuucgaccuauauaagaaaagugguauaacggaggucgaucgaaccgaggcaaaggaaggccugaaaagaggggagaucacacaucacgccguuucucgcggauccgcuaaguugcagugguuuguggaaaggaacauggucauucccgagggccgggugaucgaccugggguguggacguggcgguuggagcuacuauugcgccgggcucaagaaaguaacugaagugagaggauacaccaagggcggcccugggcacgaggagccgguucccaugucaacauauggauggaauauugugaaacuuaugagugguaaggaugucuucuaccugccaccugaaaaaugugacacuuugcugugcgauaucggcgagagcucccccucuccuaccguggaagagagcaggacaauucgcguccucaagaugguggagccaugguuaaagaacaaucaguucuguaucaaaguucugaaccccuacaugccuaccguaauagaacaucuugagcggcugcaacgaaagcacgggggaaugcuagugagaaauccacucuccaggaacucaacucaugaaauguauuggauuucuaauggcacggguaacaucgucgcaagugugaauaugguuucgcgccuguugcugaaccgguuuacaaugacccacagacgucccacuaucgagaaagacguggaucucggggccggaaccaggcacgucaacgcugaaccggagacaccuaauauggacgugauuggcgagcggauaaagcgcaucaaagaagaacauaacagcacguggcacuacgacgaugaaaauccauauaagaccugggcguaccauggcuccuaugagguaaaggccacugggucugcaucaagcaugauuaacggagugguuaaacuucugacaaagcccugggacgucgugccuauggugacccagauggcuaugacugauacaaccccauucggucagcaacgagucuuuaaagaaaagguugacacaagaacucccagguccaugccgggcacccggcgcgugauggggaucacggccgagugguuauggagaacccugggaaggaauaaaaagccucgauugugcacacgggaggaguucacuaagaaaguacguaccaacgcagccaugggcgcuguguuuacagaggaaaaucagugggauagugccaaggcggcagucgaggacgaagauuucuggaaacucguggacagagagcgcgagcugcacaagcuagguaaaugugggucuugcguuuacaacaugaugggaaagagggagaagaaacuuggcgaguuuggcaaagccaaagggagccgggcuauuugguauauguggcugggagccagauaccucgaguucgaggcacugggauuuuugaaugaggaucauugguucucacgcgaaaacuccuacaguggcguggagggggaaggacugcacaagcucggcuauauccuuagggacauaagcaaaauccccgguggggcuauguacgccgaugacacugcuggaugggacacccgaauuacggaggaugaccugcacaaugaagagaagaucacacagcagauggauccagagcaucggcaauuagccaacgcaauuuuuaaacugaccuaucagaauaaggucgugaagguacagagaccuacucccacaggcaccguuauggacaucauaucuaggaaagaucagcgcggcuccgggcaagugggaacuuacgguuugaacaccuucacaaauauggaagcgcagcucauucgucagauggagggcgaagggguccugucaaaggccgaccuagagaacccacaccuucccgagaaaaagaucacgcaguggcuggagaccaaaggaguggagcggcucaagagaauggcuaucagcggcgaugacugcguggucaagccuauugaugacagguuugccaacgcacuguuggcuuuaaaugauauggguaaaguucgcaaggacauaccacaauggcagccgucgaaaggguggcaugauuggcaacaggugcccuucuguucucaccacuuccaugaacugaucaugaaggacggacgaaaacucguagugccuugccggccacaagacgagcuuauuggcagagccaggaucagucagggcgcaggguggucccugaaggaaacugccugucuaggaaaggcguaugcucagauguggagccugauguacuuucaccgcagagaucuccgguuggccucaaacgcaauuugcuccgccguccccgugcauuggguuccuacaucuaggaccacuuggagcauccacgcucaucaccaauggaugacaaccgaggacaugcugacgguguggaaucgugucuggauagaagauaacccauggauggaggacaaaacacccgugaccacuugggagaauguaccuuaucuugguaagcgagaagaucagugguguggcagucugaucgggcucaccucccgcgccacaugggcacagaacauuccgacugcuauccagcaaguuaggagcuuaauuggaaaugaggaguuccuggacuacaugccaucuaugaaacgguuuaggaaggaggaggaaucagagggcgccaucugguga

SEQ ID NO: 15308 - RNA, 9873 nt, Artificial Sequence
  derived and/or modified CDS sequence (opt3) from DENV-3__HQ705613__SS-prME
accagccugugccucaugaugauccuucccgcagcucuggcauuccacuugacauccagagacggcgaaccuagaaugauuguggggaagaacgaacggggaaaaucuuuacuguuuaagacugccucagguauaaauauguguacgcuaaucgcgauggaucucggcgaaaugugcgacgauaccgucaccuacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucaaaauucagggggaacaagcauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacuaagaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauaugggggaagauggauguugguacggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcacaugaucgccgggguguucuuuacguucguucuacugcucuccggacagauuacuuggcgggauauggcacauacccugaucaugauuggcaguaaugcuagcgacagaauggguaugggggugacauaucuugccuugauagcaaccuuuaaaauccagcccuuccuggccuuaggauuuuuccucaggaagcugacuucucgcgaaaaccuucugcuaggcgucggccucgcuauggcgacaacccugcaauugccggaggauauugaacagauggccaaugggaucgcacugggauuaauggcucucaaacugauuacacaguuugagacuuaccagcuuuggaccgcccugaucuccuugacguguucaaacacaauauucacccucacuguggccuggcgaaccgcuacacugauccuagccgguguuagucugcuuccugugugccaaagcucguccaugcggaagacugacuggcucccaauggccgucgcggcuaugggcguacccccucugcccuuguuuauuuucgggcugaaggauaccuuaaaacguagaucuuggccacucaaugagggagugauggccguuggccuggugagcauccuugcaucaagucuguugaggaacgacgucccuauggccgguccccucguggcugggggacugcuaauugcauguuauguaaucacgggcacauccgccgaucugaccguggaaaaggcggcugacauaacuugggaggaagaggccgaacagacaggcgucucucacaaccuuaugauuaccguugacgaugacgggacuaugcgcaucaaagaugacgagacagagaauauccucaccgugcuguugaagacggcauuacugauugugagcggaauauuuccauacuccaucccggccacucuccuggucuggcauaccuggcagaaacagacacaacggucaggugugcuuugggauguuccuagucccccagaaacccagaaggcugagcuggaagagggcguauacagaauuaaacagcaggggaucuucggaaagacacaagugggcgucggugugcagaaggaggggguuuuucacacuauguggcacgugaccaggggagccgucuugacguauaacggcaaacgacuagaacccaauugggcaagugugaagaaagaccugauuucuuacggcgggggauggcgccucuccgcucaguggcaaaagggugaggaaguacaggucaucgccguggagccuggcaaaaacccaaagaauuaucagacaaugcccgggacuuuccagaccacaaccggagaaauaggcgcgaucgcccuggauuucaagccugguacuagcgggucgccgauuaucaaccgggagggaaaaguugugggccuuuacggcaauggggucgugaccaagaacggagguuauguuucaggcauugcacaaacaaaugcugagccagacgggcccacgccugaauuagaggaagagauguuuaaaaagagaaaccugacuaucauggaucuccauccaggaucuggcaaaaccaggaaguacuugcccgccauagugcgugaagcuauuaagcgccggcugagaacacucauccuggcaccuaccagggucguggccgccgagauggaggaagcucuuaaaggucugccgauccgauaucagacuacagcgaccaagagugagcacacggggcgggaaauuguagacuugaugugccaugcaacuuucacaacccgccuacugucccccgugagaguuccaaauuacaaccucaucauaauggaugaggcccacuuuaccgacccugcuagcauugccgcaaggggauacaucucuacucgggucggcaugggcgaagccgcugcgauuuucaugacagccacacccccagggacagcagaugcuuuuccucagagcaaugcccccauccaggacgaggagcgagacauaccagaaagauccuggaacucaggaaaugaguggauuacugauuucgcagguaaaacggugugguuugugccgaguaucaaggccggcaacgacaucgcuaacuguuuacgcaaaaaugggaagaaggucauucaacugagcaggaaaaccuucgauacagaauaucagaagacuaaacuuaacgacugggauuuuguagugaccacagacaucucugagaugggagccaauuucaaggcggaucguguuauugacccucggagaugccugaaacccgugauacucaccgauggcccagagagggucaucuuggcaggucccaugccugugacugccgcuuccgccgcucagcgccgagggagaguuggccggaacccacagaaggaaaaugaccaauacauuuuuacgggacagccccugaacaaugaugaggaccaugcacacuggaccgaagccaagaugcuccuggacaacaucaauacaccugagggcaucauuccggcucuuuucgaaccagagagggagaaaucagccgcaauagauggggaauaucgccuaaagggagagagucguaaaacuuucguggaacugaugagacggggugacuugcccgucugguuagcgcacaagguggccagcgagggcaucaaauacaccgauaggaaguggugcuuugacgggcagcgcaacaaucagauucuggaagagaacauggauguagagaucuggacaaaagaaggagagaagaagaaacuccgaccuagauggcuggacgcucggaccuauuccgauccccuugcccugaaggaguucaaagaguuugcagcuggcaggaagucuauugcccucgacuuggugacugaaaucggucgcguuccaucgcaucuggcacacagaacaaggaaugcccuagauaaccuggucaugcuccauacgagcgagcacgggggccgggcuuaccgucacgcgguggaggaacuuccugagaccauggaaacucuguuauugcugggacucaugauacugcuuacaggcggggccaugcuguuccucaucucaggaaaagguauuggcaagaccuccaucggguugauuugugugaucgcaaguucuggaaugcuguggauggcugagauacccuuacaauggauugccagcgccaucguccuagaguuuuucaugaugguucugcucauuccagaaccugagaagcagcgcaccccgcaggacaaucaacuugcauaugugguaaucggcauacugacauuggcugccaucauugcggcuaacgaaaugggucugcucgagacuacgaaacgagaucuggggauguccaaggaacccggcguggucucaccaaccucuuaccuugacguggaucuccauccugccagcgcauggacacuguacgccguugcuacuaccgugaucacacccauguugagacacaccauugagaauaguacugcaaacgucucccuggccgcgaucgcuaaccaggccguaguguuaaugggacuagacaaaggcuggccaauaagcaagauggaccuggggguuccucuccuugcacugggaugcuauucucaggugaaucccuugacgcugacagccgcuguccuccugcuuauuacccauuacgccaucaucggcccggguuuacaggcaaaagcuacuagggaggcccaaaagcggaccgcggccgggauuaugaagaacccaacaguggauggaaucaugacuauagaccuggauccugucauuuaugacucaaaauuugaaaagcagcucggccaggugauguugcugguucuaugugcagugcagcugcuccuuaugcgcaccuccugggcucugugcgaggccuugacacuggcaacgggucccaucaccacucucugggaaggcaguccagggaaauucuggaauacaaccauugcuguaagcauggccaacaucuuuagaggaucguaccuggccggcgcgggguuagcuuucucuauaaugaaguccgugggaacuggcaaaagggguacagggagccaaggagagacccuuggcgaaaaguggaagaaaaagcugaaucagcucucacggaaagauuuugaccuauauaagaaaagugguaucacggaggucgaucgaaccgaggcaaaggaaggccugaaaagaggggagauuacacaccaugccguuucucgcggauccgcuaaguugcagugguucguggaaaggaacauggucauccccgagggccgggugauugaccugggguguggacguggcgguuggagcuacuauugcgccgggcucaagaaaguaacugaagugagaggauacaccaagggcggcccugggcacgaggagccgguucccaugucaacauacggauggaauaucgugaaacuuaugagugguaaggaugucuuuuaucugccaccugaaaaaugugacacuuugcugugcgauauuggcgagagcucccccucuccuaccguggaagagagcaggacaauccgcguccucaagaugguggagccaugguuaaagaacaaucaguucuguauaaaaguucugaaccccuacaugccuaccguaauugaacaccuugagcggcugcaacgaaagcaugggggaaugcuagugagaaauccacucuccaggaacucaacucacgaaauguauuggaucucuaauggcacggguaacaucgucgcaagugugaauaugguuucgcgccuguugcugaaccgguucacaaugacccauagacgucccacuauugagaaagacguggaucucggggccggaaccaggcacgucaacgcugaaccggagacaccuaauauggacgugauaggcgagcggaucaagcgcauuaaagaagaacacaacagcacguggcauuacgacgaugaaaauccauauaagaccugggcguaccacggcuccuaugagguaaaggccacugggucugcaucaagcaugaucaacggagugguuaaacuucugacaaagcccugggacgucgugccuauggugacccagauggcuaugacugauacaaccccauuuggucagcaacgagucuucaaagaaaagguugacacaagaacucccagguccaugccgggcacccggcgcgugauggggauuacggccgagugguuauggagaacccugggaaggaauaaaaagccucgauugugcacacgggaggaauuuacuaagaaaguacguaccaacgcagccaugggcgcuguguucacagaggaaaaucagugggauagugccaaggcggcagucgaggacgaagauuuuuggaaacucguggacagagagcgcgagcugcauaagcuagguaaaugugggucuugcguuuacaacaugaugggaaagagggagaagaaacuuggcgaguucggcaaagccaaagggagccgggcuaucugguacauguggcugggagccagauaucucgaauuugaggcacuggguuucuugaaugaggaucacugguuuucacgcgaaaacuccuacaguggcguggagggggaaggacugcauaagcucggcuauauacuuagggacaucagcaaaauucccgguggggcuauguacgccgaugacacugcuggaugggacacccgaaucacggaggaugaccugcacaaugaagagaagauuacacagcagauggauccagagcaccggcaauuagccaacgcaaucuucaaacugaccuaucagaauaaggucgugaagguacagagaccuacucccacaggcaccguuauggacauaauuucuaggaaagaucagcgcggcuccgggcaagugggaacuuacgguuugaacaccuuuacaaauauggaagcgcagcucauccgucagauggagggcgaagggguccugucaaaggccgaccuagagaacccacaucuucccgagaaaaagaucacgcaguggcuggagaccaaaggaguggagcggcucaagagaauggcuauuagcggcgaugacugcguggucaagccuauagaugacagguucgccaacgcacuguuggcuuuaaaugauauggguaaaguucgcaaggacaucccacaauggcagccgucgaaaggguggcacgauuggcaacaggugcccuuuuguucucaucacuuccacgaacugauuaugaaggacggacgaaaacucguagugccuugccggccacaagacgagcuuaucggcagagccaggauuagucagggcgcaggguggucccugaaggaaacugccugucuaggaaaggcguaugcucagauguggagccugauguacuuccaucgcagagaucuccgguuggccucaaacgcaaucugcuccgccguccccgugcacuggguuccuacaucuaggaccacuuggagcauacaugcucaccaucaauggaugacaaccgaggacaugcugacgguguggaaucgugucuggaucgaagauaacccauggauggaggacaaaacacccgugaccacuugggagaauguaccuuaccuugguaagcgagaagaucagugguguggcagucugauugggcucaccucccgcgccacaugggcacagaacaucccgacugcuauucagcaaguuaggagcuuaaucggaaaugaggaauuucuggacuauaugccaucuaugaaacgguucaggaaggaggaggaaucagagggcgccauuugguga

SEQ ID NO: 15309 - RNA, 9873 nt, Artificial Sequence
  derived and/or modified CDS sequence (opt3) from DENV-3__HQ705615__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauaugggggaagauggauguugguacggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcacaugaucgccgggguguucuuuacguucguucuacugcucuccggacagauuacuuggcgggauauggcacauacccugaucaugauuggcaguaaugcuagcgacagaauggguaugggggugacauaucuugccuugauagcaaccuuuaaaauccagcccuuccuggccuuaggauuuuuccucaggaagcugacuucucgcgaaaaccuucugcuaggcgucggccucgcuauggcgacaacccugcaauugccggaggauauugaacagauggccaaugggaucgcacugggauuaauggcucucaaacugauuacacaguuugagacuuaccagcuuuggaccgcccugaucuccuugacguguucaaacacaauauucacccucacuguggccuggcgaaccgcuacacugauccuagcagguguuagucugcuuccugugugccaaagcucguccaugcggaagacugacuggcucccaauggccgucgcggcuaugggcguacccccucugcccuuguuuauuuucucucugaaggauaccuuaaaacguagaagcuggccacucaaugagggggugauggccguuggacuggugucaauccuugcaaguucccuguugaggaacgacgucccuauggccggcccccucguggcuggugggcugcuaauugcauguuauguaaucacgggaacaucugccgaucugaccguggaaaaggcggcugacauaacuugggaggaagaggccgaacagacaggcgucagccacaaccuuaugauugcaguugacgaugacggcaccaugcgcaucaaagaugacgagacugagaauauccucacagugcuguugaagaccgccuuacugauuguguccgggauauuuccauacucaaucccggcuacgcuccuggucuggcauacuuggcagaaacagacccaacggagcggagugcuuugggauguuccuagucccccagaaacacagaaggccgagcuggaagaggguguauacagaauuaaacagcagggcaucuucgggaagacccaagugggagucggcgugcagaaggaggguguuuuucacacaauguggcacgugacuaggggggcagucuugaccuauaacggaaaacgacuagaacccaauugggcuucugugaagaaagaccugauuuccuacggcggcggguggcgccucagcgcccaguggcaaaagggagaggaaguacaggucaucgcgguggagccugguaaaaacccaaagaauuuccagacgaugcccggcacauuccagacuaccacaggggaaauaggagccaucgcacuggauuuuaagccuggcaccucggguucaccgauuaucaaccgggaggggaaaguugugggacuuuauggcaauggcgucgugacuaagaacgggggauacguuucugguauugcucaaaccaaugccgagccagacggccccacaccugaauuagaggaagagauguucaaaaagagaaaccugacgaucauggaucuccauccagggaguggaaaaacuaggaaguauuugcccgcuauagugcgugaagcaauuaagcgccggcugagaacccucauccuggccccuacaagggucguggccgcugagauggaggaagcgcuuaaaggccugccgauccgauaccagaccacugcaacaaaguccgagcacaccggucgggaaauuguagacuugaugugccaugccacguuuacuaugcgccuacugagccccgugagaguuccaaauuauaaccucaucauaauggaugaggcucacuucacagacccugccucuauugcagccaggggguacaucagcacccgggucggaaugggcgaagcugcggccauuuuuaugaccgcaacucccccaggcacagcugaugccuucccucaguccaaugcacccauccaggacgaggagcgagacauaccagaaagaucauggaacagugggaaugaguggauuaccgauuuugccggaaaaacagugugguucgugccgagcaucaaggcugguaacgacaucgccaacuguuuacgcaaaaauggcaagaaggucauucaacugucuaggaaaacuuuugauacggaauaccagaagaccaaacuuaacgacugggauuucguagugacaacugacaucuccgagaugggggcgaauuuuaaggcagaucguguuauugacccucggagaugccugaaacccgugauacucaccgauggaccagagagggucaucuuggccggccccaugccugugacagcugccucagcugcacagcgccgagguagaguugggcggaacccacagaaggaaaaugaccaauauauuuucaccggccagccccugaacaaugaugaggaccaugcccacuggacugaagcuaagaugcuccuggacaacaucaauacgccugagggaaucauuccggcccuuuucgaaccagagagggagaaaagugcagcgauagauggcgaauaccgccuaaagggggagagccguaaaaccuuuguggaacugaugagacggggagacuugcccgucugguuagcccacaagguggcuuccgaggguaucaaauauacagauaggaaguggugcuucgacggccagcgcaacaaucagauucuggaagagaacauggauguagagaucuggacuaaagaaggggagaagaagaaacuccgaccuagauggcuggacgcccggaccuacucugauccccuugcacugaaggaauuuaaagaguucgcugccggaaggaagucgauugcacucgacuuggugacagaaaucggccgcguuccaagccaucuggcccacagaaccaggaaugcucuagauaaccuggucaugcuccauacuucagagcacggugggcgggcguaucgucacgccguggaggaacuuccugagacaauggaaacgcuguuauugcugggccucaugauacugcuuaccggaggcgcaaugcuguuucucaucuccgggaaaggaauugguaagacuaguaucggcuugauuugugugaucacaucuagcgggaugcuguggauggcugagauacccuuacaauggauugccuccgccaucguccuagaguucuuuaugaugguucugcucauuccagaaccugagaagcagcgcaccccgcaggacaaucaacuugcauacgugguaaucggaauacugaccuuggcugccaucauugcggcuaacgaaaugggccugcucgagacaacuaaacgagaucuggguaugucaaaggaacccgggguggucucuccaacgagcuaucuugacguggaucuccauccugccagugcauggacccuguacgccguugcuacaacugugaucacccccauguugagacacacaauugagaauuccaccgcaaacgucagccuggccgcgaucgcuaaccaggccguaguguuaaugggccuagacaaaggauggccaauaucuaagauggaccugggcguuccucuccuugcacuggggugcuacucacaggugaaucccuugacucugacggccgcuguccuccugcuuauuacacauuaugccaucaucggaccgggcuuacaggcaaaagcuaccagggaggcccaaaagcggacugcggccgguauuaugaagaacccaaccguggaugggaucaugacaauagaccuggauccugucauuuacgacuccaaauucgaaaagcagcucggacaggugauguugcugguucuaugugcagugcagcugcuccuuaugcgcacuaguugggcucugugcgaggccuugacccuggcaacaggccccaucacgacccucugggaagguagcccaggcaaauuuuggaauacuacaauugcuguaucgauggccaacaucuucagagggucuuaucuggccggagcgggcuuagcuuuuuccauaaugaagagcguggggaccggaaaaaggggcacugguucacaaggggagacacuuggagaaaaguggaagaaaaagcugaaucagcucagucggaaagauuucgaccuauacaagaaaucuggcaucaccgaggucgaucgaacggaggcaaaggaaggucugaaaagaggcgagauuacccaccaugccguuucccgcgggagcgcuaaguugcagugguuuguggaaaggaacauggucauccccgagggacgggugauugaccugggcugugggcguggaggcuggucauaucacugcgccggucucaagaaaguaacagaagugagaggguacacuaagggaggcccuggccacgaggagccgguucccaugaguaccuauggguggaauaucgugaaacuuaugagcggaaaggaugucuucuaccugccaccugaaaaaugugacacauugcugugcgauauuggugaguccucucccagcccuacuguggaagaguccaggaccauccgcguccucaagaugguggagccaugguuaaagaacaaucaguucuguauaaaaguucugaaccccuacaugccuacaguaauugaacaucuugagcggcugcaacgaaagcacggcgggaugcuagugagaaauccacucucaaggaacucuacccaugaaauguauuggaucaguaauggaacuggcaacaucgucgcaucggugaauaugguuagccgccuguugcugaaccgguuuacgaugacacacagacgucccaccauugagaaagacguggaucucggugccgggacuaggcacgucaacgcugaaccggagaccccuaauauggacgugauaggagagcggaucaagcgcauuaaagaagagcauaacuccacauggcacuacgacgaugaaaauccauauaagacgugggcguaccauggcucuuaugagguaaaggccaccggcucagcaagcuccaugaucaacggggugguuaaacuucugacuaagcccugggacgucgugccuauggugacacagauggcuaugaccgauacuacaccauucggacagcaacgagucuuuaaagaaaagguugacaccagaacacccaggaguaugccggguacucggcgcgugaugggcauuaccgccgagugguuauggagaacgcuggggaggaauaaaaagccucgauugugcacccgggaggaauucacaaagaaaguacguacuaacgcagccaugggagcuguguuuaccgaggaaaaucagugggauucugccaaggcggcagucgaggacgaagauuucuggaaacucguggacagagagcgcgagcugcacaagcuaggcaaaugugguagcugcguuuacaacaugauggggaagagggaaaaaaagcuuggagaguuuggcaaggccaaaggcucacgggcuaucugguauauguggcugggggccagauaccucgaauucgaggcacugggauuuuugaaugaggaucauugguucucccgcgaaaacaguuacagcgguguggagggcgaagggcugcacaagcucggauauauacuuagggacaucucuaaaauucccggcggugcuauguacgccgaugacacagcugggugggacacucgaaucaccgaggaugaccugcacaaugaagagaagauuacgcagcagauggauccagagcaucggcaauuagccaacgcaaucuuuaaacugacauaucagaauaaggucgugaagguacagagaccuacccccacuggaacaguuauggacauaauuuccaggaaagaucagcgcggcucaggccaaguggggaccuacggauugaacacuuucaccaauauggaagcgcagcucauccgucagauggagggugaaggcguccugagcaaggccgaccuagagaacccacaccuucccgaaaaaaagaucacacaguggcuggagacgaaagggguggagcggcucaagagaauggcuauuucgggagaugacugcguggucaagccuauagaugacagguuugccaacgcacuguuggcuuuaaaugauaugggcaaaguucgcaaggacaucccacaauggcagccgucuaaagguuggcaugauuggcagcaggugcccuucuguagucaccacuuccaugaacugauuaugaaggacgggcgaaaacucguagugccuugccggccacaagacgagcuuaucggaagagccaggauuucccagggcgcaggcuggagccugaaggaaaccgccugucuagggaaggcguaugcucagauguggucacugauguacuuucaccgcagagaucuccgguuggccuccaacgcaaucugcucugccguccccgugcauuggguuccuacuagcaggacaaccuggaguauacacgcucaucaccaauggaugacuacagacgauaugcugaccguguggaaucgugucuggaucgaggacaacccauggauggaagauaaaacgcccgugacaaccugggagaauguaccuuaucuuggaaagcgagaggaccaguggugugguucccugauuggccucacuagccgcgccaccugggcacagaacaucccgacagcuauucagcaaguuagaucuuuaaucgggaaugaagaguuccuggauuacaugccaucaaugaaacgguuuaggaaggaagaggagagugaaggagccauuugguga

SEQ ID NO: 15310 - RNA, 9873 nt, Artificial Sequence
  derived and/or modified CDS sequence (opt3) from DENV-3__JF920398__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacaaucuggucgaaugguguccuggaaagcgauaugauuaucccaaaaucccucgcaggcccgauuucacagcacaaccauaggcccggguaucacacucaaaccgcgggaccuuggcaccugggcaagcuugaguuggacuuuaauuacugcgaggggacaacgguggugaucaccgaaaacuguggaacucguggcccaagucugcggacaaccacugucucugguaaauuaauacaugaguggugcugucgaagcugcacacuccccccucugagauauaugggggaagauggauguugguacggcauggagauuaggccaaucuccgaaaaggaggagaauaugguuaaaucacuugugagcgccgguucuggcaagguagacaacuucaccaugggggugcugugcuuggcuauccucuuugaagaggucaugcgcggaaaguucggcaaaaagcacaugauugccgggguguuccugacguuuguucuacugcucuccggacagaucacuuggcgggauauggcacauacccugauuaugauaggcaguaaugcuagcgacagaauggguaugggggugacauaucuugccuugaucgcaaccuucaaaauucagcccuuucuggccuuaggauucuuucucaggaagcugacuucucgcgaaaaccuucugcuaggcgucggccucgcuauggcgacaacccugcaauugccggaggauaucgaacagauggccaaugggauugcacugggauuaauggcucucaaacugaucacacaguucgagacuuaccagcuuuggaccgcccugauauccuugacguguucaaacacaaucuuuacccucacuguggccuggcgaaccgcuacacugauucuagcagguguuagucugcuuccugugugccaaagcucguccaugcggaagacugacuggcucccaauggccgucgcggcuaugggcguacccccucugcccuuguucaucuuuucucugaaggauaccuuaaaacguagaagcuggccacucaaugagggggugauggccguuggacuggugucaauucuugcaaguucccuguugaggaacgacgucccuauggccggcccccucguggcuggugggcugcuaaucgcauguuauguaauaacgggaacaucugccgaucugaccguggaaaaggcggcugacauuacuugggaggaagaggccgaacagacaggcgucagccacaaccuuaugaucaccguugacgaugacggcacuaugcgcaucaaagaugacgagacagagaauauucucaccgugcuguugaagacggcauuacugauaguguccgggaucuucccauacucaauuccggccacucuccuggucuggcauaccuggcagaaacagacacaacggagcggagugcuuugggauguuccuagucccccagaaacccagaaggcugagcuggaagaggguguauacagaaucaaacagcagggcauuuuugggaagacacaagugggagucggcgugcagaaggaggguguuuuccacacuauguggcacgugaccaggggggccgucuugacguauaacggaaaacgacuagaacccaauugggcaucugugaagaaagaccugaucuccuacggcggcggguggcgccucagcgcucaguggcaaaagggagaggaaguacaggucauagccguggagccugguaaaaacccaaagaauuuucagacaaugcccggcacuuuccagaccacaaccggggaaaucggagcgauugcccuggauuucaagccuggcacuucggguucaccgaucauuaaccgggaggggaaaguugugggacuuuauggcaauggcgucgugaccaagaacgggggauacguuucugguaucgcacaaacaaaugcugagccagacggccccacgccugaauuagaggaagagauguuuaaaaagagaaaccugacuauaauggaucuccauccagggaguggaaaaaccaggaaguauuugcccgccauugugcgugaagcuaucaagcgccggcugagaacacucauccuggcaccuaccagggucguggccgccgagauggaggaagcucuuaaaggccugccgauucgauaccagacuacagcgaccaaguccgagcacacgggucgggaaaucguagacuugaugugccaugcaacuuucacaaugcgccuacugagccccgugagaguuccaaauuauaaccucauaauuauggaugaggcccacuuuaccgacccugcuucuaucgccgcaaggggguacauuagcacccgggucggaaugggcgaagccgcugcgaucuucaugacugccacacccccaggcaccgcagaugcuuuuccucaguccaaugcccccauacaggacgaggagcgagacauuccagaaagaucauggaacagugggaaugaguggaucacagauuucgcaggaaaaacugugugguuugugccgagcaucaaggccgguaacgacauugcuaacuguuuacgcaaaaauggcaagaaggucauccaacugucuaggaaaacguucgauaccgaauaccagaagacaaaacuuaacgacugggauuuuguagugacuaccgacauuuccgagaugggggccaauuucaaggcggaucguguuauagacccucggagaugccugaaacccgugauccucacagauggaccagagagggucauuuuggcaggccccaugccugugaccgccgcuucagccgcucagcgccgagguagaguugggcggaacccacagaaggaaaaugaccaauauaucuuuacuggccagccccugaacaaugaugaggaccaugcacacuggacggaagccaagaugcuccuggacaacaucaauaccccugagggaauuauaccggcucuuuucgaaccagagagggagaaaagugccgcaaucgauggcgaauaccgccuaaagggggagagccguaaaacauucguggaacugaugagacggggagacuugcccgucugguuagcgcacaagguggccuccgaggguauuaaauauacugauaggaaguggugcuuugacggccagcgcaacaaucagauccuggaagagaacauggauguagagauuuggaccaaagaaggggagaagaagaaacuccgaccuagauggcuggacgcucggacauacucugauccccuugcccugaaggaauucaaagaguuugcagcuggaaggaagucgaucgcccucgacuuggugaccgaaauaggccgcguuccaagccaucuggcacacagaacuaggaaugcccuagauaaccuggucaugcuccauacaucagagcacggugggcgggcuuaucgucacgcgguggaggaacuuccugagacgauggaaacccuguuauugcugggccucaugauccugcuuacuggaggcgccaugcuguuccucauuuccgggaaaggaaucgguaagacaaguauuggcuugaucugugugauagcaucuagcgggaugcuguggauggcugagauucccuuacaauggaucgccuccgccauuguccuagaguuuuucaugaugguucugcucaucccagaaccugagaagcagcgcaccccgcaggacaaucaacuugcauacgugguaauaggaauccugaccuuggcugccauuaucgcggcuaacgaaaugggccugcucgagacaacuaaacgagaucuggguaugucaaaggaacccgggguggucucuccaacgagcuaucuugacguggaucuccauccugccagugcauggacccuguacgccguugcuacaacugugauuacccccauguugagacacacaaucgagaauuccaccgcaaacgucagccuggccgcgauagcuaaccaggccguaguguuaaugggccuagacaaaggauggccaauuucuaagauggaccugggcguuccucuccuugcacuggggugcuacucacaggugaaucccuugacucugacggccgcuguccuccugcuuaucacacauuaugccaucauuggaccgggcuuacaggcaaaagcuaccagggaggcccaaaagcggacugcggccgguaucaugaagaacccaaccguggaugggauaaugacaauugaccuggauccugucaucuacgacuccaaauuugaaaagcagcucggacaggugauguugcugguucuaugugcagugcagcugcuccuuaugcgcacuaguugggcucugugcgaggccuugacccuggcaacaggccccauuacgacccucugggaagguagcccaggcaaauucuggaauacuacaaucgcuguaucgauggccaacauauuuagagggucuuaucuggccggagcgggcuuagcuuucuccaucaugaagagcguggggaccggaaaaaggggcacugguucacaaggggagacacuuggagaaaaguggaagaaaaagcugaaucagcucagucggaaagauuuugaccuauacaagaaaucuggcauuaccgaggucgaucgaacggaggcaaaggaaggucugaaaagaggcgagaucacccaccaugccguuucccgcgggagcgcuaaguugcagugguucguggaaaggaacauggucauucccgagggacgggugaucgaccugggcugugggcguggaggcuggucauauuacugcgccggucucaagaaaguaacagaagugagaggguauacuaagggaggcccuggccacgaggagccgguucccaugaguaccuacggguggaauauugugaaacuuaugagcggaaaggaugucuuuuaccugccaccugaaaaaugugacacauugcugugcgauaucggugaguccucucccagcccuacuguggaagaguccaggaccauacgcguccucaagaugguggagccaugguuaaagaacaaucaguucuguauuaaaguucugaaccccuauaugccuacaguaaucgaacaccuugagcggcugcaacgaaagcauggcgggaugcuagugagaaauccacucucaaggaacucuacccacgaaauguacuggaucaguaauggaacuggcaacauugucgcaucggugaauaugguuagccgccuguugcugaaccgguucacgaugacacauagacgucccaccauagagaaagacguggaucucggugccgggacuaggcacgucaacgcugaaccggagaccccuaauauggacgugaucggagagcggauuaagcgcaucaaagaagagcacaacuccacauggcauuaugacgaugaaaauccauacaagacgugggcguaucacggcucuuacgagguaaaggccaccggcucagcaagcuccaugauuaacggggugguuaaacuucugacuaagcccugggacgucgugccuauggugacacagauggcuaugaccgauacuacaccauuuggacagcaacgagucuucaaagaaaagguugacaccagaacacccaggaguaugccggguacucggcgcgugaugggcaucaccgccgagugguuauggagaacgcuggggaggaauaaaaagccucgauugugcacccgggaggaauuuacaaagaaaguacguacuaacgcagccaugggagcuguguucaccgaggaaaaucagugggauucugccaaggcggcagucgaggacgaagauuuuuggaaacucguggacagagagcgcgagcugcauaagcuaggcaaaugugguagcugcguuuauaacaugauggggaagagggaaaaaaagcuuggagaguucggcaaggccaaaggcucacgggcuauaugguacauguggcugggggccagauaccucgaauuugaggcacugggauucuugaaugaggaucacugguuuucccgcgaaaacaguuauagcgguguggagggcgaagggcugcauaagcucggauacauccuuagggacauuucuaaaauccccggcggugcuauguaugccgaugacacagcugggugggacacucgaauuaccgaggaugaccugcacaaugaagagaagaucacgcagcagauggauccagagcaccggcaauuagccaacgcaauauucaaacugacauaccagaauaaggucgugaagguacagagaccuacccccacuggaacaguuauggacauuaucuccaggaaagaucagcgcggcucaggccaaguggggaccuauggauugaacacuuuuaccaauauggaagcgcagcucauccgucagauggagggugaaggcguccugagcaaggccgaccuagagaacccacaucuucccgaaaaaaagauuacacaguggcuggagacgaaagggguggagcggcucaagagaauggcuauaucgggagaugacugcguggucaagccuaucgaugacagguucgccaacgcacuguuggcuuuaaaugauaugggcaaaguucgcaaggacauuccacaauggcagccgucuaaagguuggcacgauuggcagcaggugcccuuuuguagucaucacuuccacgaacugaucaugaaggacgggcgaaaacucguagugccuugccggccacaagacgagcuuauuggaagagccaggaucucccagggcgcaggcuggagccugaaggaaaccgccugucuagggaaggcguacgcucagauguggucacugauguauuuccaucgcagagaucuccgguuggccuccaacgcaauaugcucugccguccccgugcacuggguuccuacuagcaggacaaccuggaguauccaugcucaccaucaauggaugacuacagaggacaugcugaccguguggaaucgugucuggauugaagauaacccauggauggaggacaaaacgcccgugacaaccugggagaauguaccuuaccuuggaaagcgagaagaucaguggugugguucccugaucggccucacuagccgcgccaccugggcacagaacauuccgacagcuauccagcaaguuagaucuuuaauugggaaugaggaauuucuggacuacaugccaucaaugaaacgguucaggaaggaggaggaaagugagggagccauaugguga

SEQ ID NO: 15311 - RNA, 9873 nt, Artificial Sequence
  derived and/or modified CDS sequence (opt3) from DENV-3__JF920402__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcagcaugaaaaucugaaguauacugucauuaucaccgugcacacaggugaccagcaucagguuggcaacgagacccaaggggugacugcagaaauuacgccucaggcuuccacaaccgaggccauccucccagaauacggaacucuuggccuggagugcucuccgcgaaccgguuuggacuucaaugagaugauccuacugacaaugaaaaacaaggcguggaugguccacagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcauacagcucucaccggcgccacagaaauucagaauucagggggaacuaguauauucgcaggucaccugaagugucgguuaaaaauggacaagcuggagcuaaaaggcaugagcuaugccaugugcaccaacacguuuguccucaagaaagaggugucugaaacccagcaugggacaauccugauuaaggucgaguacaagggagaagaugugcccuguaaaaucccuuucuccacugaggacggccaagguaaggcucacaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguacaagaaggggagcaguauuggaaaaauguuugaagcuacugcccgcggugcaagaaggauggccauacugggcgacaccgcuugggauuucgggucugugggaggcguucucaacucccuggguaagauggugcaucagaucuuugggagcgccuauacggcacuuuucucgggcgucucuugggugaugaaaauuggaaucggcguacuguugacauggaucgggcucaauuccaagaacaccucaaugaguuuuagcugcauugcgauaggaaucauuacucuguacuuaggcgcugugguucaggccgacauggguugugucaucaauuggaaagggaaggagcugaagugcggauccggcauuuucgugacaaacgaggugcacaccuggacugaacaguauaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuacauuuugugggaaaauaacaucaagcugaccguuguggugggagacauuaucggcguacucgagcaggggaaaagaacucugacaccacagccuauggaguuaaaguauucauggaaaaccuggggaaaggccaagauagucacagcggaaacucaaaacaguuccuucauuaucgauggccccaauaccccagagugccccagcgugucuagggccuggaacguuugggaaguggaggacuacgguuuuggggucuucacgacaaauauuuggcugaaacuucgggaaguguauacccaguugugugaccaccgccucaugucagcugcaguuaaggaugagagagccgugcaugcugacaugggauacuggaucgagagucagaaaaacggcagcuggaagcuggaaaaagccucccuaauagagguaaagacuugcaccuggccuaagucucacacacuguggucgaaugguguccucgaaagcgauaugaucauuccaaaaucccuggcaggcccgaucucacagcauaaccacaggcccggguaccacacucaaaccgcgggaccuuggcaucuuggcaaguuggagcuggacuuuaauuauugcgaggggacaacgguggugauuaccgaaaacuguggagcccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcaagguagacaacuucacaauggggguguugugccucgccauccuguuugaagaggucaugcgcggaaaguucggcaaaaagcauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaaaauccagcccuuccuggcuuuaggauuuuuccucaggaagcugaccucucgcgaaaaccuucugcuaggcgucggccucgcgauggccacuacacugcaauugccggaggauauugaacagauggcaaaugggaucgcucugggauuaauggcccucaaacugauuacccaguuugagaucuaucagcuuuggacagcccugauauccuugacuuguucaaacaccaucuucacgcucacaguggcuuggcgaaccgcaacucugauucuagccgguguuagucugcuuccuaugugccaaagcucguccaugcggaagaccgacuggcucccaauggcgguggcugccaugggcguccccccucugcccuuguuuaucuucucucugaaggauacauuaaaacguagaagcuggccacucaaugaggggguaauggcagugggacugguuucaauucuugccaguucccuguugaggaacgacgugccuauggcuggcccccucgucgcaggugggcugcuaaucgccuguuacgugauaacuggaaccucugcggaucugacgguagaaaaggcugccgacauuacaugggaggaagaggcagaacagaccggcgugagccauaaccuuaugaucacugucgacgaugacggcacaaugcgcaucaaagaugacgagaccgagaauauucucacuguucuguugaagacagccuuacugauaguguccgggaucuuuccauauucaauuccggcuacccuccugguguggcacacguggcagaaacagacucaacggagcggaguccuuugggaugugccuagucccccagaaacccagaaggccgagcuggaagaggguguuuacagaaucaaacagcagggcauuuucgggaagacacaaguaggagugggcguccagaaggaggguguguuucacaccauguggcauguuacaaggggggcaguguugacuuacaacggaaaacgacuagaacccaauugggcuucugucaagaaagaccugaucuccuauggcggcggguggcgccucagcgcccaguggcaaaagggagaggaagugcagguaauagcggucgagccugguaaaaacccaaagaauuuccagaccaugcccggcacguuccagacaacuaccggggaaaucggagccauugcacuggauuuuaagccuggcacaucggguucaccgaucauuaaccgggaggggaaagugguuggacuuuacggcaauggcguggucaccaagaacgggggauaugugucugguaucgcucaaacuaaugccgagccagacggccccaccccugaauuagaggaagagauguucaaaaagagaaaccugacaauaauggaucuccacccagggaguggaaaaacgaggaaguacuugcccgcuauuguucgugaagcaaucaagcgccggcugagaacucucauccuggccccuaccaggguggucgccgcugagauggaggaagcgcuuaaaggccugccgauucgauaucagacaaccgcaacuaaguccgagcauacaggucgggaaaucguggacuugaugugccacgccaccuuuacgaugcgccuacugagccccguaagagugccaaauuacaaccucauaauuauggaugaggcucauuucacugacccugccucuaucgcagccaggggguauauuagcacacggguuggaaugggcgaagcugcggccaucuuuaugaccgcaacccccccaggcacugcugaugccuucccucaguccaaugcacccauacaggacgaggagcgagacauuccagaaagaucauggaacagugggaaugaguggaucacagauuuugccggaaaaaccgucugguucgugccgagcaucaaggcugguaacgacauugccaacuguuuacgcaaaaauggcaagaaggugauccaacugucuaggaaaacauuugauacugaauaccagaagacgaaacuuaacgacugggauuucgucguaaccacagacauuuccgagaugggggcgaauuuuaaggcagaucgugugauagacccucggagaugccugaaacccguuauccucacugauggaccagagagggugauuuuggccggccccaugccugucaccgcugccucagcugcacagcgccgagguagaguggggcggaacccacagaaggaaaaugaccaauacaucuucacaggccagccccugaacaaugaugaggaccacgcccacuggaccgaagcuaagaugcuccuggacaacaucaauacuccugagggaauuauaccggcccuuuucgaaccagagagggagaaaagugcagcgaucgauggcgaauaucgccuaaagggggagagccguaaaacguuuguugaacugaugagacggggagacuugcccgugugguuagcccauaaggucgcuuccgaggguauuaaauacaccgauaggaaguggugcuucgacggccagcgcaacaaucagauccuggaagagaacauggauguggagauuuggacaaaagaaggggagaagaagaaacuccgaccuagauggcuggacgcccggacuuauucugauccccuugcacugaaggaauuuaaagaguucgcugccggaaggaagucgaucgcacucgacuugguaaccgaaauaggccgcgugccaagccaccuggcccauagaacaaggaaugcucuagauaaccugguuaugcuccacaccucagagcacggugggcgggcguaccgucaugccgucgaggaacuuccugagacuauggaaacacuguuauugcugggccucaugauccugcuuacgggaggcgcaaugcuguuucucauuuccgggaaaggaaucgguaagaccaguauuggcuugaucugugugauagcuucuagcgggaugcuguggauggccgagauucccuuacaauggaucgccuccgcaauugugcuagaguucuuuaugaugguccugcucaucccagaaccugagaagcagcgcacuccgcaggacaaucaacuugcuuauguugugauaggaauccugacauuggccgcgauuaucgcugccaacgaaaugggccugcucgagaccaccaaacgagaucuggguaugucaaaggaacccgggguagugucuccaacaagcuaccuugacgucgaucuccacccugcaagugccuggacucuguaugcuguggcaacgaccguuauuacacccauguugagacauacuaucgagaauuccaccgccaacgugagccuggcggcuauagccaaccaggcagucguauuaaugggccuagacaaaggauggccaauuucuaagauggaccugggcgugccucuccuugcccuggggugcuacucacagguuaaucccuugacacugaccgcugccgugcuccugcuuaucacucacuacgcaaucauuggaccgggcuuacaggcuaaagccacgagggaggcgcaaaagcggacagccgcagguaucaugaagaacccaaccgucgaugggauaaugacuauugaccuggauccugugaucuaugacuccaaauucgaaaagcagcucggacaggucauguugcuggugcuauguguugugcagcugcuccuuaugcgcaccaguugggcucugugcgaggccuugacacuggcaacuggccccauuaccacacucugggaagguagcccaggcaaauuuuggaauacgaccaucgcuguaucgauggccaacauauucagagggucuuaccuggccggagcgggcuuagcuuuuuccaucaugaagagcguggggacuggaaaaaggggcacagguucacaaggggagacccuuggagaaaaguggaagaaaaagcugaaucagcucagucggaaagauuucgaccuauauaagaaaucuggcauuacugaggucgaucgaacagaggcaaaggaaggucugaaaagaggcgagaucacccaucacgccguuucccgcgggagcgcuaaguugcagugguuuguggaaaggaacauggucauucccgagggacgggugaucgaccugggcugugggcguggaggcuggucauacuauugcgccggucucaagaaaguaacggaagugagaggguacaccaagggaggcccuggccacgaggagccgguucccaugaguacauauggguggaauauugugaaacuuaugagcggaaaggaugucuucuaccugccaccugaaaaaugugacacuuugcugugcgauaucggugaguccucucccagcccuaccguggaagaguccaggacaauacgcguccucaagaugguggagccaugguuaaagaacaaucaguucuguauuaaaguucugaaccccuacaugccuacuguaaucgaacaucuugagcggcugcaacgaaagcacggcgggaugcuagugagaaauccacucucaaggaacucuacccaugaaauguauuggaucaguaauggaacaggcaacauugucgcaucggugaauaugguuagccgccuguugcugaaccgguuuaccaugacucacagacgucccacgauagagaaagacguggaucucggugccgggacaaggcacgucaacgcugaaccggagaccccuaauauggacgugaucggagagcggauuaagcgcaucaaagaagagcauaacuccacuuggcacuacgacgaugaaaauccauauaagaccugggcguaccauggcucuuaugagguaaaggccacaggcucagcaagcuccaugauuaacggggugguuaaacuucugacgaagcccugggacgucgugccuauggugacccagauggcuaugacugauacaaccccauucggacagcaacgagucuuuaaagaaaagguugacacuagaacacccaggaguaugccggguacccggcgcgugaugggcaucacagccgagugguuauggagaacucuggggaggaauaaaaagccucgauugugcacccgggaggaauucacgaagaaaguacguaccaacgcagccaugggagcuguguuuacagaggaaaaucagugggauucugccaaggcggcagucgaggacgaagauuucuggaaacucguggacagagagcgcgagcugcacaagcuaggcaaaugugguagcugcguuuacaacaugauggggaagagggaaaaaaagcuuggagaguuuggcaaggccaaaggcucacgggcuauaugguauauguggcugggggccagauaccucgaauucgaggcacugggauuuuugaaugaggaucauugguucucccgcgaaaacaguuacagcgguguggagggcgaagggcugcacaagcucggauauauccuuagggacauuucuaaaauccccggcggugcuauguacgccgaugacacugcugggugggacacccgaauuacagaggaugaccugcacaaugaagagaagaucacucagcagauggauccagagcaucggcaauuagccaacgcaauauuuaaacugaccuaucagaauaaggucgugaagguacagagaccuacgcccacaggaaccguuauggacauuaucuccaggaaagaucagcgcggcucaggccaaguggggacuuacggauugaacacauucaccaauauggaagcgcagcucauccgucagauggagggugaaggcguccugagcaaggccgaccuagagaacccacaccuucccgaaaaaaagauuacucaguggcuggagaccaaagggguggagcggcucaagagaauggcuauaucgggagaugacugcguggucaagccuaucgaugacagguuugccaacgcacuguuggcuuuaaaugauaugggcaaaguucgcaaggacauuccacaauggcagccgucuaaagguuggcaugauuggcagcaggugcccuucuguagucaccacuuccaugaacugaucaugaaggacgggcgaaaacucguagugccuugccggccacaagacgagcuuauuggaagagccaggaucucccagggcgcaggcuggagccugaaggaaacagccugucuagggaaggcguaugcucagauguggucacugauguacuuucaccgcagagaucuccgguuggccuccaacgcaauaugcucugccguccccgugcauuggguuccuacgagcaggaccacuuggaguauccacgcucaucaccaauggaugacaaccgaggacaugcugacuguguggaaucgugucuggauugaagauaacccauggauggaggacaaaacacccgugaccacgugggagaauguaccuuaucuuggaaagcgagaagaucaguggugugguucccugaucggccucacaagccgcgccaccugggcacagaacauuccgacugcuauccagcaaguuagaucuuuaauugggaaugaggaauuccuggacuacaugccaucaaugaaacgguuuaggaaggaggaggaaagugagggagccauaugguga

SEQ ID NO: 15312 - RNA, 9873 nt, Artificial Sequence
  derived and/or modified CDS sequence (opt3) from DENV-3__JF937652__SS-prME
acaagccugugccucaugaugauccuucccgcagcucuggcauuccacuugacauccagagacggcgagccuaggaugauuguggggaagaaugaacggggaaaaucuuuacuguuuaagacugccucagguauaaauauguguacgcugaucgcgauggaucucggcgagaugugcgacaacaccgucacauacaaauguccacauauuacugaaguugagccggaagauaucgacugcugguguaaucugaccaguacaugggugaccuaugggacuugcaaccaggcuggagagcaccgccgagauaagcguagcguagcccuugcaccccaugugggcaugggucuggacacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaauagagauuuuguugaaggauugucaggugccaccuggguggacgucgugcuggagcacggcgggugcgugacgacuauggcgaagaacaaacccacacuagauauugagcuccagaagaccgaagcaacucaacuggccacacuuaggaaacuguguaucgagggaaagauuaccaauaucacgaccgacagccggugcccuacacagggcgaagcuacuuugccagaggaacaggaucagaacuaugucuguaaacacaccuacguugaccgcgguugggggaauggaugcggccucuucggcaaggggagucuggugacaugcgccaaguuucaauguuuagagcccauagagggaaaaguagugcaguaugaaaaccugaaguacacugucauuaucaccgugcauacaggugaucagcaccagguuggcaaugagacccaaggggugacugcagaaauuacgccucaggcuuccacaaccgaggccguccucccagaauauggaacucuuggccuggagugcucuccgcgaaccgguuuggacuucaacgagaugauccuacugacaaugaaaaauaaggcguggauggugcauagacagugguuuuucgaccucccccugccuuggaccagcggggccacuacagaaacgccaaccuggaacaggaaagagcuucugguaacuuuuaagaaugcacacgcuaaaaagcaagaaguuguggucuugggcucccaggagggagccaugcacacagcucucaccggcgccacagaaauccagaacucagggggaacaaguauuuucgcaggucaucugaagugucgguuaaaaauggauaagcuggagcuaaaaggcaugagcuacgccaugugcaccaacacguuugugcucaagaaagaggucucugaaacccagcacgggacaauacugaucaagguggaguacaagggagaagacguucccuguaaaauuccuuucuccacugaggauggccaagguaaggcucauaaugggcgucuuaucaccgcgaacccagugguaacuaagaaggaggaauuggucaauauagaggcagaacccccguucggcgagucaaacauugugaucggaaucggcgacaaugcccugaaaauuaacugguauaagaaggggagcaguaucggaaaaauguuugaagcuacugcccgcggugcaagaaggauggccauucucggcgauaccgcuugggacuucgggucuguuggaggcgugcuaaauucccuugguaagaugguccaccagauauuugggagcgccuacacggcacuguucucgggcgugucuuggguaaugaaaaucggaauuggcguguugcucacauggaucgggcugaacuccaagaauaccucaaugaguuuuagcugcaucgcgauuggaauaaucacuuuauaucugggcgcuguuguccaggccgauauggguugugugauuaacuggaaagggaaggagcuaaagugcggauccggcaucuucgugacaaaugagguccauaccuggacugaacaguacaaauuucaagcagacucuccuaagcggcucgccaccgcuauugccggugcaugggagaacggcguuugugggauccgaagcacaacgcgcauggaaaaucugcuuuggaaacagauagcuaacgaguugaauuauauccugugggaaaacaacauuaagcucaccguggugguaggagauaucauuggcguccuggagcaggggaaaagaacuuuaacaccccagccaauggagcugaaguacucauggaaaaccuggggaaaggccaagaucgugacagcggaaacucaaaauaguuccuucauaauugacggcccuaacacccccgagugcccaagcguuucuagggccuggaaugugugggaagucgaggauuaugguuuugggguguucacgacaaacaucuggcuuaaauugcgggaaguuuacacccagcucugugaccaccgccugaugucagcugcagugaaggacgagagagccguacacgcugauaugggauacuggauugagagucagaaaaauggcagcuggaagcuagaaaaagccucccugaucgaggucaagacuugcaccuggcccaagucucauacacucuggucgaacggugugcuggaaagcgacaugauaaucccuaaaucccuugcaggcccaauuucacagcacaauuauaggccgggguaccauacucaaaccgcgggacccuggcacuugggcaagcuggaguuagauuuuaacuauugcgaggggacaacgguggucaucaccgaaaauuguggaacucguggcccuagucuccggacaaccacuguuucugguaaacugauucacgaguggugcugucgaagcugcacacuuccaccccugagauacaugggggaagacggauguugguauggcauggagaucaggccuauauccgaaaaggaggagaacauggugaaaucauugguaagcgccgguucuggcaagguggauaauuucaccauggggguccucugccuggcuauucuauuugaagaggugaugcgcggaaagcugggcaaaaagcauaugaucgccgggguuuucuucacguuugugcuccugcuuuccggacagaucacuuggcgggacauggcacacaccuugauuaugaucggcaguaacgcuagcgauagaauggguaugggggucacauaccuggccuuaauugcaaccuucaaaauacagccauuucucgcccugggauucuuucuuaggaagcugacuucucgcgaaaaucuacuccugggcgugggcuuggcuauggcgacaacccugcaauuacccgaggacaucgaacagauggccaacgggauugcacucggacugauggcucuuaaacugaucacacaguucgagacuuaucaguuguggaccgcccucauuucccugacguguucaaauacaaucuuuacccuaacuguugccuggcgaaccgcuacacugauacuugccggugugagucuccugccggucugccaaagcucguccaugcggaagacugauugguugccuauggccguagcggcuaugggcgugccaccccugccuuuauucaucuuugggcucaaggacacccugaaacguagaucuuggccccuuaacgagggaguuauggccgugggccuggucagcauuuuggcaucaagucuccugaggaacgaugugccaauggccgguccucuaguagcugggggacugcuuaucgcauguuacgugauuacgggcacauccgccgaccucaccgucgaaaaggcggcugauaucacuugggaggaagaggccgaacagacaggcguuucucauaaucugaugauaaccguggacgacgaugggacuaugcgcauuaaagacgaugagacagagaacaucuugaccguguuacugaagacggcacuccugaucgucagcggaauuuuccccuacuccauaccagccacucuucugguguggcacaccuggcagaaacagacacaacggucagguguuuugugggacguaccgagcccucccgaaacccagaaggcugagcuagaagagggcguguauagaaucaaacagcaggggauuuuuggaaagacacaagucggcguggguguucagaaggaggggguguuccauacuauguggcacgucaccaggggagccgugcugacguacaauggcaaacgacucgaaccaaacugggcaaguguaaagaaagaucugaucucuuauggcgggggauggcgccuuuccgcucaguggcaaaagggugaggaaguccaggugauugccguugagcccggcaaaaauccuaagaacuuucagacaaugccagggacuuuccagaccacaaccggagaaaucggcgcgauagccuuagacuucaagcccgguacuagcgggucgccuaucauuaaucgggagggaaaaguggucggccuguacggcaacggggugguuaccaagaauggagguuaugugucaggcaucgcacaaacaaacgcugagccggaugggccaacgcccgaacucgaggaagagauguuuaaaaagagaaauuugacuauuauggaccugcacccuggaucuggcaaaaccaggaaguaccucccagccaucguccgugaagcuauaaagcgccggcugagaacacuuauucuggcacccaccagggugguagccgccgagauggaggaggcuuugaaaggucuaccuauccgauaucagacuacagcgaccaagagugaacauacggggcgggaaaucguggaucugaugugccacgcaacuuucacaaugcgccucuuauccccgguuagaguccccaacuacaaucugauuaucauggacgaggcccauuuuaccgauccagcuagcauagccgcaaggggauacauuucuacccgggugggcaugggcgaagccgcugcgaucuucaugacugccacaccucccgggaccgcagacgcuuuuccacagagcaacgccccuauucaggaugaggagaaagacauccccgaacgauccuggaacucaggaaacgaguggauaacagacuucgcagguaagacugugugguuugucccaaguauuaaagccggcaacgauaucgcuaauugucuuagaaagaacgggaagaaaguaauccaacugagccgcaagacguucgacaccgaauaucagaaaacaaagcucaaugauugggacuuugugguuacuaccgauauuucugagaugggagccaacuucaaagcggacagggugaucgauccgcgucggugcuugaagccugucauucugacagacggccccgagagagugauacucgcagguccaaugcccguuaccgccgcuuccgccgcucagaggcgcgggcgagugggcagaaauccucagaaggaaaacgaucaauacaucuuuacuggacagccacugaauaacgacgaggaucacgcacauuggacggaagccaaaaugcuucuagacaauauuaacacccccgagggcaucaucccugcucuguucgaaccggagcgggagaagucagccgcaauugacggggaauauagguugaaaggagagagucgcaagacauucgucgaauuaaugcguagaggugaucugccaguguggcucgcgcacaaaguagccagcgagggcauaaaguacacugaccggaaauggugcuuugaugggcagaggaauaaccagauccuggaagagaauauggacguggagauuuggaccaaggaaggagagaagaagaaacuucgcccccgauggcuggaugcuagaacauauuccgacccucucgccuugaaagaguucaaagaguuugcagcuggccggaaaucuaucgcccuggaucuaguuaccgaaauugguaggguccccucgcaccuggcacaucgcacuagaaacgcccucgacaaucuugugaugcugcacacaagcgagcaugggggcagggcuuaccggcacgcgguggaggaauuaccagagacgauggaaaccuugcugcuccugggacuuaugauccugcucacuggcggggccauguuguuccugauaucaggaaaggguaucggcaagacauccauuggguuaaucugugucauugcaaguucuggaaugcuauggauggcugagaucccucugcaauggauagccagcgccauuguucucgaguuuuucaugauggugcuucugauccccgaaccagagaaacagcguaccccucaggauaaccaauuggcauauguagugauuggcauccugacccucgcugccauaaucgcggcuaaugaaaugggucugcuugagacaacuaagcgcgaccucgggauguccaaagaaccgggcgucgugucacccacgucuuaccuggauguugacuugcacccagccagcgcauggacccuguacgccguggcuacaacugucauuaccccuauguuacgacauacaaucgagaacaguaccgcaaacguaucccuagccgcgauugcuaaucaggccgugguucugaugggacucgauaagggcuggcccaucagcaaaauggaccuuggggugccacuguuggcacugggaugcuauucucaggucaacccucucacucugacggccgcugugcuuuuacugauaacacacuacgccauuaucggccccggucuccaggcaaaggcuaccagagaggcccaaaagaggacugcggccgggaucaugaaaaauccgaccgucgacggaauuaugacaaucgauuuggacccagugauauaugauucaaaguuugaaaaacagcugggccagguuaugcuacuggugcucugugcaguacagcuucuguugaugcggacuuccugggcucugugcgaggcccucacccuggcaacagguccuauuacgaccuuaugggaaggcagucccgggaaguucuggaacacuacaaucgcugugagcauggccaauauuuuucgcggaucguaccuugccggcgcggggcuggcuuucucuaucaugaaauccgucggaaccggcaagagagguacugggagccaaggagagacacucggcgaaaaguggaaaaagaaacuaaaccagcugucaaggaaggacuuugauuuguauaaaaagagugguauaaccgagguugaccggacggaggcaaaagaaggccugaagcgaggggagaucacccaucacgccgugucuagaggauccgcuaagcuccagugguucgucgaacgcaauauggugauuccagagggcaggguaaucgaucuuggguguggacggggcgguuggagcuacuauugcgccgggcugaaaaaggugacagaaguucguggauacacuaaaggcggccccgggcaugaggagccugugccgaugucaaccuacggauggaacauugucaaguugaugagugguaaagacguguuuuaucugcccccagaaaagugugauacacucuuaugcgacaucggcgagagcuccccuucucccacugucgaagagagcagaaccauuagggugcugaagaugguugagccuuggcuuaaaaauaaccaguucuguaucaagguacugaauccauacaugcccacagugauagaacaccuagagcgccuccaacggaaacacgggggaaugcugguccgaaacccuuuguccagaaauucaacccaugaaauguauuggauuucuaacggcacugguaauaucguggcaaguguuaacauggugucgaggcugcuccuuaaccgcuucacgaugacacaccggagaccaaccaucgagaaggaugucgaccugggggccggaacucgucaugugaaugcugaacccgagaccccgaacauggauguaauuggcgagaggauaaaacggaucaaggaagaacacaauagcacauggcacuacgacgacgaaaacccuuauaagacgugggcguaccauggcuccuaugaggugaaagccaccgggucugcaucaagcaugauuaauggaguugucaaguuacugacuaaaccaugggauguggugcccauggucacacagauggcuaugaccgacacuacaccuuuuggucagcaacgcguuuucaaggaaaaaguggauacccgaacaccaagauccaugcccggcacuaggcggguaauggggaucaccgccgagugguuguggcgcacgcucggaagaaacaagaagccgaggcugugcacccgagaggaauuuaccaaaaaggugcggacuaaugcagccaugggcgcugucuucaccgaggaaaaccagugggacagugccaaagcggcaguggaggaugaagacuuuuggaagcuaguugaucgugagagagagcuucacaaacuggguaagugugggucuugcguguacaauaugaugggaaaacgcgaaaagaagcucggcgaguucggcaaagccaaggggagcagggcuauuugguacauguggcugggagcccgguauuuggaauuugaggcacuggguuuccucaacgaggaccauugguuuucaagagaaaauuccuacaguggcgucgagggggaaggacuucacaaacugggcuauaucuuacgcgauauaagcaagaucccugguggggcuauguacgccgacgauacagcuggaugggacacuaggauuaccgaggacgaucugcauaacgaagagaaaaucacgcagcagauggaccccgagcaccgacaauuggccaaugcaauuuucaagcucacauaucagaacaaggugguaaaaguucagcggccaaccccuacuggcacagugauggauaucauaucuagaaaggaccagaggggcuccgggcaagucggaaccuacggucugaauacuuuuaccaacaugggcgcgcagcuaauucgccagauggaaggggagggagugcuuucaaaagccgaucuggaaaacccccaccucccagagaagaaaaucacacaguggcuggaaacgaagggcguggagcguuugaagcggauggcuaucagcggugacgauugcgucguuaaacccauugacgauagauucgccaaugcauuacuggcucucaacgacauggggaaggugaggaaagauauaccucaauggcagccaucgaagggauggcaugacuggcagcagguaccguuuuguucucaccauuuccacgagcuuaucaugaaagauggccgcaagcuggugguccccugccgaccucaagacgaacuaauuggccgggccagaaucagucagggggcaggauggucccugaaggagaccgccugucucgguaaagcguaugcucagauguggagcuugauguacuuccacaggcgcgaccugagacuugccucaaaugcaauuugcuccgccgugccaguucauugggugcccacuucucggacaaccuggagcauccacgcucaucaccaauggaugacuacagaagauaugcugaccgucuggaacaggguguggauagaggacaauccuuggauggaagauaagacgccaguaacaaccugggagaacguucccuaccucggcaaacgugaggaccaguggugugggaguuuaaucggacugacuucccgagccaccugggcacagaauauuccuacagcuauccagcaagugcgcagcuugauuggcaacgaagaguuucuggauuauaugccgucuaugaagagauuccggaaagaagaggagucagaaggugccaucugguga

SEQ ID NO: 15313 - RNA, 9873 nt, Artificial Sequence
  derived and/or modified CDS sequence (opt3) from DENV-3__JF920404__SS-prME
accagccugugccucaugaugauccuucccgcagcucuggcauuccacuugacuuccagagacggcgagccuagaaugauuguggggaagaacgaacggggaaagucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucaaaauucagggggaacaagcauauucgcaggucaucugaagugucgguuaaaaauggacaagcuggagcuaaaaggcaugagcuacgccaugugcaccaacgcuuuuguccucaagaaagaggugucugaaacgcagcacgggaccauccugauuaaggucgaguacaagggagaagaugugcccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgccggugcuugggagaauggcgucugugggauacgaagcaccacacgcauggaaaaccuccuguggaaacagaucgccaaugagcuuaacuauauuuugugggaaaauaacaucaagcugacgguuguggugggagacauuaucggcguacucgagcaggggaaaagaacccugacuccacagccuauggaguuaaaguacucauggaaaacauggggaaaggcgaagauagucaccgccgaaacacaaaacaguuccuucauuaucgauggccccaauacuccagagugccccagcgugucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaaccauaggcccggguaucacacacaaacugccggaccuuggcaccuuggcaaguuggagcuggacuuuaauuacugcgaggggaccacaguggugauuacggaaaacuguggaacccguggcccaaguuuacggacuacaaccgucucugguaaacucauccaugaguggugcugucgaagcugcacucugcccccucuuagauauaugggggaagauggauguugguacggcauggagauaaggccaauuuccgaaaaggaggagaauaugguuaaaucacuggugagcgcugguucuggcaagguagacaacuucacaauggggguguugugccucgccauccuguuugaagaggucaugcgcggaaaguucggcaaaaagcacaugaucgcagggguguucuuuaccuucguucuacugcucuccggacagauuacguggcgggauauggcucauacucugaucaugauuggcaguaaugccagcgacagaauggguaugggggugaccuaucuugcauugauagccacauuuaaaauccagcccuuccuggcuuuaggauuuuuccucaggaagcugaccucucgcgaaaaccuucugcuaggcgucggccucgcgauggccacuacacugcaauugccggaggauauugaacagauggcaaaugggaucgcucugggauuaauggcccucaaacugauuacccaguuugagacauaccagcuuuggacugcccugaucuccuugaccuguucaaacacgauauucacacucaccguggcuuggcgaacugcaacccugauccuagccgguguuagucugcuuccugugugccaaagcucguccaugcggaagacagacuggcucccaauggcggucgcugccaugggcguacccccucugcccuuguuuauuuucgggcugaaggauacuuuaaaacguagaucuuggccacucaaugagggagugauggcaguuggccuggugagcauccuugccucaagucuguugaggaacgacgucccuauggcugguccccucguggcagggggacugcuaauugccuguuauguaaucaccggcacguccgcggaucugacaguggaaaaggcugccgacauaaccugggaggaaggcgcagagcagacuggggucucucacaaccuuaugauuacaguugacgaugacggaaccaugcgcaucaaagaugacgaaacugagaauauccucacagugcuguugaagaccgccuuacugauugugagcgguauauuuccauacuccaucccggcuacgcuccuggucuggcauacuuggcagaaacagacccaacggucaggcgugcuuugggauguuccuagucccccagagacacagaaggccgaacuggaggaagggguauacagaauuaaacagcagggaaucuucggcaagacccaagugggugucggggugcagaaggagggaguuuuucacacaauguggcacgugacuaggggcgcagucuugaccuauaacggcaaacgacuagagcccaauugggcuagugugaagaaagaccugauuucuuacgggggagguuggcgccucuccgcccaguggcaaaagggcgaagagguacaggucaucgcgguggaaccugggaaaaacccaaagaauuuccagacgaugcccggaacauuccagacuaccacaggcgagauaggugccaucgcacuggauuuuaagccugggaccagcggaucgccgauuaucaaccgggaaggcaaaguugugggccuuuaugggaauggagucgugacuaagaacgguggcuacguuucagggauugcucaaaccaaugccgagccagacggacccacaccugaguuagaagaggaaauguucaaaaagagaaaccugacgaucauggaucuccauccaggcucugguaaaacuaggaaguauuugcccgcuauagugcgugaggcaauuaagcgccggcugagaacccucauccuggccccuacaagggucguggccgcugaaauggaggaggcgcuuaaagggcugccgauccgauaccagaccacugcaacaaagagugaacacaccggacgggagauuguagacuugaugugccaugccacguuuacuaugcgccuacugucccccgugagaguuccaaauuauaaccucaucauaauggaugaagcucacuucacagacccugccagcauugcagccaggggcuacaucucuacccgggucggcaugggggaggcugcggccauuuuuaugaccgcaacucccccaggaacagcugaugccuucccucagagcaaugcacccauccaggacgaagaacgagacauaccagagagauccuggaacucagguaaugaauggauuaccgauuuugccggcaaaacagugugguucgugccgaguaucaaggcugggaacgacaucgccaacuguuuacgcaaaaauggaaagaaggucauucaacugagcaggaaaacuuuugauacggaguaccagaagaccaaacuuaacgacugggauuucguagugacaacugacaucucugaaaugggcgcgaauuuuaaggcagaucguguuauugacccucggagaugccugaaacccgugauacucaccgaugguccagagagggucaucuuggccgggcccaugccugugacagcugccuccgcugcacagcgccgaggcagaguuggacggaacccacagaaggagaaugaccaauauauuuucaccggccagccccugaacaaugaugaagaccaugcccacuggacugaggcuaagaugcuccuggacaacaucaauacgccugaagggaucauuccggcccuuuucgagccagaaagggagaaaucagcagcgauagauggagaguaccgccuaaagggugaaagucguaaaaccuuuguggagcugaugagacggggcgacuugcccgucugguuagcccacaagguggcuagcgaagggaucaaauauacagauaggaaguggugcuucgacggacagcgcaacaaucagauucuggaggaaaacauggauguagagaucuggacuaaagagggcgaaaagaagaaacuccgaccuagauggcuggacgcccggaccuacuccgauccccuugcacugaaggaguuuaaagaguucgcugccgguaggaagucuauugcacucgacuuggugacagagaucgggcgcguuccaucgcaucuggcccacagaaccaggaaugcucuagauaaccuggucaugcuccauacuagcgaacacggcggacgggcguaucgucacgccguggaggagcuuccugaaacaauggagacgcuguuauugcugggccucaugauacugcuuaccgggggagcaaugcuguuucucaucucagguaaaggcauugggaagacuuccaucggauugauuugugugaucgcuaguucuggcaugcuguggauggccgaaauacccuuacaauggauugccagcgcaaucguccuagaguucuuuaugaugguucugcucauuccagagccugaaaagcagcgcacaccgcaggacaaucaacuugcuuacgugguaaucgguauacugaccuuggccgcgaucauugcugccaacgagauggggcugcucgaaaccacaaaacgagaucugggcauguccaaggagcccggaguggucucaccaacuucuuaucuugacguggaucuccauccugcaagcgccuggacgcuguacgcuguugcaaccacagugaucacucccauguugagacacaccauugaaaauaguacagccaacgucucccuggcggcuaucgccaaccaggcaguaguguuaaugggccuagacaaaggguggccaauaagcaagauggaccugggaguuccucuccuugcccugggcugcuacucucaggugaaucccuugacccugacugcugccguccuccugcuuauuacgcauuaugcaaucaucgguccgggguuacaggcuaaagccacaagggaggcgcaaaagcggaccgccgcaggaauuaugaagaacccaacuguggauggcaucaugaccauagaccuggauccugucauuuacgacucaaaauucgagaagcagcucggucaggugauguugcugguucuaugugcugugcagcugcuccuuaugcgcacauccugggcccugugcgaagcauugacucuggcuaccggccccaucacaacgcucugggaggggaguccaggaaaauuuuggaauaccacuauugccguaagcauggccaacaucuucagaggcucguaucuggcgggggcuggauuagcauuuucuauaaugaaguccgugggcacagguaaaagggggaccggaagccaaggcgaaacucuuggugagaaguggaagaaaaagcugaaucagcucucacggaaagauuucgaccuauacaagaaaaguggcaucacagaagucgaucgaaccgaggccaaggaggggcugaaaagaggagaaauuacgcaccaugcuguuucucgcggcuccgccaaguugcagugguuuguggagaggaacauggucauccccgaagggcgggugauugaccugggauguggccgugguggguggagcuauuacugcgcaggacucaagaaaguaaccgaggugagaggcuauacaaagggcgggccuggacacgaggaaccgguucccaugucaacuuacgguuggaauaucgugaaacuuaugaguggcaaggaugucuucuaccugccaccugagaaaugugacaccuugcugugcgauauuggggaaagcucccccucuccuacaguggaggaaagcaggacuauccgcguccucaagaugguggagccaugguuaaagaacaaucaguucuguauaaaaguucugaaccccuauaugccuaccguaauugagcaccuugaacggcugcaacgaaagcauggaggcaugcuagugagaaauccacucuccaggaacucaacacacgagauguacuggaucucuaaugguaccgggaacaucgucgccagugugaauaugguuucgcgccuguugcugaaccgguuuacuaugacgcauagacgucccacaauugaaaaagacguggaucucggagcuggcaccaggcacgucaacgcggagccggaaacuccuaauauggacgugauaggcgagcggaucaagcgcauuaaagaggaacacaacagcaccuggcauuaugacgaugagaauccauacaagacaugggccuaucacggguccuacgaaguaaaggcaacgggaucugcuucaagcaugaucaacggugugguuaaacuucugaccaagcccugggacgucgugccuauggugacucagauggccaugacagauaccacuccauucggccagcaacgagucuuuaaagagaagguugacacaagaacccccagguccaugccggggacacggcgcgugaugggaauuacugcagaaugguuauggagaacccugggcaggaauaaaaagccucgauugugcacgcgggaggaguucaccaagaaaguacguacaaacgccgcuaugggugccguguuuacugaagagaaucagugggauagugcgaaggcagccgucgaagacgaggauuucuggaaacucguggacagagaacgcgagcugcauaagcuagggaaauguggaucuugcguuuauaacaugaugggcaagagggagaagaaacuuggcgaauuugggaaagcuaaaggaagccgggccaucugguacauguggcugggugcaagauaccucgaguucgaagcucugggcuuuuugaaugaggaucacugguucucacgcgagaacuccuauagugggguggaaggagagggccugcauaagcucgguuacauacuuagggacaucagcaaaauucccgggggagccauguaugcugaugacaccgccggcugggacacacgaaucacugaagaugaccugcacaaugaggaaaagauuacccagcagauggauccagagcaccggcaauuagcaaacgcgaucuuuaaacugacguaccagaauaaggucgugaagguacagagaccuacacccaccggcacuguuauggacauaauuucuaggaaagaucagcgcggguccggacaaguggguacauauggcuugaacaccuucacuaauauggaggcccagcucauccgucagauggaaggggagggaguccugucaaaggcugaccuagaaaacccacaucuucccgagaaaaagaucacccaguggcuggaaacaaaaggcguggagcggcucaagagaauggccauuagcggugaugacugcguggucaagccuauagaugacagguuugcaaacgcucuguuggccuuaaaugauauggggaaaguucgcaaggacaucccacaauggcagccgucgaaaggauggcacgauuggcaacaggugcccuucuguucucaucacuuccacgagcugauuaugaaggacggccgaaaacucguagugccuugccggccacaagacgaacuuaucggcagagcaaggauuagucagggggccggauggucccugaaggagacggcgugucuagguaaggcuuacgcccagauguggagccugauguauuuucaucgcagagaucuccgguuggcaucaaacgccaucugcuccgcuguccccgugcacuggguuccuaccucuaggacuacauggagcauacaugcccaccaucaauggaugaccacugaagacaugcugacaguguggaaucgugucuggaucgaggauaacccauggauggaagacaaaacccccgugacgacaugggagaauguaccuuaccuuggcaagcgagaggaucaguggugugggagucugauuggacucaccucccgcgcaacuugggcucagaacaucccgaccgccauucagcaaguuaggagcuuaaucggcaaugaagaguuccuggacuacaugccaucuaugaaacgguuuaggaaggaagaggagucagaaggugcgauuugguga

SEQ ID NO: 15314 - RNA, 9873 nt, Artificial Sequence
  derived and/or modified CDS sequence (opt3) from DENV-3__JF937641__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacgcuuuuguccucaagaaagaggugucugaaacgcagcacgggaccauccugauuaaggucgaguacaagggagaagaugugcccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgcaggugcuugggagaauggcgucugugggauacgaagcaccacacgcauggaaaaccuccuguggaaacagaucgccaaugagcuuaacuauauuuugugggaaaauaacaucaagcugacgguuguggugggagacauuaucggcguacucgagcaggggaaaagaacccugacuccacagccuauggaguuaaaguacucauggaaaacauggggaaaggcgaagauagucaccgccgaaacacaaaacaguuccuucauuaucgauggccccaauacuccagagugccccagcgugucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaaccauaggcccggguaucacacacaaacugccggaccuuggcaccuuggcaaguuggagcuggacuuuaauuacugcgaggggaccacaguggugauuacggaaaacuguggaacccguggcccaaguuuacggacuacaaccgucucugguaaacucauccaugaguggugcugucgaagcugcacucugcccccucuuagauauaugggggaagauggauguugguacggcauggagauaaggccaauuuccgaaaaggaggagaauaugguuaaaucacuggugagcgcugguucuggcaagguagacaacuucacaauggggguguugugccucgccauccuguuugaagaggucaugcgcggaaaguucggcaaaaagcacaugaucgcagggguguucuuuaccuucguucuacugcucuccggacagauuacguggcgggauauggcucauacucugaucaugauuggcaguaaugccagcgacagaauggguaugggggugaccuaucuugcauugauagccacauuuaaaauccagcccuuccuggcuuuaggauuuuuccucaggaagcugaccucucgcgaaaaccuucugcuaggcgucggccucgcgauggccacuacacugcaauugccggaggauauugaacagauggcaaaugggaucgcucugggauuaauggcccucaaacugauuacccaguuugagacauaccagcuuuggacugcccugaucuccuugaccuguucaaacacgauauucacacucaccguggcuuggcgaacugcaacccugauccuagccgguguuagucugcuuccugugugccaaagcucguccaugcggaagacagacuggcucccaauggcggucgcugccaugggcguacccccucugcccuuguuuauuuucgggcugaaggauacuuuaaaacguagaucuuggccacucaaugagggagugauggcaguuggccuggugagcauccuugccucaagucuguugaggaacgacgucccuauggcugguccccucguggcagggggacugcuaauugccuguuauguaaucaccggcacguccgcggaucugacaguggaaaaggcugccgacauaaccugggaggaagaggcagaacagacuggcgucucucacaaccuuaugauuacaguugacgaugacgggaccaugcgcaucaaagaugacgagacugagaauauccucacagugcuguugaagaccgccuuacugauugugagcggaauauuuccauacuccaucccggcuacgcuccuggucuggcauacuuggcagaaacagacccaacggucaggugugcuuugggauguuccuagccccccagaaacacagaaggccgagcuggaagagggcguauacagaauuaaacagcaggggaucuucggaaagacccaagugggcgucggugugcagaaggaggggguuuuucacacaauguggcacgugacuaggggagcagucuugaccuauaacggcaaacgacuagaacccaauugggcuagugugaagaaagaccugauuucuuacggcgggggauggcgccucuccgcccaguggcaaaagggugaggaaguacaggucaucgcgguggagccuggcaaaaacccaaagaauuuccagacgaugcccgggacauuccagacuaccacaggagaaauaggcgccaucgcacuggauuuuaagccugguaccagcgggucgccgauuaucaaccgggagggaaaaguugugggccuuuauggcaauggggucgugacuaagaacggagguuacguuucaggcauugcucaaaccaaugccgagccagacgggcccacaccugaauuagaggaagagauguucaaaaagagaaaccugacgaucauggaucuccauccaggaucuggcaaaacuaggaaguauuugcccgcuauagugcgugaagcaauuaagcgccggcugagaacccucauccuggccccuacaagggucguggccgcugagauggaggaagcgcuuaaaggucugccgauccgauaccagaccacugcaacaaagagugagcacaccgggcgggaaauuguagacuugaugugccaugccacguuuacuaugcgccuacugucccccgugagaguuccaaauuauaaccucaucauaauggaugaggcucacuucacagacccugccagcauugcagccaggggauacaucucuacccgggucggcaugggcgaagcugcggccauuuuuaugaccgcaacucccccagggacagcugaugccuucccucagagcaaugcacccauccaggacgaggagcgagacauaccagaaagauccuggaacucaggaaaugaguggauuaccgauuuugccgguaaaacagugugguucgugccgaguaucaaggcuggcaacgacaucgccaacuguuuacgcaaaaaugggaagaaggucauucaacugagcaggaaaacuuuugauacggaauaccagaagaccaaacuuaacgacugggauuucguagugacaacugacaucucugagaugggagcgaauuuuaaggcagaucguguuauugacccucggagaugccugaaacccgugauacucaccgauggcccagagagggucaucuuggccggucccaugccugugacagcugccuccgcugcacagcgccgagggagaguuggccggaacccacagaaggaaaaugaccaauauauuuucaccggacagccccugaacaaugaugaggaccaugcccacuggacugaagcuaagaugcuccuggacaacaucaauacgccugagggcaucauuccggcccuuuucgaaccagagagggagaaaucagcagcgauagauggggaauaccgccuaaagggagagagucguaaaaccuuuguggaacugaugagacggggugacuugcccgucugguuagcccacaagguggcuagcgagggcaucaaauauacagauaggaaguggugcuucgacgggcagcgcaacaaucagauucuggaagagaacauggauguagagaucuggacuaaagaaggagagaagaagaaacuccgaccuagauggcuggacgcccggaccuacuccgauccccuugcacugaaggaauuuaaagaguucgcugccggcaggaagucuauugcacucgacuuggugacagaaaucggucgcguuccaucgcaucuggcccacagaaccaggaaugcucuagauaaccuggucaugcuccauacuagcgagcacgggggccgggcguaucgucacgccguggaggaacuuccugagacaauggaaacgcuguuauugcugggacucaugauacugcuuaccggcggggcaaugcuguuucucaucucaggaaaagguauuggcaagacuuccaucggguugauuugugugaucgcuaguucuggaaugcuguggauggccgagauacccuuacaauggauugccagcgcaaucguccuagaguucuuuaugaugguucugcucauuccagaaccugagaagcagcgcacaccgcaggacaaucaacuugcuuacgugguaaucggcauacugaccuuggccgcgaucauugcugccaacgaaaugggucugcucgagaccacaaaacgagaucuggggauguccaaggaacccggcguggucucaccaacuucuuaucuugacguggaucuccauccugcaagcgccuggacgcuguacgcuguugcaaccacagugaucacucccauguugagacacaccauugagaauaguacagccaacgucucccuggcggcuaucgccaaccaggcaguaguguuaaugggacuagacaaaggcuggccaauaagcaagauggaccuggggguuccucuccuugcccugggaugcuacucucaggugaaucccuugacccugacugcugccguccuccugcuuauuacgcauuaugcaaucaucggcccggguuuacaggcuaaagccacaagggaggcgcaaaagcggaccgccgcagggauuaugaagaacccaacuguggauggaaucaugaccauagaccuggauccugucauuuacgacucaaaauucgaaaagcagcucggccaggugauguugcugguucuaugugcugugcagcugcuccuuaugcgcacauccugggcccugugcgaggcauugacucuggcuaccggucccaucacaacgcucugggaaggcaguccagggaaauuuuggaauaccacuauugccguaagcauggccaacaucuucagaggaucguaucuggcgggcgcuggguuagcauuuucuauaaugaaguccgugggaacaggcaaaagggguaccgggagccaaggagagacucuuggcgaaaaguggaagaaaaagcugaaucagcucucacggaaagauuucgaccuauacaagaaaagugguaucacagaggucgaucgaaccgaggccaaggaaggccugaaaagaggggagauuacgcaccaugcuguuucucgcggauccgccaaguugcagugguuuguggaaaggaacauggucauccccgagggccgggugauugaccugggguguggacguggcgguuggagcuauuacugcgcagggcucaagaaaguaaccgaagugagaggauauacaaagggcggcccugggcacgaggagccgguucccaugucaacuuacggauggaauaucgugaaacuuaugagugguaaggaugucuucuaccugccaccugaaaaaugugacaccuugcugugcgauauuggcgagagcucccccucuccuacaguggaagagagcaggacuauccgcguccucaagaugguggagccaugguuaaagaacaaucaguucuguauaaaaguucugaaccccuauaugccuaccguaauugaacaccuugagcggcugcaacgaaagcaugggggaaugcuagugagaaauccacucuccaggaacucaacacacgaaauguacuggaucucuaauggcaccgguaacaucgucgccagugugaauaugguuucgcgccuguugcugaaccgguuuacuaugacgcauagacgucccacaauugagaaagacguggaucucggggcuggaaccaggcacgucaacgcggaaccggagacuccuaauauggacgugauaggcgagcggaucaagcgcauuaaagaagagcacaacagcaccuggcauuaugacgaugaaaauccauacaagacaugggccuaucacggcuccuacgagguaaaggcaacggggucugcuucaagcaugaucaacggagugguuaaacuucugaccaagcccugggacgucgugccuauggugacucagauggccaugacagauaccacuccauucggucagcaacgagucuuuaaagaaaagguugacacaagaacccccagguccaugccgggcacacggcgcgugauggggauuacugcagagugguuauggagaacccugggaaggaauaaaaagccucgauugugcacgcgggaggaauucaccaagaaaguacguacaaacgccgcuaugggcgccguguuuacugaggaaaaucagugggauagugcgaaggcagccgucgaggacgaagauuucuggaaacucguggacagagagcgcgagcugcauaagcuagguaaaugugggucuugcguuuauaacaugaugggaaagagggaaaaaaagcuuggcgaguuuggcaaggcuaaagggagccgggccaucugguacauguggcugggagcaagauaccucgaauucgaggcucuggguuuuuugaaugaggaucacugguucucacgcgaaaacuccuauaguggcguggagggggaaggacugcauaagcucggcuacauacuuagggacaucagcaaaauucccgguggggccauguaugcugaugacaccgccggaugggacacacgaaucacugaggaugaccugcacaaugaagagaagauuacccagcagauggauccagagcaccggcaauuagcaaacgcgaucuuuaaacugacguaccagaauaaggucgugaagguacagagaccuacacccaccggcacuguuauggacauaauuucuaggaaagaucagcgcggcuccgggcaagugggaacauaugguuugaacaccuucacuaauauggaagcccagcucauccgucagauggagggcgaagggguccugucaaaggcugaccuagagaacccacaucuucccgaaaaaaagaucacccaguggcuggagacaaaaggaguggagcggcucaagagaauggccauuagcggcgaugacugcguggucaagccuauagaugacagguuugcaaacgcucuguuggccuuaaaugauauggguaaaguucgcaaggacaucccacaauggcagccgucgaaaggguggcacgauuggcagcaggugcccuucuguucucaucacuuccacgaacugauuaugaaggacggacgaaaacucguagugccuugccggccacaagacgagcuuaucggcagagcaaggauuagucagggcgccggguggucccugaaggaaacggcgugucuaggaaaggcuuacgcccagauguggagccugauguauuuucaucgcagagaucuccgguuggcaucaaacgccaucugcuccgcuguccccgugcacuggguuccuaccucuaggacuacauggagcauacaugcccaccaucaauggaugaccacugaggacaugcugacaguguggaaucgugucuggaucgaagauaacccauggauggaggacaaaacccccgugacgacaugggagaauguaccuuaccuugguaagcgagaagaucagugguguggcagucugauugggcucaccucccgcgcaacuugggcucagaacaucccgaccgccauucagcaaguuagaagcuuaaucggaaaugaggaauuccuggacuacaugccaucuaugaaacgguuuaggaaggaggaggaaucagagggcgcgauuugguga

SEQ ID NO: 15315 - RNA, 9873 nt, Artificial Sequence
  derived and/or modified CDS sequence (opt3) from DENV-3__JF920396__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcgcgcuguugacauggaucgggcucaauuccaagaacaccucaaugaguuuuagcugcauugcuauaggaaucauuacucuguauuuaggcgccguagugcaggcagacauggguuguguugucaauuggaaagggaaggagcugaagugcggauccggcaucuucgugacaaacgaggugcauaccuggacugaacaguacaaauuucaagccgauucucccaagcggcuagcuaccgccauugcaggugcuugggagaauggcgucugugggauccgaagcacaacgcgcauggaaaaccuccuguggaaacagauagccaaugagcuuaacuauaucuugugggaaaauaacauuaagcugaccguuguggugggagacaucauuggcguacucgagcaggggaaaagaacucugacaccacagccuauggaguuaaaguacucauggaaaaccuggggaaaggcgaagaucgucacagccgaaacucaaaacaguuccuucauaauugauggccccaauaccccagagugccccagcgugucuagggcuuggaacguuugggaaguggaggacuaugguuuuggggucuucacgacaaauaucuggcugaaacuucgggaaguguacacccaguugugugaccaccgccucaugucagcagccguuaaggaugagagagcugugcacgccgacaugggauacuggauugagagucagaaaaacggcagcuggaagcuggaaaaagcaucccuaaucgagguaaagacuugcaccuggccuaagucucauacacuguggucgaaugguguccucgaaagcgauaugauaaucccaaaaucccuggcgggcccgauuucacagcacaaccauaggcccggguaucacacucaaaccgccggaccuuggcaccuuggcaaguuggagcuggacuuuaauuacugcgaggggacaacgguggugaucaccgaaaacuguggaacucguggcccaaguuuacggacaaccacugucucugguaaacucauucaugaguggugcugucgaagcugcacacugcccccucuuagauauaugggggaagauggauguugguacggcauggagaucaggccaauauccgaaaaggaggagaauaugguuaaaucacuggugagcgcugguucuggcaagguagacaacuucaccauggggguguugugccucgccauucuguuugaagaggucaugcgcggaaaguucggcaaaaagcacaugaucgcagggguguucuuuacguucguucuacugcucuccggacagaucacuuggcgggauauggcucauacccugauuaugaucggcaguaaugccagcgacagaauggguaugggggugacauaucuugcauugauugccaccuuuaaaauacagcccuuccuggcuuuaggauuuuuccucaggaagcugacuucucgcgaaaaccuucugcuaggcgucggccucgcgauggccacaacccugcaauugccggaggauaucgaacagauggcaaaugggauugcucugggauuaauggcccucaaacugaucacacaguuugagacuuaccagcuuuggaccgcccugauuuccuugacguguucaaacacaaucuucacccucacuguggcuuggcgaaccgcaacacugauacuagccgguguuagucugcuuccugugugccaaagcucguccaugcggaagacugacuggcucccaauggcggucgcugccaugggcguacccccucugcccuuguuuaucuucucucugaaggauaccuuaaaacguagaagcuggccacucaaugagggggugauggcaguuggacuggugucaauucuugccaguucccuguugaggaacgacgucccuauggcuggcccccucguggcaggugggcugcuaaucgccuguuauguaauuacgggaacaucugcggaucugaccguggaaaaggcugccgacaucacuugggaggaagaggcagaacagacaggcgucagccacaaccuuaugauaaccguugacgaugacggcacuaugcgcauuaaagaugacgagacagagaauauccucaccgugcuguugaagacggccuuacugaucguguccgggauuuuuccauacucaauaccggcuacucuccuggucuggcauaccuggcagaaacagacacaacggagcggagugcuuugggauguuccuagucccccagaaacccagaaggccgagcuggaagaggguguauacagaaucaaacagcagggcauuuucgggaagacacaagugggagucggcgugcagaaggaggguguuuuucacacuauguggcacgugaccaggggggcagucuugacguauaacggaaaacgacuagaacccaauugggcuucugugaagaaagaccugaucuccuacggcggcggguggcgccucagcgcccaguggcaaaagggagaggaaguacaggucauugcgguggagccugguaaaaacccaaagaauuuccagacaaugcccggcacuuuccagaccacaaccggggaaaucggagccauagcacuggauuuuaagccuggcacuucggguucaccgaucauuaaccgggaggggaaaguugugggacuuuauggcaauggcgucgugaccaagaacgggggauacguuucugguaucgcucaaacaaaugccgagccagacggccccacgccugaauuagaggaagagauguucaaaaagagaaaccugacuauuauggaucuccauccagggaguggaaaaaccaggaaguauuugcccgcuaucgugcgugaagcaauaaagcgccggcugagaacacucauucuggccccuaccagggucguggccgcugagauggaggaagcgcuuaaaggccugccgauccgauaccagacuacagcaaccaaguccgagcacacgggucgggaaaucguagacuugaugugccaugccacuuuuacaaugcgccuacugagccccgugagaguuccaaauuauaaccucauuaucauggaugaggcucacuucaccgacccugccucuauagcagccaggggguacauuagcacccgggucggaaugggcgaagcugcggccaucuuuaugacugcaacacccccaggcaccgcugaugccuucccucaguccaaugcacccauucaggacgaggagcgagacaucccagaaagaucauggaacagugggaaugaguggauaacagauuuugccggaaaaacugugugguucgugccgagcauuaaggcugguaacgacaucgccaacuguuuacgcaaaaauggcaagaaggucauccaacugucuaggaaaacguuugauaccgaauaccagaagacaaaacuuaacgacugggauuucguagugacuaccgacauuuccgagaugggggcgaauuuuaaggcagaucguguuaucgacccucggagaugccugaaacccgugauucucacagauggaccagagagggucauauuggccggccccaugccugugaccgcugccucagcugcacagcgccgagguagaguugggcggaacccacagaaggaaaaugaccaauauaucuucacuggccagccccugaacaaugaugaggaccaugcccacuggacggaagcuaagaugcuccuggacaacauuaauaccccugagggaaucaucccggcccuuuucgaaccagagagggagaaaagugcagcgauugauggcgaauaccgccuaaagggggagagccguaaaacauuuguggaacugaugagacggggagacuugcccgucugguuagcccacaagguggcuuccgaggguauaaaauauacugauaggaaguggugcuucgacggccagcgcaacaaucagauccuggaagagaacauggauguagagauuuggaccaaagaaggggagaagaagaaacuccgaccuagauggcuggacgcccggacauacucugauccccuugcacugaaggaauuuaaagaguucgcugccggaaggaagucgaucgcacucgacuuggugaccgaaauuggccgcguuccaagccaucuggcccacagaacuaggaaugcucuagauaaccuggucaugcuccauacaucagagcacggugggcgggcguaucgucacgccguggaggaacuuccugagacgauggaaacccuguuauugcugggccucaugauccugcuuacuggaggcgcaaugcuguuucucauauccgggaaaggaaucgguaagacaaguauuggcuugaucugugugauugcuucuagcgggaugcuguggauggccgagauccccuuacaauggauagccuccgcaauuguccuagaguucuuuaugaugguucugcucaucccagaaccugagaagcagcgcaccccgcaggacaaucaacuugcuuacgugguaauuggaauccugaccuuggccgcgauaaucgcugccaacgaaaugggccugcucgagacaacuaaacgagaucuggguaugucaaaggaacccgggguggucucuccaacgagcuaucuugacguggaucuccauccugcaagugccuggacccuguacgcuguugcaacaacugugauuacccccauguugagacacacaaucgagaauuccaccgccaacgucagccuggcggcuauugccaaccaggcaguaguguuaaugggccuagacaaaggauggccaaucucuaagauggaccugggcguuccucuccuugcccuggggugcuacucacaggugaaucccuugacucugacggcugccguccuccugcuuauaacacauuaugcaauuaucggaccgggcuuacaggcuaaagccaccagggaggcgcaaaagcggacugccgcagguaucaugaagaacccaaccguggaugggauuaugacaaucgaccuggauccugucauauacgacuccaaauucgaaaagcagcucggacaggugauguugcugguucuaugugcugugcagcugcuccuuaugcgcacuaguugggcccugugcgaggcauugacccuggcuacaggccccauuacgacccucugggaagguagcccaggcaaauuuuggaauacuacaaucgccguaucgauggccaacauuuucagagggucuuaucuggcgggagcuggcuuagcauuuuccaucaugaagagcguggggaccggaaaaaggggcacugguucacaaggggagacacuuggagaaaaguggaagaaaaagcugaaucagcucagucggaaagauuucgaccuauacaagaaaucuggcauaaccgaggucgaucgaacggaggccaaggaaggucugaaaagaggcgagaucacccaccaugcuguuucccgcgggagcgccaaguugcagugguuuguggaaaggaacauggucauucccgagggacgggugaucgaccugggcugugggcguggaggcuggucauauuacugcgcaggucucaagaaaguaacagaagugagaggguauacuaagggaggcccuggccacgaggagccgguucccaugaguaccuacggguggaauauugugaaacuuaugagcggaaaggaugucuucuaccugccaccugaaaaaugugacacauugcugugcgauaucggugaguccucucccagcccuacuguggaagaguccaggaccauucgcguccucaagaugguggagccaugguuaaagaacaaucaguucuguaucaaaguucugaaccccuauaugccuacaguaauagaacaccuugagcggcugcaacgaaagcauggcgggaugcuagugagaaauccacucucaaggaacucuacccacgaaauguacuggauuaguaauggaacuggcaacaucgucgccucggugaauaugguuagccgccuguugcugaaccgguuuacgaugacacauagacgucccaccaucgagaaagacguggaucucggugcugggacuaggcacgucaacgcggaaccggagaccccuaauauggacgugauuggagagcggauaaagcgcaucaaagaagagcacaacuccacauggcauuaugacgaugaaaauccauacaagacgugggccuaucacggcucuuacgagguaaaggcaaccggcucagcuagcuccaugauuaacggggugguuaaacuucugacuaagcccugggacgucgugccuauggugacacagauggccaugaccgauacuacaccauucggacagcaacgagucuuuaaagaaaagguugacaccagaacacccaggaguaugccggguacucggcgcgugaugggcaucaccgcagagugguuauggagaacgcuggggaggaauaaaaagccucgauugugcacccgggaggaauucacaaagaaaguacguacuaacgccgcuaugggagccguguuuaccgaggaaaaucagugggauucugcgaaggcagccgucgaggacgaagauuucuggaaacucguggacagagagcgcgagcugcauaagcuaggcaaaugugguagcugcguuuauaacaugauggggaagagggaaaaaaagcuuggagaguuuggcaaggcuaaaggcucacgggccauuugguacauguggcugggggcaagauaccucgaauucgaggcucugggauuuuugaaugaggaucacugguucucccgcgaaaacaguuauagcgguguggagggcgaagggcugcauaagcucggauacauccuuagggacauaucuaaaauccccggcggugccauguaugcugaugacacagccgggugggacacucgaauuaccgaggaugaccugcacaaugaagagaagaucacgcagcagauggauccagagcaccggcaauuagcaaacgcgauuuuuaaacugacauaccagaauaaggucgugaagguacagagaccuacccccacuggaacaguuauggacaucauauccaggaaagaucagcgcggcucaggccaaguggggaccuauggauugaacacuuucaccaauauggaagcccagcucauucgucagauggagggugaaggcguccugagcaaggcugaccuagagaacccacaucuucccgaaaaaaagaucacacaguggcuggagacgaaagggguggagcggcucaagagaauggccaucucgggagaugacugcguggucaagccuauugaugacagguuugcaaacgcucuguuggccuuaaaugauaugggcaaaguucgcaaggacauaccacaauggcagccgucuaaagguuggcacgauuggcagcaggugcccuucuguagucaucacuuccacgaacugaucaugaaggacgggcgaaaacucguagugccuugccggccacaagacgagcuuauuggaagagcaaggaucucccagggcgccggcuggagccugaaggaaaccgcgugucuagggaaggcuuacgcccagauguggucacugauguauuuucaucgcagagaucuccgguuggcauccaacgccauuugcucugcuguccccgugcacuggguuccuacuagcaggacaaccuggaguauccaugcccaccaucaauggaugacuacagaggacaugcugaccguguggaaucgugucuggauagaagauaacccauggauggaggacaaaacgcccgugacaaccugggagaauguaccuuaccuuggaaagcgagaagaucaguggugugguucccugaucggccucacuagccgcgcaaccugggcucagaacauuccgacagccauccagcaaguuagaucuuuaauugggaaugaggaauuccuggacuacaugccaucaaugaaacgguuuaggaaggaggaggaaagugagggagcgaucugguga

SEQ ID NO: 15316 - RNA, 9873 nt, Artificial Sequence
  derived and/or modified CDS sequence (opt3) from DENV-3__JF920406__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacgcuuuuguccucaagaaagaggugucugaaacgcagcacgggaccauccugauuaaggucgaguacaagggagaagaugugcccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgcaggugcuugggagaauggcgucugugggauacgaagcaccacacgcauggaaaaccuccuguggaaacagaucgccaaugagcuuaacuauauuuugugggaaaauaacaucaagcugacgguuguggugggagacauuaucggcguacucgagcaggggaaaagaacccugacuccacagccuauggaguuaaaguacucauggaaaacauggggaaaggcgaagauagucaccgccgaaacacaaaacaguuccuucauuaucgauggccccaauacuccagagugccccagcgugucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaaccauaggcccggguaucacacacaaacugccggaccuuggcaccuuggcaaguuggagcuggacuuuaauuacugcgaggggaccacaguggugauuacggaaaacuguggaacccguggcccaaguuuacggacuacaaccgucucugguaaacucauccaugaguggugcugucgaagcugcacucugcccccucuuagauauaugggggaagauggauguugguacggcauggagauaaggccaauuuccgaaaaggaggagaauaugguuaaaucacuggugagcgcugguucuggcaagguagacaacuucacaauggggguguugugccucgccauccuguuugaagaggucaugcgcggaaaguucggcaaaaagcacaugaucgcagggguguucuuuaccuucguucuacugcucuccggacagauuacguggcgggauauggcucauacucugaucaugauuggcaguaaugccagcgacagaauggguaugggggugaccuaucuugcauugauagccacauuugaaauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaccagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaauggcggucgcugccaugggcguacccccucugcccuuguuuauuuucgggcugaaggauacuuuaaagcguagaucuuggccacucaaugaaggagugauggcaguuggccuggugagcauccuugccucaagucuguugaggaacgacgucccuauggcugguccccucguggcagggggacugcuaauugccuguuauguaaucaccggcacguccgcggaucugacaguggagaaagcugccgacauaaccugggaagaggaagcagagcagacuggcgucucucacaaccuuaugauuacaguugacgaugacgggaccaugcgcaucaaggaugacgagacugaaaauauccucacagugcuguugaaaaccgccuuacugauugugagcggaauauuuccauacuccaucccggcuacgcuccuggucuggcauacuuggcagaagcagacccaacggucaggugugcuuugggauguuccuagccccccagagacacagaaagccgaacuggaggagggcguauacagaauuaagcagcaggggaucuucggaaaaacccaagugggcgucggugugcagaaggaagggguuuuucacacaauguggcacgugacuaggggagcagucuugaccuauaacggcaagcgacuagagcccaauugggcuagugugaaaaaggaccugauuucuuacggcgggggauggcgccucuccgcccaguggcaaaaaggugaagagguacaggucaucgcgguggaaccuggcaagaacccaaaaaauuuccagacgaugcccgggacauuccagacuaccacaggagagauaggcgccaucgcacuggauuuuaagccugguaccagcgggucgccgauuaucaaccgggagggaaagguugugggccuuuauggcaauggggucgugacuaaaaacggagguuacguuucaggcauugcucaaaccaaugccgaaccagacgggcccacaccugaguuagaagaggaaauguucaagaaaagaaaccugacgaucauggaucuccauccaggaucuggcaagacuaggaaauauuugcccgcuauagugcgugaggcaauuaagcgccggcugagaacccucauccuggccccuacaagggucguggccgcugagauggaagaggcgcuuaagggucugccgauccgauaccagaccacugcaacaaaaagugaacacaccgggcgggagauuguagacuugaugugccaugccacguuuacuaugcgccuacugucccccgugagaguuccaaauuauaaccucaucauaauggaugaagcucacuucacagacccugccagcauugcagccaggggauacaucucuacccgggucggcaugggcgaggcugcggccauuuuuaugaccgcaacucccccagggacagcugaugccuucccucagagcaaugcacccauccaggacgaggaacgagacauaccagagagauccuggaacucaggaaaugaauggauuaccgauuuugccgguaagacagugugguucgugccgaguaucaaagcuggcaacgacaucgccaacuguuuacgcaagaaugggaaaaaggucauucaacugagcaggaagacuuuugauacggaguaccagaaaaccaagcuuaacgacugggauuucguagugacaacugacaucucugagaugggagcgaauuuuaaagcagaucguguuauugacccucggagaugccugaagcccgugauacucaccgauggcccagaaagggucaucuuggccggucccaugccugugacagcugccuccgcugcacagcgccgagggagaguuggccggaacccacagaaagagaaugaccaauauauuuucaccggacagccccugaacaaugaugaagaccaugcccacuggacugaggcuaagaugcuccuggacaacaucaauacgccugaaggcaucauuccggcccuuuucgagccagagagggaaaagucagcagcgauagauggggaguaccgccuaaaaggagaaagucguaagaccuuuguggagcugaugagacggggugacuugcccgucugguuagcccacaaaguggcuagcgaaggcaucaaguauacagauaggaaauggugcuucgacgggcagcgcaacaaucagauucuggaggagaacauggauguagaaaucuggacuaaggagggagaaaaaaagaagcuccgaccuagauggcuggacgcccggaccuacuccgauccccuugcacugaaagaguuuaaggaauucgcugccggcaggaaaucuauugcacucgacuuggugacagagaucggucgcguuccaucgcaucuggcccacagaaccaggaaugcucuagauaaccuggucaugcuccauacuagcgagcacgggggccgggcguaucgucacgccguggaagagcuuccugaaacaauggagacgcuguuauugcugggacucaugauacugcuuaccggcggggcaaugcuguuucucaucucaggaaaggguauuggcaaaacuuccaucggguugauuugugugaucgcuaguucuggaaugcuguggauggccgagauacccuuacaauggauugccagcgcaaucguccuagaauucuuuaugaugguucugcucauuccagagccugaaaagcagcgcacaccgcaggacaaucaacuugcuuacgugguaaucggcauacugaccuuggccgcgaucauugcugccaacgagaugggucugcucgaaaccacaaagcgagaucuggggauguccaaagagcccggcguggucucaccaacuucuuaucuugacguggaucuccauccugcaagcgccuggacgcuguacgcuguugcaaccacagugaucacucccauguugagacacaccauugagaauaguacagccaacgucucccuggcggcuaucgccaaccaggcaguaguguuaaugggacuagacaagggcuggccaauaagcaaaauggaccuggggguuccucuccuugcccugggaugcuacucucaggugaaucccuugacccugacugcugccguccuccugcuuauuacgcauuaugcaaucaucggcccggguuuacaggcuaaggccacaagggaagcgcaaaaacggaccgccgcagggauuaugaagaacccaacuguggauggaaucaugaccauagaccuggauccugucauuuacgacucaaaguucgagaaacagcucggccaggugauguugcugguucuaugugcugugcagcugcuccuuaugcgcacauccugggcccugugcgaagcauugacucuggcuaccggucccaucacaacgcucugggagggcaguccagggaaguuuuggaauaccacuauugccguaagcauggccaacaucuucagaggaucguaucuggcgggcgcuggguuagcauuuucuauaaugaaauccgugggaacaggcaagagggguaccgggagccaaggagaaacucuuggcgagaaauggaagaagaaacugaaucagcucucacggaaggauuucgaccuauacaaaaagagugguaucacagaggucgaucgaaccgaagccaaagagggccugaagagaggggaaauuacgcaccaugcuguuucucgcggauccgccaaauugcagugguuuguggagaggaacauggucauccccgaaggccgggugauugaccugggguguggacguggcgguuggagcuauuacugcgcagggcucaagaagguaaccgaggugagaggauauacaaaaggcggcccugggcacgaggaaccgguucccaugucaacuuacggauggaauaucgugaagcuuaugagugguaaagaugucuucuaccugccaccugagaagugugacaccuugcugugcgauauuggcgaaagcucccccucuccuacaguggaggagagcaggacuauccgcguccucaaaaugguggaaccaugguuaaagaacaaucaguucuguauaaagguucugaaccccuauaugccuaccguaauugagcaccuugaacggcugcaacgaaaacaugggggaaugcuagugagaaauccacucuccaggaacucaacacacgagauguacuggaucucuaauggcaccgguaacaucgucgccagugugaauaugguuucgcgccuguugcugaaccgguuuacuaugacgcauagacgucccacaauugaaaaggacguggaucucggggcuggaaccaggcacgucaacgcggagccggagacuccuaauauggacgugauaggcgaacggaucaaacgcauuaaggaggaacacaacagcaccuggcauuaugacgaugagaauccauacaaaacaugggccuaucacggcuccuacgaaguaaaggcaacggggucugcuucaagcaugaucaacggagugguuaagcuucugaccaaacccugggacgucgugccuauggugacucagauggccaugacagauaccacuccauucggucagcaacgagucuuuaaggagaaaguugacacaagaacccccagguccaugccgggcacacggcgcgugauggggauuacugcagagugguuauggagaacccugggaaggaauaagaaaccucgauugugcacgcgggaagaguucaccaagaagguacguacaaacgccgcuaugggcgccguguuuacugaagagaaucagugggauagugcgaaagcagccgucgaagacgaggauuucuggaagcucguggacagagagcgcgaacugcauaaacuagguaagugugggucuugcguuuauaacaugaugggaaaaagggagaagaaacuuggcgaauuuggcaaggcuaaggggagccgggccaucugguacauguggcugggagcaagauaccucgaguucgaggcucuggguuuuuugaaugaagaucacugguucucacgcgagaacuccuauaguggcguggaaggggagggacugcauaaacucggcuacauacuuagggacaucagcaagauucccgguggggccauguaugcugaugacaccgccggaugggacacacgaaucacugaagaugaccugcacaaugaggagaaaauuacccagcagauggauccagaacaccggcaauuagcaaacgcgaucuuuaagcugacguaccagaauaaagucgugaagguacagagaccuacacccaccggcacuguuauggacauaauuucuaggaaggaucagcgcggcuccgggcaagugggaacauaugguuugaacaccuucacuaauauggaggcccagcucauccgucagauggaaggcgaggggguccugucaaaagcugaccuagaaaacccacaucuucccgagaagaaaaucacccaguggcuggagacaaagggaguggaacggcucaaaagaauggccauuagcggcgaugacugcguggucaagccuauagaugacagguuugcaaacgcucuguuggccuuaaaugauauggguaagguucgcaaagacaucccacaauggcagccgucgaagggguggcacgauuggcagcaggugcccuucuguucucaucacuuccacgagcugauuaugaaagacggacgaaagcucguagugccuugccggccacaagacgaacuuaucggcagagcaaggauuagucagggcgccggguggucccugaaagagacggcgugucuaggaaaggcuuacgcccagauguggagccugauguauuuucaucgcagagaucuccgguuggcaucaaacgccaucugcuccgcuguccccgugcacuggguuccuaccucuaggacuacauggagcauacaugcccaccaucaauggaugaccacugaagacaugcugacaguguggaaucgugucuggaucgaggauaacccauggauggaggacaagacccccgugacgacaugggaaaauguaccuuaccuugguaaacgagaggaucagugguguggcagucugauugggcucaccucccgcgcaacuugggcucagaacaucccgaccgccauucagcaaguuagaagcuuaaucggaaaugaagaguuccuggacuacaugccaucuaugaagcgguuuaggaaagaggaagagucagaaggcgcgauuugguga

SEQ ID NO: 15317 - RNA, 9873 nt, Artificial Sequence
  derived and/or modified CDS sequence (opt3) from DENV-3__JF920409__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucgcccagaagguugugauauucaucuuacugaugcuugucacuccaucgaugaccaugcgcugugugggcguagggaacagagacuuuguugaaggauugucaggugcgacauggguggaugucgugcuggagcacggcgggugcgugaccacgauggcaaagaauaaacccacucuagacauugagcuccagaagacagaagccacccaacuggcuacucuuaggaaacuguguaucgagggaaagauuacaaacaucaccacggauagccggugcccuacccagggcgaagccacauugccagaggaacaggaccagaauuaugucuguaaacacacuuacguugaucgcgguugggggaacggaugcggccucuucggcaaggggagucuggugaccugcgcaaaguuucaauguuuagagcccauagagggaaaaguagugcaguaugaaaaucugaaguacacagucauuaucacugugcauaccggugaccagcaccagguuggcaacgagacacaaggggugaccgcugaaauuacuccucaggccuccacgacagaggcgauccucccagaauauggaacccuuggccuggagugcucuccgcgaacugguuuggacuucaaugagaugauccuacugaccaugaaaaacaaggccuggaugguccauagacagugguuuuucgaucucccccugccuuggacaagcggggcaaccacugaaacaccaacguggaauaggaaagagcuucuggugaccuuuaagaacgcucacgccaaaaagcaagaaguaguuguguugggcucccaggagggagcuaugcacacugcccucacaggcgcaaccgaaauucagaauucagggggaacaaguauauucgccggucaucugaagugucgguuaaaaauggacaagcuggagcuaaaaggcaugagcuacgcuaugugcacuaacaccuuuguccucaagaaagaggugucugaaacgcagcacgggaccauccugauuaaggucgaguacaagggagaagaugugcccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgcaggugcuugggagaauggcgucugugggauacgaagcaccacacgcauggaaaaccuccuguggaaacagaucgccaaugagcuuaacuauauuuugugggaaaauaacaucaagcugacgguuguggugggagacauuaucggcguacucgagcaggggaaaagaacccugacuccacagccuauggaguuaaaguacucauggaaaacauggggaaaggcgaagauagucaccgccgaaacacaaaacaguuccuucauuaucgauggccccaauacuccagagugccccagcgugucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaaccauaggcccggguaucacacacaaacugccggaccuuggcaccuuggcaaguuggagcuggacuuuaauuacugcgaggggaccacaguggugauuacggaaaacuguggaacccguggcccaaguuuacggacuacaaccgucucugguaaacucauccaugaguggugcugucgaagcugcacucugcccccucuuagauauaugggggaagauggauguugguacggcauggagauaaggccaauuuccgaaaaggaggagaauaugguuaaaucacuggugagcgcugguucuggcaagguagacaacuucacaauggggguguugugccucgccauccuguuugaagaggucaugcgcggaaaguucggcaaaaagcacaugaucgcaggggcuuucuuuauguucgugcuacugcucuccggacagauuaccuggcgggauauggcccauacgcugaucaugauuggcaguaaugcaagcgacagaauggguauggggguuacuuaucuugccuugauagcuaccuuuaaaauccagcccuuccuggcguuaggauuuuuccucaggaagcugacaucucgcgaaaaccuucugcuaggcgugggccucgccauggcaaccacucugcaauugccggaggauauugaacagauggcuaaugggaucgcccugggauuaauggcccucaaacugauuacacaguuugagaccuaccagcuuuggacagcucugaucuccuugacuuguucaaacaccauauucacgcucacagucgcauggcgaaccgccacucugauccuagcgggugugagucugcuuccuguuugccaaagcucguccaugcggaagaccgacuggcucccaauggcuguggccgcaaugggcguccccccucugcccuuguuuauuuucucucugaaggauacauuaaaacguagaagcuggccacucaaugaggggguaauggccgugggacugguuucaauccuugcuaguucccuguugaggaacgacgugccuauggcaggcccccucgucgccggugggcugcuaauugcguguuaugugaucacuggaaccucugcugaucugacgguagaaaaggccgcagacauaacaugggaggaagaggccgaacagaccggcgugagccacaaccuuaugauuacugucgacgaugacggcacaaugcgcaucaaagaugacgaguccgagaauauccucaccguucuguugaagacugcuuuacugauugugucagggauauuuccauacagcaucccggccacacuccugguguggcauaccuggcagaaacagacgcaacggaguggaguccuuugggaugugccuucucccccagaaacucagaaggcagagcuggaagaggguguuuacagaauuaaacagcagggcaucuucgggaagacccaaguaggagugggcguccagaaggaggguguguuucacacaauguggcacguuaccaggggggcuguguugacauauaacggaaaacgacuagaacccaauugggccuccgucaagaaagaccugauuagcuacggcggcggguggcgccucucggcgcaguggcaaaagggagaggaagugcagguaaucgccgucgagccugguaaaaacccaaagaauuuccagacuaugcccggcaccuuccagacgacaacuggggaaauaggagcaaucgcucuggauuuuaagccuggcaccucagguucuccgauuaucaaccgggaggggaaagugguuggacuuuauggcaauggcguggucacaaagaacgggggauacgugagugguauugcccaaaccaaugcugagccagacggccccacuccugaauuagaggaagagauguucaaaaagagaaaccugaccaucauggaucuccauccaggguccggaaaaacaaggaaguauuugcccgcaauaguucgugaagccauuaagcgccggcugagaacgcucauccuggccccuacuaggguggucgcugcggagauggaggaagcacuuaaaggccugccgauccgauaccagaccacagccaccaagagcgagcacacuggucgggaaauuguggacuugaugugccaugcuacauuuaccaugcgccuacugucucccguaagagugccaaauuauaaccucaucauaauggaugaggcccacuucacggacccugcaagcauugccgcuaggggguacaucuccacucggguuggaaugggcgaagcggccgcaauuuuuaugacagcuacccccccaggcaccgccgaugcauucccucagucaaaugcccccauccaggacgaggagcgagacauaccagaaagaaguuggaacagcgggaaugaguggauuacugauuuugcuggaaaaacagucugguucgugccgucuaucaaggccgguaacgacaucgcgaacuguuuacgcaaaaauggcaagaaggugauucaacuguccaggaaaaccuuugauacagaauaccagaagacuaaacuuaacgacugggauuucgucguaacgaccgacaucucagagaugggggcaaauuuuaaggccgaucgugugauugacccucggagaugccugaaacccguuauacucacagauggaccagagagggugaucuuggcuggccccaugccugucacugccgcuagugcagcccagcgccgagguagaguggggcggaacccacagaaggaaaaugaccaauauauuuucaccggccagccccugaacaaugaugaggaccaugcucacuggacagaagccaagaugcuccuggacaacaucaauaccccugagggaaucauuccggcacuuuucgaaccagagagggagaaaagcgcggccauagauggcgaauaccgccuaaagggggagucccguaaaacuuuuguugaacugaugagacggggagacuugcccgugugguuagcucacaaggucgccucugaggguaucaaauauacggauaggaaguggugcuucgacggccagcgcaacaaucagauucuggaagagaacauggauguggagaucuggaccaaagaaggggagaagaagaaacuccgaccuagauggcuggacgcacggacauacucggauccccuugcucugaaggaauuuaaagaguucgccgcaggaaggaagagcauugcccucgacuugguaacugaaaucggccgcgugccaucacaucuggcucacagaaccaggaaugcgcuagauaaccugguuaugcuccauacauccgagcacggugggcgggccuaucgucacgcagucgaggaacuuccugagaccauggaaacucuguuauugcugggccucaugauacugcuuacaggaggcgcuaugcuguuucucaucagugggaaaggaauugguaagacgucuaucggcuugauuugugugaucgccagcuccgggaugcuguggauggccgagauacccuuacaauggauugcaucagcuaucgugcuagaguucuuuaugaugguccugcucauuccagaaccugagaagcagcgcaccccgcaggacaaucaacuugccuacguugugaucggaauacugacuuuggcggcuaucauugccgcaaacgaaaugggccugcucgagacaaccaaacgagaucuggguaugucuaaggaacccgggguagugagcccaaccaguuaucuugacgucgaucuccauccugccuccgcuuggacacuguacgcaguggccacuacgguuaucacccccauguugagacacacaauugagaauagcacugcgaacgugucucuggcugccaucgcaaaccaggccgucguauuaaugggccuagacaaaggauggccaauaucaaagauggaccugggcgugccucuccuugcucuggggugcuacucccagguuaaucccuugacccugacagccgcagugcuccugcuuauuacccauuaugcuaucaucggaccgggcuuacaggccaaagcgacuagggaggcccaaaagcggacggcagcugguauuaugaagaacccaacagucgaugggaucaugaccauagaccuggauccugugauuuacgacaguaaauucgaaaagcagcucggacaggucauguugcuggugcuaugugccguucagcugcuccuuaugcgcacuagcugggcacugugcgaggcuuugacccuggccacaggccccaucacuacccucugggaagguucgccaggcaaauuuuggaauacaacgauugccgugucuauggcgaacaucuucagaggguccuaucuggcuggagcaggcuuagccuuuagcauaaugaagucaguagggaccggaaaaaggggcacugguagucaaggggagacacuuggagaaaaguggaagaaaaagcugaaucagcucucucggaaagauuucgaccuauacaagaaauccggcaucaccgagguggaucgaacugaggcuaaggaaggucugaaaagaggcgagauuacacaccaugccgucagccgcgggucagcaaaguugcagugguuuguugaaaggaacauggugauccccgagggacgggucauugaccugggcugugggcguggaggcuggaguuauuacugcgccggucucaagaaagugaccgaaguaagaggguauacgaagggaggcccuggccacgaggagccggugcccaugagcaccuacggguggaauaucguuaaacuuauguccggaaaggauguguucuaccugccaccugaaaaaugugacacauugcugugcgauauuggugagucuagccccuccccuacugucgaagagucaaggaccauccgcgugcucaagauggucgagccaugguuaaagaacaaucaguucuguauaaaagugcugaaccccuauaugccuacaguuauugaacaccuugagcggcugcaacgaaagcauggcgggaugcuaguaagaaauccacucucuaggaacaguacucacgaaauguacuggaucucgaauggaaccggcaacaucguggcuagcgucaauauggugucccgccuguugcugaaccgguuuacaaugacccauagacgucccacuauugagaaagacguugaucucggugcggggacgaggcacgugaacgccgaaccggagacaccuaauauggacgucauaggagagcggaucaagcgcauuaaagaagagcacaacucuaccuggcauuaugacgaugaaaauccauacaagacuugggcauaucacggcucauacgaggugaaggcuaccggcagcgccuccaguaugaucaacgggguagugaaacuucugacaaagcccugggacguugucccuauggugacgcagauggcaaugaccgauacuacaccauucggacagcaacgaguguuuaaagaaaaggucgacaccagaacucccaggucuaugccggguacacggcgcguuaugggcauuaccgccgagugguuauggagaacacuggggaggaauaaaaagccucgauugugcacucgggaggaauucaccaagaaagugcguacgaacgcugccaugggagcgguauuuaccgaggaaaaucagugggauagcgcaaaggccgcuguggaggacgaagauuucuggaaacucgucgacagagagcgcgagcugcauaagcuaggcaaaugugguucaugcguguauaacaugauggggaagagggaaaaaaagcuuggagaguuuggcaaggccaaaggcucccgggcaaucugguacauguggcugggggcuagauaccucgaauucgaggcccugggauuuuugaaugaggaucacugguucagucgcgaaaacagcuauucugguguugagggcgaagggcugcauaagcucggauacauacuuagggacaucuccaaaauucccggcggugcuauguaugccgaugacacagcagggugggacacucgaaucaccgaggaugaccugcacaaugaagagaagauuacacagcagauggauccagagcaccggcaauuagcgaacgccaucuuuaaacugacuuaccagaauaagguggucaaggugcagagaccuacccccacgggaacaguaauggacauaauuucaaggaaagaucagcgcggcagcggccaaguugggaccuauggauugaacacuuucacaaauauggaagcucagcucauccgucagauggagggugaaggcgugcugucgaaggccgaccuagagaacccacaucuucccgaaaaaaagaucacccaguggcuggagacuaaaggggucgagcggcucaagagaauggcaauuucuggagaugacugcguggugaagccuauagaugacagguuugcuaacgcccuguuggcauuaaaugauaugggcaaaguccgcaaggacaucccacaauggcagccgaguaaagguuggcacgauuggcagcagguucccuucuguucccaucacuuccacgaacugauuaugaaggacgggcgaaaacucgugguaccuugccggccacaagacgagcuuaucggaagagccaggauuagccagggcgcgggcuggucacugaaggaaaccgcuugucuagggaaggccuacgcacagauguggucccugauguauuuucaucgcagagaucuccgguuggccucuaacgcuaucugcagcgccgugcccguccacugggugccuacaaguaggacgaccugguccauacaugcacaccaucaauggaugacuacagaggacaugcugaccguuuggaaucguguguggaucgaagauaacccauggauggaggacaaaacucccgucacaaccugggagaaugugccuuaccuuggaaagcgagaagaucaguggugugguagccugauuggccucacgucucgcgcuacaugggcccagaacaucccgaccgcgauucagcaaguaagaucauuaaucgggaaugaggaauuccuggacuacaugccaaguaugaaacgguuuaggaaggaggaggaauccgagggagcuauuugguga

SEQ ID NO: 15318 - RNA, 9873 nt, Artificial Sequence
  derived and/or modified CDS sequence (opt3) from DENV-3__JF920408__SS-prME
accagccugugccucaugaugauccuucccgccgcucuggcauuccacuugacaucccgggacggagaaccuaggaugauuguggggaagaacgaacggggaaaaucuuuacuguuuaagacugccucagguauaaauauguguacgcuaaucgcgauggaucucggagaaaugugcgacgauaccgucacauacaaauguccacauauuacugaaguugaaccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgggacccaaggagugacugcagagauuacgccucaggcuuccacaaccgaagccauccucccagaguauggcacucuuggucuggaaugcucuccgcgaaccggguuggacuucaaugagaugauccuacugacaaugaaaaacaaggcguggaugguccauagacagugguuuuucgaucucccccugccuuggaccagcggcgccacuacagagacgccaaccuggaauaggaaagaacuucuggugacuuuuaagaacgcacacgcuaaaaagcaagagguaguuguguugggaucccaggaaggcgccaugcacacagcucucaccggggccacagagauucaaaauucaggagguacuggcauauucgcagggcaucugaagugucgguuaaaaauggacaagcuggaacuaaaaggaaugaguuacgccaugugcaccaacacguuuguccucaagaaagaggugagcgagacccagcacggcacaauccugauuaaggucgaauacaagggugaggaugugcccuguaaaaucccuuucucuacugaagacgggcaaggcaaggcucauaacggacgucuuauaaccgcgaauccaguugugacuaagaaggaggagcccguaaacauugaagcagagccgccuuucggcgaauccaauaucgucaucgggauuggagauaacgccuugaaaaucaauugguauaagaaggguucaagcauuggcaaaauguuugaggcuacugcccgcggggcaagaaggauggccauacugggagacaccgcuugggauuucggcagugugggugggguucucaacucucugggcaagauggugcaccagaucuuuggauccgccuacacggcacuuuucagcggcgucucgugggugaugaaaauugggaucggaguacuguugacauggaucggccucaauucuaagaacaccuccaugucauuuaguugcauugcgauagguaucauuacucuguauuuaggggcugugguucaggccgacaugggaugugucaucaauuggaaaggcaaggaacugaagugcgguagcggcauuuucgugacaaacgaggugcauaccuggacugagcaguacaaauuucaagcagauucccccaagcggcuagccaccgcuaucgccggggcaugggaaaauggagucuguggcauacgaucuacaacgcgcauggagaaccuccuguggaaacagaucgcuaaugaacuuaacuauauuuugugggagaauaacaucaagcugaccguuguggugggggacauuaucggaguacucgaacagggcaaaagaacucugacaccacagccuauggaguuaaaguacagcuggaaaaccugggguaaggccaagauagucacagcggagacucaaaacucaaguuucauuaucgaugggcccaauaccccagaaugccccuccgugagcagggccuggaacguuugggagguggaagacuauggauuuggcgucuucacgacaaauauuuggcugaaacuucgggagguguacacccaguugugugaccaccgccucaugucugcugcaguuaaggaugaaagagccgugcacgcugacauggguuacuggaucgagucacagaaaaacggcaguuggaagcuggagaaagccagccuaauagaaguaaagacuugcaccuggccuaagucccauacacuguggucuaaugggguccucgagucggauaugaucauuccaaaaagccuggcaggaccgaucucccagcacaaccauaggcccggcuaucacacucaaaccgcggggccuuggcaccuuggaaaguuggaacuggacuuuaauuacugcgagggcacaacgguggugauuaccgagaacugugguacucgugggccaucauuacggacaaccacugucaguggaaaacucauccaugaauggugcugucgaucuugcacacugcccccucuuagauauaugggcgaggaugguuguugguacggcauggaaauaaggccaauuagcgagaaggaagagaauaugguuaaaucccuggugucagccgggagcggaaagguagacaacuucaccaugggcguguugugccucgcuauccuguuugaggaagucaugcgcgggaaguucggcaagaagcacaugaucgccggcguguucuuuacguucguucuacugcucucuggucagauuacuuggcgggauauggcacauacccugaucaugauuggguccaaugcuagugacagaaugggaaugggcgugacauaucuugccuugauagcaaccuuuaaaauccagcccuuccuggccuuaggcuuuuuccucaggaagcugacuagccgcgagaaccuucugcuaggggucggacucgcuauggcgacaacccugcaauugccggaagauauugagcagauggccaaugguaucgcacugggcuuaauggcucucaaacugauuacacaguuugaaacuuaccagcuuuggaccgcccugaucucuuugacguguuccaacacaauauucacccucacuguggccuggcgaaccgcuacacugauccuagcagggguuucacugcuuccugugugccaaaguagcucgaugcggaagacugacuggcucccaauggccgucgcggcuaugggaguacccccucugcccuuguuuauuuucggccugaaggauaccuuaaaacguagauccuggccacucaaugagggugugauggccguugggcuggugucuauccuugcaagcucacuguugaggaacgacgucccuauggccggaccccucguggcuggcggccugcuaauugcauguuauguaaucacggggacaagugccgaucugaccguggagaaggcggcugacauaacuugggaagaggaagccgagcagacaggagucucccacaaccuuaugauuaccguugacgaugacgguacuaugcgcaucaaagaugacgaaacagagaauauccucaccgugcuguugaagacggcauuacugauugugucuggcauauuuccauacagcaucccggccacucuccuggucuggcauaccuggcagaaacagacacaacgguccggggugcuuugggauguuccuucacccccagagacccagaaggcugaacuggaggaaggaguauacagaauuaaacagcagggcaucuucgguaagacacaagugggggucggagugcagaaggagggcguuuuucacacuauguggcacgugaccaggggcgccgucuugacguauaacgggaaacgacuagagcccaauugggcaagcgugaagaaagaccugauuaguuacggagguggcuggcgccucucugcucaguggcaaaagggggaagagguacaggucaucgccguggaaccuggcaaaaacccaaagaauuuccagacaaugcccggcacuuuccagaccacaaccggugagauaggggcgaucgcccuggauuuuaagccuggaacuuccggcagcccgauuaucaaccgggaaggcaaaguuguggggcuuuauggaaauggugucgugaccaagaacggcggguacguuucgggaauugcacaaacaaaugcugagccagacggccccacgccugaguuagaagaggaaauguucaaaaagagaaaccugacuaucauggaucuccauccagguucagggaaaaccaggaaguauuugcccgccauagugcgugaggcuauuaagcgccggcugagaacacucauccuggcaccuaccagggucguggccgccgaaauggaggaggcucuuaaaggacugccgauccgauaccagacuacagcgaccaagucugaacacacgggccgggagauuguagacuugaugugccaugcaacuuuuacaaugcgccuacugagucccgugagaguuccaaauuauaaccucaucauaauggaugaagcccacuucaccgacccugcuuccauugccgcaaggggcuacaucagcacccgggucgggaugggagaggccgcugcgauuuuuaugacugccacacccccagguaccgcagaugcuuucccucagucuaaugcccccauccaggacgaagaacgagacauaccagagagaagcuggaacuccggcaaugaauggauuacagauuuugcagggaaaacugugugguucgugccgucaaucaaggccggaaacgacaucgcuaacuguuuacgcaaaaauggcaagaaggucauucaacugaguaggaaaacguuugauaccgaguaccagaagacaaaacuuaacgacugggauuucguagugacuaccgacaucagcgaaaugggugccaauuuuaaggcggaucguguuauugacccucggagaugccugaaacccgugauacucacagaugggccagagagggucaucuuggcaggccccaugccugugaccgccgcuucugccgcucagcgccgaggaagaguuggccggaacccacagaaggagaaugaccaauauauuuucacugggcagccccugaacaaugaugaagaccaugcacacuggacggaggccaagaugcuccuggacaacaucaauaccccugaaggaaucauuccggcucuuuucgagccagaaagggagaaauccgccgcaauagauggugaguaccgccuaaagggcgaaucacguaaaacauuuguggagcugaugagaagaggggacuugcccgucugguuagcgcacaagguggccagugaaggaaucaaauauacugauaggaaguggugcuucgacggccagcgcaacaaucagauucuggaggaaaacauggauguagagaucuggaccaaagagggugaaaagaagaaacuccgaccuagauggcuggacgcucggacauacagcgauccccuugcccugaaggaguuuaaagaguucgcagcugggaggaaguccauugcccucgacuuggugaccgagaucggccgcguuccaucucaucuggcacacagaacuaggaaugcccuagauaaccuggucaugcuccauacaucggaacacggaggccgggcuuaucgucacgcgguggaggagcuuccugaaacgauggagacccuguuauugcuggggcucaugauacugcuuacuggaggugccaugcuguuucucaucagcggcaaagggauuggaaagacaucaaucggcuugauuugugugaucgcauccagugguaugcuguggauggcugaaauacccuuacaauggauugccucugccaucguccuagaguucuuuaugaugguucugcucauuccagagccugaaaagcagcgcaccccgcaggacaaucaacuugcauacgugguaaucgggauacugaccuuggcugccaucauugcggcuaacgagaugggccugcucgaaacaacuaaacgagaucugggaaugagcaaggagcccggcguggucuccccaacgucauaucuugacguggaucuccauccugccucugcauggacccuguacgccguugcuacaacugugaucacccccauguugagacacacaauugaaaauagcaccgcaaacgucagucuggccgcgaucgcuaaccaggccguaguguuaauggggcuagacaaaggauggccaauauccaagauggaccugggcguuccucuccuugcacuggguugcuacagccaggugaaucccuugacucugacggccgcuguccuccugcuuauuacacauuaugccaucaucgggccgggauuacaggcaaaagcuaccagggaggcccaaaagcggacugcggccggcauuaugaagaacccaaccguggaugguaucaugacaauagaccuggauccugucauuuacgacucuaaauucgagaagcagcucggccaggugauguugcugguucuaugugcagugcagcugcuccuuaugcgcacuucaugggcucugugcgaagccuugacccuggcaacagggcccaucacgacccucugggagggauccccaggcaaauuuuggaauacuacaauugcuguaaguauggccaacaucuucagagggagcuaucuggccggagcgggcuuagcuuuuucgauaaugaagucuguggguaccgggaaaaggggaacuggcucccaaggugaaacacuuggcgagaaguggaagaaaaagcugaaucagcucagccggaaagauuucgaccuauacaagaaaucagggaucaccgaagucgaucgaacggaggcaaaggagggacugaaaagaggcgaaauuacccaccaugccguuagucgcgggucugcuaaguugcagugguuuguggagaggaacauggucauccccgaaggacgggugauugaccugggcuguggucgugggggaugguccuauuacugcgccggccucaagaaaguaacagaggugagaggcuauacuaaagggggaccuggucacgaagaaccgguucccaugagcaccuacggcuggaauaucgugaaacuuaugucagggaaggaugucuucuaccugccaccugagaaaugugacacauugcugugcgauauuggagaaaguagccccuccccuacuguggaggaaucuaggaccauccgcguccucaagaugguggagccaugguuaaagaacaaucaguucuguauaaaaguucugaaccccuauaugccuacaguaauugagcaccuugaacggcugcaacgaaagcauggcgguaugcuagugagaaauccacucagcaggaacuccacccacgagauguacuggaucucaaaugggacuggaaacaucgucgcaucugugaauaugguuagucgccuguugcugaaccgguuuacgaugacacauagacgucccaccauugaaaaagacguggaucucggcgccggcacuaggcacgucaacgcugagccggaaaccccuaauauggaggugauaggggagcggaucaagcgcauuaaagaagaacacaacucgacauggcauuaugacgacgaaaauccauacaagacgugggcguaucacggaagcuacgagguaaaggccaccgguuccgcaucuucaaugaucaacggcgugguuaaacuucugacuaagcccugggaugucgugccuauggugacacagauggcuaugaccgacacuacaccauucgggcagcaacgagucuuuaaagaaaagguugauaccagaacacccaggagcaugccgggaacucggcgcgugaugggcauuaccgccgagugguuauggagaacgcuggguaggaauaaaaagccucgauugugcacccgggaggaguucacaaagaaaguacguacuaacgcagccaugggggcuguguuuaccgaggaaaaucagugggacuccgccaaggcggcagucgaggaugaagacuucuggaaacucguggauagagagcgcgagcugcauaagcuaggaaaauguggcaguugcguuuauaacaugaugggcaagagggagaagaaacuuggggaguuuggaaaagccaaagguucucgggcuaucugguacauguggcugggcgccagauaccucgaguucgaggcacugggguuuuugaaugaggaccacugguucagccgcgaaaacucauauuccggaguggagggcgaaggucugcauaagcucggguacauacuuagggauaucaguaaaauucccggaggcgcuauguaugccgacgauacagcuggcugggacacucgaaucaccgaggacgaucugcacaaugaagagaagauuacgcagcagauggacccagagcaccggcaauuagccgaugcaaucuuuaaacugacauaccagaacaaggucgugaagguacagagaccuacccccacugggacaguuauggacauaauuagcaggaaagaucagcgcggaucuggucaagugggcaccuauggguugaauacuuucaccaacauggaagcgcagcucauccgucagauggagggagaaggcguccuguccaaggccgaccuagagaauccacaucuucccgagaaaaagaucacacaguggcuggagacgaaagguguggagcggcucaagagaauggcuauuucaggggaugacugcguggucaagccuauagaugacagguuugccaacgcacuguuggcuuuaaacgauaugggaaaaguucgcaaggacaucccacaauggcagccgagcaaaggcuggcacgauuggcaacaggugcccuucuguucgcaucacuuccacgaacugauuaugaaggacggccgaaaacucguagugccuugccggccacaagacgagcuuaucgggagagccaggauuucucagggagcagguuggagucugaaggaaaccgccugucuaggcaaggcguacgcucagauguggucccugauguauuuucaucgcagagaucuccgguuggccagcaaugcaaucugcucagccguccccgugcacuggguuccuacuuccaggacaaccuggucuauacaugcucaccaucaauggaugacuacagaggacaugcugaccguguggaaccgugucuggaucgaagauaauccauggauggaggacaaaacgcccgugacaaccugggagaacguaccuuaccuugggaagcgagaagaucagugguguggaagccugauuggccucacaagucgcgccaccugggcacagaauaucccgacagcuauucagcaaguuagauccuuaaucgguaacgaggaguuccuggacuacaugccaagcaugaaacgguuuaggaaggaggaggaaucugagggggccauuugguga

SEQ ID NO: 15319 - RNA, 9873 nt, Artificial Sequence
  derived and/or modified CDS sequence (opt3) from DENV-3__JF920397__SS-prME
accagccugugccucaugaugauccuucccgccgcucuggcauuccacuugacuuccagagacggcgagccuaggaugauuguggggaagaacgaacggggaaagucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcgucgcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcagcaugaaaaucugaaguauacugucauuaucaccgugcacacaggugaccagcaucagguuggcaacgagacccaaggggugacugcagaaauuacgccucaggcuuccacaaccgaggccauccucccagaauacggaacucuuggccuggagugcucuccgcgaaccgguuuggacuucaaugagaugauccuacugacaaugaaaaacaaggcguggaugguccacagacagugguuuuucgaucucccccugccuuggaccagcggggccacuacagaaacgccaaccuggaauaggaaagaccuucuggugacuuuuaagaacgcacacgcuaaaaagcaagagguaguuguguugggcucccaggaaggagccaugcauacagcucucaccggcgccacagagauucaaaauucagggggaacaaguauauucgcaggucaccugaagugucgguuaaaaauggauaagcuggaacuaaaaggcaugagcuaugccaugugcaccaacacguuuguccucaagaaagaggugucugagacccagcaugggacaauccugauuaaggucgaauacaagggagaggacgugcccuguaaaaucccuuucuccacugaagauggccaagguaaggcucacaacgggcgucuuauaaccgcgaauccaguugugacuaagaaggaggagcccguaaacauugaagcagagccgccuuucggcgaaucaaauaucgucaucggaauuggcgacaacgccuugaaaaucaauugguacaagaaggggagcaguauuggaaaaauguuugaggcuacugcccgcggugcaagaaggauggccauacugggcgauaccgcuugggacuucgggucugugggaggcguucucaacucccuggguaagauggugcaucagaucuuugggagcgccuauacggcacuuuucucgggcgucucuugggugaugaaaauuggaaucggcguacuguugacauggaucgggcucaauuccaagaacaccucaaugaguuuuagcugcauugcgauaggaaucauuacucuguacuuaggcgcugugguucaggccgauauggguugugucaucaauuggaaagggaaggaacugaagugcggauccggcauuuucgugacaaacgaggugcacaccuggacugagcaguauaaauuucaagcagacucucccaagcggcuagccaccgcuaucgccggugcaugggaaaauggcgucugugggauacgaagcacaacgcgcauggagaaccuccuguggaaacagaucgcuaaugaacuuaacuacauuuugugggagaauaacaucaagcugaccguuguggugggagauauuaucggcguacucgaacaggggaaaagaacucugacaccacagccuauggaguuaaaguauucauggaaaaccuggggaaaggccaagauagucacagcggagacucaaaacaguuccuucauuaucgacggccccaauaccccagaaugccccagcgugucuagggccuggaacguuugggagguggaagacuacgguuuuggggucuucacgacaaauauuuggcugaaacuucgggagguguauacccaguugugugaucaccgccucaugucagcugcaguuaaggacgaaagagccgugcaugcugauaugggauacuggaucgagagucagaaaaacggcagcuggaagcuggagaaagccucccuaauagaaguaaagacuugcaccuggccuaagucucacacacuguggucgaaugguguccucgagagcgacaugaucauuccaaaaucccuggcaggcccgaucucacagcauaaccacaggcccggguaccacacucaaaccgcgggaccuuggcaucuuggcaaguuggaacuggauuuuaauuauugcgaggggacaacgguggugauuaccgagaacuguggaacucguggcccaaguuuacggacaaccacugucucugguaaacucauccacgaauggugcugucgaagcugcacacugcccccucuuagauacaugggggaggacggauguugguauggcauggaaauaaggccaauuuccgagaaggaagagaauaugguuaaaucacuggugagcgccgguucuggcaagguagauaacuucaccauggggguguugugccucgcuauccuguuugaggaagucaugcgcggaaaguucggcaaaaagcauaugaucgccgggguguucuuuacguucguucuacugcucuccggacagauuacuuggcgggacauggcacacacccugaucaugauuggcaguaaugcuagcgauagaauggguaugggggugacauaccuugccuugauagcaaccuuuaaaauccagcccuuccuggccuuaggauuuuuccucaggaagcugacuucucgcgagaaccuucugcuaggcgucggccucgcuauggcgacaacccugcaauugccggaagacauugagcagauggccaaugggaucgcacugggauuaauggcucucaaacugauuacacaguuugaaaucuaucagcuuuggacugcccugauauccuugaccuguucaaacacgaucuucacacucaccguggccuggcgaacugcuacccugauucuagccgguguuagucugcuuccuaugugccaaagcucguccaugcggaagacagauuggcucccaauggccguggcggcuaugggcguacccccucugcccuuguuuaucuucucucugaaggacacuuuaaaacguagaagcuggccacucaaugaggggguaauggccgugggacugguuucaauucuugcaaguucccuguugaggaacgaugugccuauggccggcccccucgucgcuggugggcugcuaaucgcauguuacgugauaaccggaacgucugccgaccugacaguagagaaggcggcugacauuaccugggaagaggaagccgagcagacuggcgugagccauaaccuuaugaucacagucgaugacgauggcaccaugcgcaucaaagacgaugaaacugagaauauucucacaguucuguugaagaccgcauuacugauaguguccgggaucuuuccauauucaauuccggccacgcuccugguguggcacacuuggcagaaacagacccaacggagcggaguccuuugggacgugccuagucccccagagacacagaaggcugaacuggaggaagguguuuacagaaucaaacagcagggcauuuucgggaagacccaaguaggagugggcguccagaaggaggguguguuucacacaauguggcauguuacuagaggggcaguguugaccuacaacggaaaacgacuagagcccaauugggcaucugucaagaaagaucugaucuccuauggcggcggguggcgccucagcacgcaguggcaaaagggagaagaggugcagguaauagcugucgaaccugguaaaaacccaaagaauuuccagacaaugcccggcacuuuccagaccacaaccggggagaucggagccauugcgcuggacuuuaagccuggcacuucggguucaccgaucauuaaccgggaagggaaagugguuggacuuuacggcaauggcguggucaccaagaacgggggauaugugucugguaucgcccaaacaaaugcagagccagauggccccacgccugaguuagaagaggaaauguucaaaaagagaaaccugacuauaauggaccuccacccagggaguggaaaaaccaggaaguacuugcccgcuauuguucgugaggccaucaagcgccggcugagaacacucauccuggcuccuaccaggguggucgcagccgaaauggaggaggcccuuaaaggccugccgauucgauaucagacuacagcuaccaaguccgaacauacgggucgggagaucguggauuugaugugccacgcgacuuuuacaaugcgccuacugagccccguaagagugccaaauuacaaccucauaauuauggacgaagcacauuucaccgauccugccucuaucgcugccaggggguauauuagcacccggguuggaaugggcgaggcagccgcuaucuuuaugacugcgacacccccaggcaccgccgacgcauucccucaguccaaugcucccauacaggacgaagaacgagauauuccagagagaucauggaacagugggaaugaauggaucacagacuuugccggaaaaacugucugguucgugccgagcaucaaggcagguaacgauauugccaacuguuuacgcaaaaauggcaagaaggugauccaacugucuaggaaaacguuugacaccgaguaccagaagacaaaacuuaacgauugggacuucgucguaacuaccgauauuuccgaaaugggggcuaauuuuaaggccgaccgugugauagauccucggagaugccugaaacccguuauccucacagacggaccagagagggugauuuuggcgggccccaugccugucaccgcagccucagcugcccagcgccgagguagaguggggcggaacccacagaaggagaaugaucaauacaucuucacuggccagccccugaacaaugacgaagaccacgcucacuggacggaggcaaagaugcuccuggauaacaucaauaccccugaaggaauuauaccggcccuuuucgagccagaaagggagaaaagugcugccaucgacggcgaguaucgccuaaagggggaaagccguaaaacauuuguugagcugaugagacggggagauuugcccgugugguuagcacauaaggucgcguccgaagguauuaaauacacugacaggaaguggugcuucgauggccagcgcaacaaucagauccuggaggaaaacauggacguggagauuuggaccaaagagggggaaaagaagaaacuccgaccuagauggcuggaugcccggacauauucugacccccuugcucugaaggaguuuaaagaguucgccgcaggaaggaagucgaucgcucucgauuugguaaccgagauaggccgcgugccaagccaccuggcccauagaacuaggaaugcacuagacaaccugguuaugcuccacacaucagaacacggugggcgggccuaccgucaugcugucgaggagcuuccugaaacgauggagacccuguuauugcugggccucaugauccugcuuacuggaggcgcgaugcuguuucucauuuccgggaaaggaaucgguaagacaaguauuggcuugaucugugugauagccucuagcgggaugcuguggauggcagaaauucccuuacaauggaucgcuuccgccauugugcuagaguucuuuaugaugguccugcucaucccagagccugaaaagcagcgcaccccgcaggauaaucaacuugccuauguugugauaggaauccugaccuuggcagcuauuaucgccgcgaacgagaugggccugcucgaaacaacuaaacgagaccuggguaugucaaaggagcccgggguagugucuccaacgagcuaccuugaugucgaccuccacccugcuagugccuggacccuguaugcaguggccacaacuguuauuacccccauguugagacauacaaucgaaaauuccaccgcuaacgugagccuggcagccauagcgaaccaggcugucguauuaaugggccuagacaaaggauggccaauuucuaagauggaucugggcgugccucuccuugcccuggggugcuacucacagguuaaucccuugacucugacggcagccgugcuccugcuuaucacacacuacgcuaucauuggaccgggcuuacaggccaaagcaaccagggaggcucaaaagcggacugccgcggguaucaugaagaacccaaccgucgacgggauaaugacaauugaucuggacccugugaucuaugauuccaaauucgagaagcagcucggacaggucauguugcuggugcuauguguugugcagcugcuccuuaugcgcacaaguugggcccugugcgaagcauugacccuggcuacaggccccauuacgacccucugggaggguagcccaggcaaauuuuggaauacuacaaucgccguaucgauggcaaacauauucagagggucuuaccuggcuggagccggcuuagccuuuuccaucaugaaaagcguggggaccggaaaaaggggcacugguucacaaggggaaacacuuggagagaaguggaagaaaaagcugaaucagcucagucggaaagacuucgaucuauauaagaaaucuggcauuaccgaagucgaccgaacggaggcgaaggagggucugaaaagaggcgaaaucacccaucacgcuguuucccgcgggagcgcaaaguugcagugguuuguggagaggaacauggucauucccgaaggacgggugaucgaucugggcugugggcguggaggcuggucauacuauugcgccggucucaagaaaguaacagaggugagaggguacacuaagggaggcccuggccacgaggaaccgguucccaugaguaccuauggguggaauauugugaaacuuaugagcggaaaggacgucuucuaccugccaccugagaaaugugauacauugcugugcgacaucggugaauccucucccagcccuacuguggaggaauccaggaccauacgcguccucaagaugguggagccaugguuaaagaacaaucaguucuguauuaaaguucugaaccccuacaugccuacaguaaucgagcaucuugaacggcugcaacgaaagcacggcgggaugcuagugagaaauccacucucaaggaacucuacccaugagauguauuggaucaguaauggaacuggcaacauugucgcuucggugaauaugguuagccgccuguugcugaaccgguuuacgaugacacacagacgucccaccauagaaaaagauguggaccucggugccgggacuaggcacgucaacgcagagccggaaaccccuaauauggacgugaucggagagcggauuaagcgcaucaaagaggaacauaacuccacauggcacuacgaugacgagaauccauauaagacgugggccuaccauggcucuuaugaaguaaaggcuaccggcucagcgagcuccaugauuaacggggugguuaaacuucugacuaagcccugggaugucgugccuauggugacacagauggccaugaccgacacuacaccauucggacagcaacgagucuuuaaagagaagguugauaccagaacacccaggaguaugccggguacucggcgcgugaugggcaucaccgcagaaugguuauggagaacgcuggggaggaauaaaaagccucgauugugcacccgggaggaguucacaaagaaaguacguacuaacgcugccaugggagcaguguuuaccgaagagaaucagugggacucugccaaggcugccgucgaagaugaggacuucuggaaacucguggauagagaacgcgagcugcacaagcuaggcaaaugugguagcugcguuuacaacaugauggggaagagggagaagaaacuuggagaauuuggcaaagcgaaaggcucacgggcaauaugguauauguggcugggggccagauaccucgaguucgaagcucugggauuuuugaaugaggaccauugguucucccgcgagaacaguuacagcgguguggaaggcgaggggcugcacaagcucggauauauccuuagggauauuucuaaaauccccggcggugccauguacgcagacgacacagcugggugggauacucgaauuaccgaagacgaucugcacaaugaggaaaagaucacgcagcagauggacccagagcaucggcaauuagccaacgcuauauuuaaacugacauaucagaauaaggucgugaagguacagagaccuacccccacuggaacaguuauggauauuaucuccaggaaagaccagcgcggcucaggccaaguggggaccuacggauugaacacuuucaccaauauggaggcccagcucauccgucagauggaaggugagggcguccugagcaaggcagaucuagaaaacccacaccuucccgagaaaaagauuacacaguggcuggaaacgaaagggguggagcggcucaagagaauggcgauaucgggagacgauugcguggucaagccuaucgacgauagguuugccaacgcucuguuggccuuaaaugacaugggcaaaguucgcaaggauauuccacaauggcagccgucuaaagguuggcaugacuggcaacaggugcccuucuguagucaccacuuccaugagcugaucaugaaggacgggcgaaaacucguagugccuugccggccacaagaugaacuuauuggaagggcaaggaucucccagggcgcuggcuggagccugaaggagaccgccugucuagggaaggcauaugcccagauguggucacugauguacuuucaccgcagagaccuccgguuggcguccaacgcuauaugcucugccguccccgugcauuggguuccuacuagcaggacaaccuggaguauccacgcacaucaccaauggaugacuacagaagauaugcugaccguguggaaucgugucuggauugaggacaacccauggauggaagauaaaacgcccgugacaaccugggagaauguaccuuaucuuggaaagcgagaggaccaguggugugguucccugaucggccucacuagccgcgccaccugggcucagaacauuccgacagccauccagcaaguuagaucuuuaauugggaaugaagaguuccuggauuacaugccaucaaugaaacgguuuaggaaggaagaggagagugaaggagcaauaugguga

SEQ ID NO: 15320 - RNA, 9873 nt, Artificial Sequence
  derived and/or modified CDS sequence (opt3) from DENV-3__JN093513__SS-prME
accagccugugccucaugaugauccuucccgccgcucuggcauuccacuugacauccagagacggcgaaccuagaaugauuguggggaagaacgaacgggguaaaucuuuacuguuuaagacugccucagguauaaauauguguacgcuaaucgcgauggaucucggcgaaaugugcgacgauaccgucacauacaaauguccacauauuacugaaguugaaccggaagacaucgauugcugguguaaccugaccaguacaugggugaccuaugggacuugcaaucaggcuggagaacaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcagcaugaaaaucugaaguauacugucauuaucaccgugcacacaggugaccagcaucagguuggcaacgagacccaaggggugacugcagaaauuacgccucaggcuuccacaaccgaggccauccucccagaauacggaacucuuggccuggagugcucuccgcgaaccgguuuggacuucaaugagaugauccuacugacaaugaaaaacaaggcguggaugguccacagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcauacagcucucaccggcgccacagaaauucaaaauucagggggaacaagcauauucgcaggucaccugaagugucgguuaaaaauggacaagcuggagcuaaaaggcaugagcuaugccaugugcaccaacacguuuguccucaagaaagaggugucugaaacccagcaugggacaauccugauuaaggucgaguacaagggagaagaugugcccuguaaaaucccuuucuccacugaggacggccaagguaaggcucacaacgggcgucuuauaaccgcgaauccaguugugacuaagaaggaggaacccguaaacauugaggcagaaccgccuuucggcgagucaaauaucgucaucggaauuggcgauaacgccuugaaaaucaauugguacaagaaggggagcaguauuggaaaaauguuugaagcuacugcccgcggugcaagaaggauggccauacugggcgacaccgcuugggauuucgggucugugggaggcguucucaacucccuggguaagauggugcaucagaucuuugggagcgccuauacggcacuuuucucgggcgucucuugggugaugaaaauuggaaucggcguacuguugacauggaucgggcucaauuccaagaacaccucaaugaguuuuagcugcauugcgauaggaaucauuacucuguacuuaggcgcugugguucaggccgacauggguugugucaucaauuggaaagggaaggagcugaagugcggauccggcauuuucgugacaaacgaggugcacaccuggacugaacaguauaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuacauuuugugggaaaauaacaucaagcugaccguuguggugggagacauuaucggcguacucgagcaggggaaaagaacucugacaccacagccuauggaguuaaaguauucauggaaaaccuggggaaaggccaagauagucacagcggaaacucaaaacaguuccuucauuaucgauggccccaauaccccagagugccccagcgugucuagggccuggaacguuugggaaguggaggacuacgguuuuggggucuucacgacaaauauuuggcugaaacuucgggaaguguauacccaguugugugaccaccgccucaugucagcugcaguuaaggaugagagagccgugcaugcugacaugggauacuggaucgagagucagaaaaacggcagcuggaagcuggaaaaagccucccuaauagagguaaagacuugcaccuggccuaagucucacacacuguggucgaaugguguccucgaaagcgauaugaucauuccaaaaucccuggcaggcccgaucucacagcauaaccacaggcccggguaccacacucaaaccgcgggaccuuggcaucuuggcaaguuggagcuggacuuuaauuauugcgaggggacaacgguggugauuaccgaaaacuguggaacucguggcccaaguuuacggacaaccacugucucugguaaacucauccacgaguggugcugucgaagcugcacacugcccccucuuagauacaugggggaagauggauguugguauggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcauaugaucgccgggguguucuuuacguucguucuacugcucuccggacagauuacuuggcgggauauggcacacacccugaucaugauuggcaguaauacaagcgacagaauggguaugggggugaccuaccuugcuuugauagccacuuuuaaaauccagcccuuccuggcauuaggauuuuuccucaggaagcugacaucucgcgaaaaccuucugcuaggcgucggccucgccauggcuaccacacugcaauugccggaggauauugaacagauggcgaaugggaucgcccugggauuaauggcacucaaacugauuacucaguuugagaucuaucagcuuuggaccgcucugauauccuugacguguucaaacacaaucuucacccucacuguggccuggcgaaccgccacacugauucuagcugguguuagucugcuuccugugugccaaagcucguccaugcggaagacugacuggcucccaauggcagucgccgcgaugggcguacccccucugcccuuguuuaucuucgggcugaaggauaccuuaaaacguagaucuuggccacucaaugagggagugauggcuguuggccuggugagcauucuugccucaagucuguugaggaacgacgucccuauggcagguccccucguggccgggggacugcuaaucgcuuguuacguaauaacgggcacauccgcagaucugaccguggaaaaggccgcggacauuacuugggaggaagaggcugaacagacaggcgucucucauaaccuuaugaucaccguugacgaugacgggacuaugcgcaucaaagaugacgagacagagaauauucucaccgugcuguugaagacggccuuacugauagugagcggaaucuuuccauauuccauuccggcaacucuccuggucuggcacaccuggcagaaacagacacaacggucaggugugcuuugggauguuccuagucccccagaaacccagaaggccgagcuggaagagggcguauacagaaucaaacagcaggggauuuucggaaagacacaagugggcgucggugugcagaaggaggggguuuuucacacuauguggcaugugaccaggggagcugucuugacguacaacggcaaacgacuagaacccaauugggccagugugaagaaagaccugaucucuuauggcgggggauggcgccucuccgcacaguggcaaaagggugaggaaguacaggucauagcuguggagccuggcaaaaacccaaagaauuuccagacaaugcccgggacuuuccagaccacaaccggagaaaucggcgccauugcgcuggauuuuaagccugguacuagcgggucgccgaucauuaaccgggagggaaaaguugugggccuuuacggcaauggggucgugaccaagaacggagguuauguuucaggcaucgcccaaacaaaugcagagccagacgggcccacgccugaauuagaggaagagauguucaaaaagagaaaccugacuauaauggaucuccacccaggaucuggcaaaaccaggaaguacuugcccgcuauugugcgugaagccaucaagcgccggcugagaacacucauccuggcuccuaccagggucguggcagccgagauggaggaagcccuuaaaggucugccgauucgauaucagacuacagcuaccaagagugagcauacggggcgggaaaucguagacuugaugugccacgcgacuuuuacaaugcgccuacugucccccgugagaguuccaaauuacaaccucauaauuauggaugaggcacauuucaccgacccugccagcaucgcugccaggggauauauuucuacccgggucggcaugggcgaagcagccgcuaucuuuaugacugcgacacccccagggaccgccgaugcauucccucagagcaaugcucccauacaggacgaggagcgagacauuccagaaagauccuggaacucaggaaaugaguggaucacagauuuugccgguaaaacugugugguucgugccgaguaucaaggcaggcaacgacauugccaacuguuuacgcaaaaaugggaagaaggucauccaacugagcaggaaaacguuugauaccgaauaccagaagacaaaacuuaacgacugggauuucguagugacuaccgacauuucugagaugggagcuaauuuuaaggccgaucguguuauagacccucggagaugccugaaacccgugauccucacagauggcccagagagggucauuuuggcgggucccaugccugugaccgcagccuccgcugcccagcgccgagggagaguuggccggaacccacagaaggaaaaugaccaauacaucuucacuggacagccccugaacaaugaugaggaccacgcucacuggacggaagcaaagaugcuccuggacaacaucaauaccccugagggcauuauaccggcccuuuucgaaccagagagggagaaaucagcugccaucgauggggaauaucgccuaaagggagagagucguaaaacauuuguggaacugaugagacggggugacuugcccgucugguuagcacauaagguggcgagcgagggcauuaaauacacugauaggaaguggugcuucgacgggcagcgcaacaaucagauccuggaagagaacauggauguagagauuuggaccaaagaaggagagaagaagaaacuccgaccuagauggcuggacgcccggacauauuccgauccccuugcucugaaggaauuuaaagaguucgccgcaggcaggaagucuaucgcucucgacuuggugaccgaaauaggucgcguuccaucgcaccuggcccauagaacuaggaaugcacuagauaaccuggucaugcuccacacaagcgagcacgggggccgggccuaccgucaugcuguggaggaacuuccugagacgauggaaacccuguuauugcugggacucaugauccugcuuacuggcggggcgaugcuguuucucauuucaggaaaagguaucggcaagacauccauuggguugaucugugugauagccaguucuggaaugcuguggauggcagagauucccuuacaauggaucgcuagcgccauuguccuagaguucuuuaugaugguucugcucaucccagaaccugagaagcagcgcaccccgcaggacaaucaacuugccuaugugguaauaggcauccugaccuuggcagcuauuaucgccgcgaacgaaaugggucugcucgagacaacuaaacgagaucuggggauguccaaggaacccggcguggucucaccaacgucuuaccuugacguggaucuccacccugcuagcgccuggacccuguaugcaguugccacaacugugauuacccccauguugagacauacaaucgagaauaguaccgcuaacgucucccuggcagccauagcgaaccaggcuguaguguuaaugggacuagacaaaggcuggccaauuagcaagauggaccuggggguuccucuccuugcccugggaugcuacucucaggugaaucccuugacucugacggcagccguccuccugcuuaucacacacuacgcuaucauuggcccggguuuacaggccaaagcaaccagggaggcucaaaagcggacugccgcggggaucaugaagaacccaaccguggauggaauaaugacaauugaccuggauccugucaucuaugacucaaaauucgaaaagcagcucggccaggugauguugcugguucuaugugccgugcagcugcuccuuaugcgcacuuccugggcacugugcgaggcuuugacccuggccacaggucccauuacgacccucugggaaggcaguccagggaaauuuuggaauacuacaaucgcaguaagcauggcuaacauauucagaggaucguaccuggccggcgccggguuagcguuuucuaucaugaaguccgugggaaccggcaaaagggguacugggagccaaggagagacacuuggcgaaaaguggaagaaaaagcugaaucagcucucacggaaagauuucgaccuauauaagaaaagugguauuaccgaggucgaucgaacggaggcuaaggaaggccugaaaagaggggagaucacccaucacgcaguuucucgcggauccgccaaguugcagugguuuguggaaaggaacauggucauucccgagggccgggugaucgaccugggguguggacguggcgguuggagcuacuauugcgcugggcucaagaaaguaacagaagugagaggauacacuaagggcggcccugggcacgaggagccgguucccaugucaaccuauggauggaauauugugaaacuuaugagugguaaggaugucuucuaccugccaccugaaaaaugugacacauugcugugcgauaucggcgagagcucccccucuccuacuguggaagagagcaggaccauacgcguccucaagaugguggagccaugguuaaagaacaaucaguucuguauuaaaguucugaaccccuacaugccuacaguaaucgaacaucuugagcggcugcaacgaaagcacgggggaaugcuagugagaaauccacucuccaggaacucaacccaugaaauguauuggaucucuaauggcacugguaacauugucgccagugugaauaugguuucgcgccuguugcugaaccgguuuacgaugacacacagacgucccaccauagagaaagacguggaucucggggcaggaacuaggcacgucaacgccgaaccggagaccccuaauauggacgugaucggcgagcggauuaagcgcaucaaagaagaacauaacagcacauggcacuacgacgaugaaaauccauauaagacgugggcuuaccauggcuccuaugagguaaaggcgaccgggucugccucaagcaugauuaacggagugguuaaacuucugacuaagcccugggacgucgugccuauggugacacagauggcaaugaccgauacuacaccauucggucagcaacgagucuuuaaagaaaagguugacaccagaacacccagguccaugccgggcacucggcgcgugauggggaucaccgcugagugguuauggagaacgcugggaaggaauaaaaagccucgauugugcacccgggaggaguucacaaagaaaguacguacuaacgccgcaaugggcgccguguuuaccgaggaaaaucagugggauagugcuaaggccgcggucgaggacgaagauuucuggaaacucguggacagagagcgcgagcugcacaagcuagguaaaugugggucuugcguuuacaacaugaugggaaagagggagaagaaacuuggcgaguuuggcaaagcaaaagggagccgggccauaugguauauguggcugggagcuagauaccucgaguucgaggcccugggauuuuugaaugaggaucauugguucucacgcgaaaacuccuacaguggcguggagggggaaggacugcacaagcucggcuauauccuuagggacauuagcaaaauccccgguggggcaauguacgcugaugacacagccggaugggacacucgaauuaccgaggaugaccugcacaaugaagagaagaucacgcagcagauggauccagagcaucggcaauuagcuaacgccauauuuaaacugacauaucagaauaaggucgugaagguacagagaccuacccccacuggcacaguuauggacauuaucucuaggaaagaucagcgcggcuccgggcaagugggaaccuacgguuugaacacuuucaccaauauggaagcacagcucauccgucagauggagggcgaagggguccugucaaaggcggaccuagagaacccacaccuucccgagaaaaagauuacacaguggcuggagacgaaaggaguggagcggcucaagagaauggccauaagcggcgaugacugcguggucaagccuaucgaugacagguuugcuaacgcccuguuggcauuaaaugauauggguaaaguucgcaaggacauuccacaauggcagccgucgaaaggguggcaugauuggcaacaggugcccuucuguucucaccacuuccaugaacugaucaugaaggacggacgaaaacucguagugccuugccggccacaagacgagcuuauuggcagagcuaggaucagucagggcgccggguggucccugaaggaaaccgcaugucuaggaaaggccuaugcgcagauguggagccugauguacuuucaccgcagagaucuccgguuggcuucaaacgccauaugcuccgcaguccccgugcauuggguuccuacuucuaggacaaccuggagcauccacgcccaucaccaauggaugacuacagaggacaugcugaccguguggaaucgugucuggauugaagauaacccauggauggaggacaaaacgcccgugacaaccugggagaauguaccuuaucuugguaagcgagaagaucagugguguggcagucugaucgggcucacuucccgcgcuaccugggcccagaacauuccgacagcaauccagcaaguuaggagcuuaauuggaaaugaggaguuccuggacuacaugccaucuaugaaacgguuuaggaaggaggaggaaucagagggcgcuauaugguga

SEQ ID NO: 15321 - RNA, 9873 nt, Artificial Sequence
  derived and/or modified CDS sequence (opt3) from DENV-3__JF937624__SS-prME
accagccugugccucaugaugauccuucccgcagcucuggcauuccacuugacauccagagacggcgaaccuagaaugauuguggggaagaacgaacgggguaaaucuuuacuguuuaagacugccucagguauaaauauguguacgcuaaucgcgauggaucucggcgaaaugugcgacgauaccgucacauacaaauguccacauauuacugaaguugaaccggaagacaucgauugcugguguaaccugaccaguacaugggugaccuaugggacuugcaaucaggcuggagaacaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucaaaauucagggggaacaagcauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacuaagaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauaugggggaagauggauguugguacggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcacaugaucgccgggguguucuuuacguucguucuacugcucuccggacagauuacuuggcgggauauggcacauacccugaucaugauuggcaguaaugcuagcgacagaauggguaugggggugacauaucuugccuugauagcaaccuuuaaaauccagcccuuccuggccuuaggauuuuuccucaggaagcugacuucucgcgaaaaccuucugcuaggcgucggccucgcuauggcgacaacccugcaauugccggaggauauugaacagauggccaaugggaucgcacugggauuaauggcucucaaacugauuacacaguuugagacuuaccagcuuuggaccgcccugaucuccuugacguguucaaacacaauauucacccucacuguggccuggcgaaccgcuacacugauccuagccgguguuagucugcuuccugugugccaaagcucguccaugcggaagacugacuggcucccaauggccgucgcggcuaugggcguacccccucugcccuuguuuauuuucgggcugaaggauaccuuaaaacguagaucuuggccacucaaugagggagugauggccguuggccuggugagcauccuugcaucaagucuguugaggaacgacgucccuauggccgguccccucguggcugggggacugcuaauugcauguuauguaaucacgggcacauccgccgaucugaccguggaaaaggcggcugacauaacuugggaggaagaggccgaacagacaggcgucucucacaaccuuaugauuaccguugacgaugacgggacuaugcgcaucaaagaugacgagacagagaauauccucaccgugcuguugaagacggcauuacugauugugagcggaauauuuccauacuccaucccggccacucuccuggucuggcauaccuggcagaaacagacacaacggucaggugugcuuugggauguuccuagucccccagaaacccagaaggcugagcuggaagagggcguauacagaauuaaacagcaggggaucuucggaaagacacaagugggcgucggugugcagaaggaggggguuuuucacacuauguggcacgugaccaggggagccgucuugacguauaacggcaaacgacuagaacccaauugggcaagugugaagaaagaccugauuucuuacggcgggggauggcgccucuccgcucaguggcaaaagggugaggaaguacaggucaucgccguggagccuggcaaaaacccaaagaauuuccagacaaugcccgggacuuuccagaccauaacaggagaaaucggcgcgauugcccuggauuuuaagccugguaccagcgggucgccgaucauuaaccgggagggaaaaguugugggccuuuauggcaauggggucgugacuaagaacggagguuacguuucaggcaucgcacaaaccaaugcugagccagacgggcccacaccugaauuagaggaagagauguucaaaaagagaaaccugacgauaauggaucuccauccaggaucuggcaaaacuaggaaguauuugcccgccauugugcgugaagcuaucaagcgccggcugagaacccucauccuggcaccuacaagggucguggccgccgagauggaggaagcucuuaaaggucugccgauucgauaccagaccacugcgacaaagagugagcacaccgggcgggaaaucguagacuugaugugccaugcaacguuuacuaugcgccuacugucccccgugagaguuccaaauuauaaccucauaauuauggaugaggcccacuucacagacccugcuagcaucgccgcaaggggauacauuucuacccgggucggcaugggcgaagccgcugcgaucuuuaugaccgccacucccccagggacagcagaugcuuucccucagagcaaugcccccauacaggacgaggagcgagacauuccagaaagauccuggaacucaggaaaugaguggaucaccgauuuugcagguaaaacagugugguucgugccgaguaucaaggccggcaacgacauugcuaacuguuuacgcaaaaaugggaagaaggucauccaacugagcaggaaaacuuuugauacggaauaccagaagaccaaacuuaacgacugggauuucguagugacaacugacauuucugagaugggagccaauuuuaaggcggaucguguuauagacccucggagaugccugaaacccgugauccucaccgauggcccagagagggucauuuuggcaggucccaugccugugacagccgcuuccgccgcucagcgccgagggagaguuggccggaacccacagaaggaaaaugaccaauauaucuucaccggacagccccugaacaaugaugaggaccaugcacacuggacugaagccaagaugcuccuggacaacaucaauacgccugagggcauuauaccggcucuuuucgaaccagagagggagaaaucagccgcaaucgauggggaauaccgccuaaagggagagagucguaaaaccuuuguggaacugaugagacggggugacuugcccgucugguuagcgcacaagguggccagcgagggcauuaaauauacagauaggaaguggugcuucgacgggcagcgcaacaaucagauccuggaagagaacauggauguagagauuuggacuaaagaaggagagaagaagaaacuccgaccuagauggcuggacgcucggaccuacuccgauccccuugcccugaaggaauuuaaagaguucgcagcuggcaggaagucuaucgcccucgacuuggugacagaaauaggucgcguuccaucgcaucuggcacacagaaccaggaaugcccuagauaaccuggucaugcuccauacuagcgagcacgggggccgggcuuaucgucacgcgguggaggaacuuccugagacaauggaaacgcuguuauugcugggacucaugauccugcuuaccggcggggccaugcuguuucucauuucaggaaaagguaucggcaagacuuccauuggguugaucugugugauagcaaguucuggaaugcuguggauggcugagauucccuuacaauggaucgccagcgccauuguccuagaguucuuuaugaugguucugcucaucccagaaccugagaagcagcgcacaccgcaggacaaucaacuugcauacgugguaauaggcauccugaccuuggcugccauuaucgcggcuaacgaaaugggucugcucgagaccacaaaacgagaucuggggauguccaaggaacccggcguggucucaccaacuucuuaucuugacguggaucuccauccugccagcgcauggacgcuguacgccguugcuaccacagugauuacucccauguugagacacaccaucgagaauaguacagcaaacgucucccuggccgcgauagcuaaccaggccguaguguuaaugggacuagacaaaggcuggccaauuagcaagauggaccuggggguuccucuccuugcacugggaugcuacucucaggugaaucccuugacccugacugccgcuguccuccugcuuaucacgcauuaugccaucauuggcccggguuuacaggcaaaagcuacaagggaggcccaaaagcggaccgcggccgggaucaugaagaacccaacuguggauggaauaaugaccauugaccuggauccugucaucuacgacucaaaauucgaaaagcagcucggccaggugauguugcugguucuaugugcagugcagcugcuccuuaugcgcacauccugggcucugugcgaggccuugacucuggcaaccggucccauuacaacgcucugggaaggcaguccagggaaauuuuggaauaccacuaucgcuguaagcauggccaacauauucagaggaucguaucuggccggcgcgggguuagcuuuuucuaucaugaaguccgugggaacaggcaaaagggguaccgggagccaaggagagacucuuggcgaaaaguggaagaaaaagcugaaucagcucucacggaaagauuucgaccuauacaagaaaagugguauuacagaggucgaucgaaccgaggcaaaggaaggccugaaaagaggggagaucacgcaccaugccguuucucgcggauccgcuaaguugcagugguuuguggaaaggaacauggucauucccgagggccgggugaucgaccugggguguggacguggcgguuggagcuauuacugcgccgggcucaagaaaguaaccgaagugagaggauauacaaagggcggcccugggcacgaggagccgguucccaugucaacuuacggauggaauauugugaaacuuaugagugguaaggaugucuucuaccugccaccugaaaaaugugacaccuugcugugcgauaucggcgagagcucccccucuccuacaguggaagagagcaggacuauacgcguccucaagaugguggagccaugguuaaagaacaaucaguucuguauuaaaguucugaaccccuauaugccuaccguaaucgaacaccuugagcggcugcaacgaaagcaugggggaaugcuagugagaaauccacucuccaggaacucaacacacgaaauguacuggaucucuaauggcaccgguaacauugucgcaagugugaauaugguuucgcgccuguugcugaaccgguuuacuaugacgcauagacgucccacaauagagaaagacguggaucucggggccggaaccaggcacgucaacgcugaaccggagacuccuaauauggacgugaucggcgagcggauuaagcgcaucaaagaagaacacaacagcaccuggcauuaugacgaugaaaauccauacaagacaugggcguaucacggcuccuacgagguaaaggccacggggucugcaucaagcaugauuaacggagugguuaaacuucugaccaagcccugggacgucgugccuauggugacucagauggcuaugacagauaccacuccauucggucagcaacgagucuuuaaagaaaagguugacacaagaacccccagguccaugccgggcacacggcgcaucauggggauaacugccgagugguuauggagaacccugggaaggaauaaaaagccucgauugugcacgcgggaggaguucaccaagaaagugcguacaaacgcagccaugggcgcuguauuuacugaggaaaaucagugggauagugccaaggcggcaguggaggacgaagauuucuggaaacucgucgacagagagcgcgagcugcauaagcuagguaaaugugggucuugcguguauaacaugaugggaaagagggagaagaaacuuggcgaguuuggcaaagccaaagggagccgggcuaucugguacauguggcugggagccagauaccucgaguucgaggcacugggauuuuugaaugaggaucacugguucucacgcgaaaacuccuauaguggcguugagggggaaggacugcauaagcucggcuacauucuuagggacaucagcaaaauucccgguggggcuauguaugccgaugacaccgcuggaugggacacacgaaucacugaggaugaccugcacaaugaagagaagauaacccagcagauggauccagagcaccggcaauuagccaacgcaauuuuuaaacugacguaccagaauaagguggucaaggugcagagaccuacacccaccggcacuguaauggacaucaucucuaggaaagaucagcgcggcuccgggcaaguuggaacauaugguuugaacaccuucacuaauauggaagcgcagcucauucgucagauggagggcgaaggggugcugucaaaggccgaccuagagaacccacaucuucccgagaaaaagauaacccaguggcuggagacaaaaggagucgagcggcucaagagaauggcuaucagcggcgaugacugcguggugaagccuauugaugacagguuugccaacgcacuguuggcuuuaaaugauauggguaaaguccgcaaggacaucccacaauggcagccgucgaaaggguggcacgauuggcagcagguucccuucuguucucaucacuuccacgaacugauuaugaaggacggacgaaaacucgugguaccuugccggccacaagacgagcuuaucggcagagccaggauaagucagggcgcaggguggucccugaaggaaacggccugucuaggaaaggcguacgcucagauguggagccugauguauuuucaucgcagagaucuccgguuggccucaaacgcaaucugcuccgccgugcccguccacugggugccuaccucuaggacuacauggagcauucaugcucaccaucaauggaugaccacugaggacaugcugacaguuuggaaucguguguggaucgaagauaacccauggauggaggacaaaacccccgucacgacaugggagaaugugccuuaccuugguaagcgagaagaucagugguguggcagucugauugggcucaccucccgcgccacuugggcacagaacaucccgaccgcuauucagcaaguaaggagcuuaauaggaaaugaggaguuccuggacuacaugccaucuaugaaacgguuuaggaaggaggaggaaucagagggcgccaucugguga

SEQ ID NO: 15322 - RNA, 9873 nt, Artificial Sequence
  derived and/or modified CDS sequence (opt3) from DENV-3__JN000938__SS-prME
accagccugugccucaugaugauccuucccgccgcucuggcauuccacuugacuuccagagacggcgaaccuaggaugauuguggggaagaacgaacggggaaaaucuuuacuguuuaagacugccucagguauaaauauguguacgcuaaucgcgauggaucucggcgaaaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucaaaauucagggggaacaaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacuaagaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauaugggggaagauggauguugguacggcauggagauaaggccauucuccgaaaaggaggagaauaugguuaaaucacuggugagcgccgguggcgggaagguagacaacuuuaccaugggaguguugugccucgcuauucuguucgaagaggucaugcgcggcaaguucgggaaaaagcacaugaucgccggaguguuuuucacguuuguucuacugcucucuggccagaucacuuggcgggauauggcacauacccugauuaugaucgguuccaaugcuagugacagaauggggaugggagugacauaucuugccuugauugcaaccuucaaaauacagcccuuucuggccuuaggcuucuuucucaggaagcugacuagccgcgaaaaccuucugcuaggcgucgggcucgcuauggcgacaacccugcaauugccggaggauaucgaacagauggccaauggaauugcacuggguuuaauggcucucaaacugaucacacaguucgagacuuaccagcuuuggaccgcccugauuucuuugacguguuccaacacaaucuuuacccucacuguggccuggcgaaccgcuacacugauacuagcaggcguuucacugcuuccugugugccaaaguagcucgaugcggaagacugacuggcucccaauggccgucgcggcuauggggguacccccucugcccuuguucaucuuuggacugaaggauaccuuaaaacguagauccuggccacucaaugagggcgugauggccguuggucuggugucuauucuugcaagcucacuguugaggaacgacgucccuauggccgggccccucguggcuggaggccugcuaaucgcauguuauguaauuacgggcacaagugccgaucugaccguggaaaaggcggcugacaucacuugggaggaagaggccgaacagacaggggucucccacaaccuuaugauaaccguugacgaugacggaacuaugcgcauuaaagaugacgagacagagaauauccucaccgugcuguugaagacggcauuacugaucgugucugguauuuucccauacagcauaccggccacucuccuggucuggcauaccuggcagaaacagacacaacgguccggcgugcuuugggauguuccuucacccccagaaacccagaaggcugagcuggaagaggggguauacagaaucaaacagcagggaauuuuuggcaagacacaagugggugucggggugcagaaggagggaguuuuccacacuauguggcacgugaccaggggcgccgucuugacguauaacggcaaacgacuagaacccaauugggcaagcgugaagaaagaccugaucaguuacgggggagguuggcgccucucugcucaguggcaaaagggcgaggaaguacaggucauugccguggagccugggaaaaacccaaagaauuuccagacaaugcccggaacuuuucagaccacaaccggcgaaaucggugcgauagcccuggauuucaagccugggacuuccggaagcccgaucauuaaccgggagggcaaaguugugggccuuuaugggaauggagucgugaccaagaacgguggcuacguuucggggaucgcacaaacaaaugcugagccagacggacccacgccugaauuagaggaagagauguuuaaaaagagaaaccugacuauuauggaucuccauccaggcucagguaaaaccaggaaguauuugcccgccaucgugcgugaagcuauaaagcgccggcugagaacacucauucuggcaccuaccagggucguggccgccgagauggaggaagcucuuaaagggcugccgauccgauaccagacuacagcgaccaagucugagcacacgggacgggaaaucguagacuugaugugccaugcaacuuucacaaugcgccuacugagucccgugagaguuccaaauuauaaccucauuaucauggaugaggcccacuuuaccgacccugcuuccauagccgcaaggggcuacauuagcacccgggucggcaugggggaagccgcugcgaucuucaugacugccacacccccaggaaccgcagaugcuuuuccucagucuaaugcccccauucaggacgaggagcgagacaucccagaaagaagcuggaacuccgguaaugaguggauaacagauuucgcaggcaaaacugugugguuugugccgucaauuaaggccgggaacgacaucgcuaacuguuuacgcaaaaauggaaagaaggucauccaacugaguaggaaaacguucgauaccgaauaccagaagacaaaacuuaacgacugggauuuuguagugacuaccgacauuagcgagaugggcgccaauuucaaggcggaucguguuaucgacccucggagaugccugaaacccgugauucucacagaugguccagagagggucauauuggcagggcccaugccugugaccgccgcuucugccgcucagcgccgaggcagaguuggacggaacccacagaaggaaaaugaccaauauaucuucacuggccagccccugaacaaugaugaggaccaugcacacuggacggaagccaagaugcuccuggacaacauuaauaccccugaggggaucaucccggcucuuuuugaaccagagagggagaaauccgccgcaauugauggagaauaccgccuaaagggugagucacguaaaacauucguggaacugaugagacggggcgacuugcccgucugguuagcgcacaagguggccagugaggggauaaaauauacugauaggaaguggugcuuugacggacagcgcaacaaucagauccuggaagagaacauggauguagagauuuggaccaaagaaggcgagaagaagaaacuccgaccuagauggcuggacgcucggacauacagcgauccccuugcccugaaggaguucaaagaguuugcagcugguaggaaguccaucgcccucgacuuggugaccgaaauugggcgcguuccaucucaucuggcacacagaacuaggaaugcccuagauaaccuggucaugcuccauacaucggagcacggcggacgggcuuaucgucacgcgguggaggaacuuccugagacgauggaaacccuguuauugcugggccucaugauccugcuuacugggggagccaugcuguuccucauaagcgguaaaggcaucgggaagacaucaauuggauugaucugugugauugcauccaguggcaugcuguggauggcugagauccccuuacaauggauagccucugccauuguccuagaguuuuucaugaugguucugcucaucccagaaccugagaagcagcgcaccccgcaggacaaucaacuugcauacgugguaauugguauccugaccuuggcugccauaaucgcggcuaacgaaauggggcugcucgagacaacuaaacgagaucugggcaugagcaaggaacccggaguggucuccccaacgucauaucuugacguggaucuccauccugccucugcauggacccuguacgccguugcuacaacugugauuacccccauguugagacacacaaucgagaauagcaccgcaaacgucagucuggccgcgauugcuaaccaggccguaguguuaaugggccuagacaaaggguggccaaucuccaagauggaccugggaguuccucuccuugcacugggcugcuacagccaggugaaucccuugacucugacggccgcuguccuccugcuuauaacacauuaugccauuaucgguccgggguuacaggcaaaagcuaccagggaggcccaaaagcggacugcggccggaaucaugaagaacccaaccguggauggcauuaugacaaucgaccuggauccugucauauacgacucuaaauuugaaaagcagcucggucaggugauguugcugguucuaugugcagugcagcugcuccuuaugcgcacuucaugggcucugugcgaggccuugacccuggcaacaggccccauuacgacccucugggaaggguccccaggaaaauucuggaauacuacaaucgcuguaaguauggccaacauuuuuagaggcagcuaucuggccggggcgggauuagcuuucucgaucaugaagucugugggcaccgguaaaagggggacuggaucccaaggcgagacacuuggugaaaaguggaagaaaaagcugaaucagcucagccggaaagauuuugaccuauacaagaaaucaggcauaaccgaggucgaucgaacggaggcaaaggaagggcugaaaagaggagagaucacccaccaugccguuagucgcggcucugcuaaguugcagugguucguggaaaggaacauggucauucccgaggggcgggugaucgaccugggauguggccguggugggugguccuauuacugcgccggacucaagaaaguaacagaagugagaggcuauacuaagggcgggccuggacacgaggagccgguucccaugagcaccuacgguuggaauauugugaaacuuaugucaggcaaggaugucuucuaccugccaccugaaaaaugugacacauugcugugcgauaucggggagaguagccccuccccuacuguggaagagucuaggaccauucgcguccucaagaugguggagccaugguuaaagaacaaucaguuuuguaucaaaguucugaaccccuauaugccuacaguaauagaacaccuugagcggcugcaacgaaagcauggaggcaugcuagugagaaauccacucagcaggaacuccacccacgaaauguacuggauuucaaaugguacugggaacaucgucgcaucugugaauaugguuagucgccuguugcugaaccgguucacgaugacacauagacgucccaccaucgagaaagacguggaucucggagccggcacuaggcacgucaacgcugaaccggagaccccuaauauggacgugauuggcgagcggauaaagcgcaucaaagaagaacacaacucgacauggcauuaugacgaugaaaauccauacaagacgugggcguaucacgggagcuacgagguaaaggccaccggauccgcaucuucaaugauuaacggugugguuaaacuucugacuaagcccugggacgucgugccuauggugacacagauggcuaugaccgauacuacaccauuuggccagcaacgagucuucaaagaaaagguugacaccagaacacccaggagcaugccggggacucggcgcgugaugggaaucaccgccgagugguuauggagaacgcugggcaggaauaaaaagccucgauugugcacccgggaggaauuuacaaagaaaguacguacuaacgcagccaugggugcuguguucaccgaggaaaaucagugggauuccgccaaggcggcagucgaggacgaagauuuuuggaaacucguggacagagagcgcgagcugcauaagcuagggaaauguggaaguugcguuuauaacaugaugggcaagagggagaagaaacuuggcgaguucgggaaagccaaaggaucucgggcuauuugguacauguggcugggugccagauaccucgaauuugaggcacugggcuucuugaaugaggaucacugguuuagccgcgaaaacucauauuccgggguggagggagaaggccugcauaagcucgguuacauccuuagggacauaaguaaaauccccgggggagcuauguaugccgaugacacagcuggcugggacacucgaauuaccgaggaugaccugcacaaugaagagaagaucacgcagcagauggauccagagcaccggcaauuagccaacgcaauuuucaaacugacauaccagaauaaggucgugaagguacagagaccuacccccacuggcacaguuauggacaucauaagcaggaaagaucagcgcgggucuggacaaguggguaccuauggcuugaacacuuuuaccaauauggaagcgcagcucauucgucagauggagggggaaggaguccuguccaaggccgaccuagagaacccacaucuucccgagaaaaagaucacacaguggcuggagacgaaaggcguggagcggcucaagagaauggcuaucucaggugaugacugcguggucaagccuauugaugacagguucgccaacgcacuguuggcuuuaaaugauauggggaaaguucgcaaggacauaccacaauggcagccgagcaaaggauggcacgauuggcaacaggugcccuucuguucgcaucacuuucacgaacugaucaugaaggacggccgaaaacucguagugccuugccggccacaagacgagcuuauuggcagagccaggaucucucagggggcaggauggagucugaaggaaaccgccugucuagguaaggcguacgcucagauguggucccugauguauuuccaucgcagagaucuccgguuggccagcaacgcaauuugcucagccguccccgugcacuggguuccuacuuccaggacaaccuggucuauccaugcucaccaucaauggaugacuacagaggacaugcugaccguguggaaucgugucuggauagaagauaacccauggauggaggacaaaacgcccgugacaaccugggagaauguaccuuaccuuggcaagcgagaagaucaguggugugggagccugaucggacucacaagucgcgccaccugggcacagaacauuccgacagcuauccagcaaguuagauccuuaauuggcaaugaggaauuucuggacuacaugccaagcaugaaacgguucaggaaggaggaggaaucugagggugccaucugguga

SEQ ID NO: 15323 - RNA, 9873 nt, Artificial Sequence
  derived and/or modified CDS sequence (opt3) from DENV-3__JN093515__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcagcaugaaaaucugaaguauacugucauuaucaccgugcacacaggugaccagcaucagguuggcaacgagacccaaggggugacugcagaaauuacgccucaggcuuccacaaccgaggccauccucccagaauacggaacucuuggccuggagugcucuccgcgaaccgguuuggacuucaaugagaugauccuacugacaaugaaaaacaaggcguggaugguccacagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcauacagcucucaccggcgccacagaaauucagaauucagggggaacuaguauauucgcaggucaccugaagugucgguuaaaaauggacaagcuggagcuaaaaggcaugagcuaugccaugugcaccaacacguuuguccucaagaaagaggugucugaaacccagcaugggacaauccugauuaaggucgaguacaagggagaagaugugcccuguaaaaucccuuucuccacugaggacggccaagguaaggcucacaacgggcgucuuauaaccgcgaauccaguugugacaaaacgcgaggaacccguaaacauugaggcagaaccgccuuucggcgagucaaauaucgucaucggaauuggcgauaacgccuugaagaucaauugguacaaaaaggggagcaguauuggaaagauguuugaagcuacugccagaggugcaaggcggauggccauacugggcgacaccgcuugggauuucgggucugugggaggcguucucaacucccuggguaaaauggugcaucagaucuuugggagcgccuauacggcacuuuucucgggcgucucuugggugaugaagauuggaaucggcguacuguugacauggaucgggcucaauuccaaaaacaccucaaugaguuuuagcugcauugcgauaggaaucauuacucuguacuuaggcgcugugguucaggccgacauggguugugucaucaauuggaaggggaaagagcugaagugcggauccggcauuuucgugacaaacgaggugcacaccuggacugaacaguauaaguuucaagcagauucucccaaacgacuagccaccgcuaucgccggugcaugggagaauggcgucugugggauacgcagcacaacgagaauggaaaaccuccuguggaagcagaucgcuaaugagcuuaacuacauuuugugggaaaauaacaucaaacugaccguuguggugggagacauuaucggcguacucgagcaggggaagaggacucugacaccacagccuauggaguuaaaauauucauggaagaccuggggaaaagccaagauagucacagcggaaacucaaaacaguuccuucauuaucgauggccccaauaccccagagugccccagcgugucucgggccuggaacguuugggaaguggaggacuacgguuuuggggucuucacgacaaauauuuggcugaagcuucgcgaaguguauacccaguugugugaccacagacucaugucagcugcaguuaaagaugagagggccgugcaugcugacaugggauacuggaucgagagucagaagaacggcagcuggaaacuggaaaaggccucccuaauagagguaaaaacuugcaccuggccuaagucucacacacuguggucgaaugguguccucgaaagcgauaugaucauuccaaagucccuggcaggcccgaucucacagcauaaccaccgucccggguaccacacucaaaccgcgggaccuuggcaucuuggcaaauuggagcuggacuuuaauuauugcgaggggacaacgguggugauuaccgaaaacuguggaacucggggcccaaguuuacgaacaaccacugucucugguaagcucauccacgaguggugcuguagaagcugcacacugcccccucuuagguacaugggggaagauggauguugguauggcauggagauacgcccaauuuccgaaaaagaggagaauaugguuaagucacuggugagcgccgguucuggcaaaguagacaacuucaccauggggguguugugccucgcuauccuguuugaagaggucaugcggggaaaguucggcaagaaacauaugaucgccgggguguucuuuacguucguucuacugcucuccggacagauuacuuggagagauauggcacacacccugaucaugauuggcaguaaugcuagcgacaggauggguaugggggugacauaccuugccuugauagcaaccuuuaagauccagcccuuccuggccuuaggauuuuuccuccgcaaacugacuucucgagaaaaccuucugcuaggcgucggccucgcuauggcgacaacccugcaauugccggaggauauugaacagauggccaaugggaucgcacugggauuaauggcucucaagcugauuacacaguuugagaucuaucagcuuuggacugcccugauauccuugaccuguucaaacacgaucuucacacucaccguggccuggcggacugcuacccugauucuagcagguguuagucugcuuccuaugugccaaagcucguccaugcguaaaacagacuggcucccaauggccguggcggcuaugggcguccccccucugcccuuguuuaucuucucucugaaggauacuuuaaagagaaggagcuggccacucaaugaggggguaauggccgugggacugguuucaauucuugcaaguucccuguugcgcaacgacgugccuauggccggcccccucgucgcuggugggcugcuaaucgcauguuacgugauaaccggaacgucugccgaucugacaguagaaaaagcggcugacauuaccugggaggaagaggccgaacagacuggcgugagccauaaccuuaugaucacagucgacgaugacggcaccaugcggaucaaggaugacgagacugagaauauucucacaguucuguugaaaaccgcauuacugauaguguccgggaucuuuccauauucaauuccggccacgcuccugguguggcacacuuggcagaagcagacccaaagaagcggaguccuuugggaugugccuagucccccagaaacacagaaagcugagcuggaagaggguguuuacaggaucaagcagcagggcauuuucgggaaaacccaaguaggagugggcguccagaaggaggguguguuucacacaauguggcauguuacucgaggggccguguugaccuacaacggaaagcgccuagaacccaauugggcaucugucaaaaaggaccugaucuccuauggcggcggguggcggcucagcgcucaguggcaaaaaggagaggaagugcagguaauagccgucgagccugguaagaacccaaaaaauuuccagacgaugcccggcacauuccagacuaccacaggggaaaucggagcgauugcccuggauuuuaagccuggcaccucggguucaccgaucauuaacagagaggggaaggugguuggacuuuacggcaauggcguggucacuaaaaacgggggauaugugucugguaucgcacaaaccaaugcugagccagacggccccacaccugaauuagaggaagagauguucaagaaaaggaaccugacgauaauggaucuccacccagggaguggaaagacucguaaauacuugcccgccauuguucgcgaagcuaucaagcggagacugaggacccucauccuggcaccuacacgaguggucgccgccgagauggaggaagcucuuaagggccugccgauucgguaucagaccacugcgacaaaauccgagcauaccggucgcgaaaucguggacuugaugugccacgcaacguuuacuaugagacuacugagccccguaagggugccaaauuacaaccucauaauuauggaugaggcccauuucacagacccugcuucuaucgccgcacggggguauauuagcacccgaguuggaaugggcgaagccgcugcgaucuuuaugaccgccacucccccaggcacagcagaugcuuucccucaguccaaugcccccauacaggacgaggagagagacauuccagaacgcucauggaacagugggaaugaguggaucaccgauuuugcaggaaagacagucugguucgugccgagcaucaaagccgguaacgacauugcuaacuguuuaaggaagaauggcaaaaaggugauccaacugucucguaagacuuuugauacggaauaccagaaaaccaagcuuaacgacugggauuucgucguaacaacugacauuuccgagaugggggccaauuuuaaagcggaucgggugauagacccuagaaggugccugaagcccguuauccucaccgauggaccagagcgcgugauuuuggcaggccccaugccugucacagccgcuucagccgcucagcgaagaggucggguggggaggaacccacagaaagaaaaugaccaauacaucuucaccggccagccccugaacaaugaugaggaccacgcacacuggacugaagccaagaugcuccuggacaacaucaauacgccugagggaauuauaccggcucuuuucgaaccagagcgcgagaagagugccgcaaucgauggcgaauaucgucuaaaaggggagagcagaaagaccuuuguugaacugaugcggaggggagacuugcccgugugguuagcgcauaaagucgccuccgaggguauuaaguacacagaucgcaaauggugcuucgacggccagcgaaacaaucagauccuggaagagaacauggauguggagauuuggacuaaggaaggggagaaaaagaagcucagaccucgguggcuggacgcuaggaccuauucugauccccuugcccugaaagaauuuaaggaguucgcagcuggacgcaaaucgaucgcccucgacuugguaacagaaauaggcagagugccaagccaccuggcacauaggacccggaaugcccuagauaaccugguuaugcuccacacuucagagcacggugggcgugcuuaccgccaugcggucgaggaacuuccugagacaauggaaacgcuguuauugcugggccucaugauccugcuuaccggaggcgccaugcuguuucucauuuccgggaagggaaucgguaaaacuaguauuggcuugaucugugugauagcaucuagcgggaugcuguggauggcugagauucccuuacaauggaucgccuccgccauugugcuagaguucuuuaugaugguccugcucaucccagaaccugagaagcagcgaacaccgcaggacaaucaacuugcauauguugugauaggaauccugaccuuggcugccauuaucgcggcuaacgaaaugggccugcucgagaccacaaagagagaucuggguaugucaaaagaacccgggguagugucuccaacuagcuaccuugacgucgaucuccacccugccagugcauggacgcuguaugccguggcuaccacaguuauuacucccauguugaggcauaccaucgagaauuccacagcaaacgugagccuggccgcgauagcuaaccaggccgucguauuaaugggccuagacaagggauggccaauuucuaaaauggaccugggcgugccucuccuugcacuggggugcuacucacagguuaaucccuugacccugacugccgcugugcuccugcuuaucacgcacuacgccaucauuggaccgggcuuacaggcaaaggcuacacgggaggcccaaaaacgcaccgcggccgguaucaugaagaacccaacugucgaugggauaaugaccauugaccuggauccugugaucuaugacuccaaguucgaaaaacagcucggacaggucauguugcuggugcuauguguugugcagcugcuccuuaugagaacaaguugggcacugugcgaggcuuugacucuggccaccggccccauuacaacgcucugggaagguagcccaggcaaguuuuggaauaccacuaucgcaguaucgauggcuaacauauucagggggucuuaccuggccggagccggcuuagcguuuuccaucaugaaaagcguggggacaggaaagcggggcaccgguucacaaggggagacucuuggagaaaaauggaagaagaaacugaaucagcucagucgaaaggauuucgaccuauauaaaaagucuggcauuacagaggucgauagaaccgaggcuaaagaaggucugaagcgcggcgagaucacgcaucacgcaguuuccagggggagcgccaaauugcagugguuuguggaacggaacauggucauucccgagggacgugugaucgaccugggcugugggagaggaggcuggucauacuauugcgcuggucucaagaagguaaccgaagugaggggguacacaaaaggaggcccuggccacgaggagccgguucccaugaguacuuauggguggaauauugugaagcuuaugagcggaaaagaugucuucuaccugccaccugaaaagugugacaccuugcugugcgauaucggugaguccucucccagcccuacaguggaagagucccgcacuauacggguccucaaaaugguggagccaugguuaaagaacaaucaguucuguauuaagguucugaaccccuacaugccuaccguaaucgaacaucuugagcgacugcaaagaaaacacggcgggaugcuagugaggaauccacucucacgcaacucuacacaugaaauguauuggaucaguaauggaaccggcaacauugucgccucggugaauaugguuagccggcuguugcugaacagauuuacuaugacgcaccguaggcccacaauagagaaggacguggaucucggugcagggacccggcacgucaacgccgaaccggagacuccuaauauggacaucauuggagagcgcaucaaacgaauuaaggaagagcauaacuccaccuggcacuacgacgaugaaaauccauauaaaacaugggcuuaccauggcucuuaugaggugaaggcgacgggcucagccagcuccaugaucaacgggguagugaagcuucugaccaaacccugggacguugucccuauggugacucagauggcaaugacagauaccacuccauucggacagcaaagaguguuuaaggaaaaagucgacacaaggaccccccggaguaugccggguacacgcagaguuaugggcauaacugcugagugguuauggaggacccuggggcgaaauaagaaaccucgguugugcacgcgugaggaauucaccaagaaggugagaacaaacgccgcaaugggagccguauuuacugaggaaaaucagugggauucugcuaaagccgcgguggaggacgaagauuucuggaagcucgucaaccgcgagagggagcugcacaaacuaggcaagugugguagcugcguguacaauaugauggggaaacgggaaaagaaacuuggagaguuuggcaaggcaaagggcucaagagccaucugguauauguggcugggggcucgcuaccucgaauucgaggcccugggauuuuugaacgaggaccauugguucuccagggaaaauaguuacagcgguguugagggcgaagggcugcacaaacucggauauauucuucgagauaucucuaagauucccggcggugcaauguacgcugacgauaccgccgggugggacacacggaucacugaggacgaucugcacaacgaagagaaaauaacccagcagauggacccagagcauagacaauuagcuaaugccauuuuuaagcugacguaucagaacaaaguggucaaggugcagaggccuacacccaccggaacuguaauggauaucaucucccgcaaggaccagcguggcucaggccaaguugggacauacggauugaauaccuucacuaacauggaagcacagcucauucggcagauggagggugaaggcgugcugagcaaagcggaucuagagaacccacaccuucccgaaaagaaaauaacccaguggcuggagacaaagggggucgagagacucaaaaggauggccaucucgggagacgauugcguggugaagccuauugacgaucgcuuugcuaaugcccuguuggcauuaaacgacaugggcaagguccgaaaagauaucccacaauggcagccgucuaaggguuggcaugacuggcagcagguucccuucuguagucaccacuuccaugaacugauuaugaaagaugggcggaagcucgugguaccuugcagaccacaagacgagcuuaucggaagggcucgcauaucccagggcgccggcuggagccugaaagaaacggcaugucuagggaaggccuaugcgcagauguggucacugauguacuuucacagacgggaccucagguuggcuuccaaugccaucugcucugcagugcccguccauugggugccuaccagccguacuacauggaguauucacgcccaucaccaauggaugaccacugaggauaugcugacaguuuggaaccgaguguggaucgaagacaauccauggauggaggauaagacccccgucacgacaugggagaacgugccuuaucuuggaaaacgcgaagaccaguggugugguucccugauuggccucaccagcagagcuacuugggcccagaauaucccgaccgcaauucagcaaguacggucuuuaauagggaacgaggaauuccuggauuacaugccaucaaugaagagguuucgcaaagaggaggaaagugagggagcuaucugguga

SEQ ID NO: 15324 - RNA, 9873 nt, Artificial Sequence
  derived and/or modified CDS sequence (opt3) from DENV-3__JF937646__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcauugggaacagagacuuuguagaaggauugucaggugccaccuggguugaugugguccuggagcacggcgggugcgugacgacuauggcgaagaauaaacccacacuagacaucgagcuccagaagaccgaagcaacucaacuggccacacuuaggaaacuguguauugagggaaagaucaccaacauaacgaccgauagccggugcccuacacagggcgaagcuacuuugccagaggaacaggaccagaauuauguguguaaacacaccuacgucgaucgcgguugggggaacggaugcggccucuucggcaaggggagucugguuacaugcgccaaguuucaauguuuagagcccauugagggaaaagugguacaguaugaaaaucugaaguacacugugaucauuaccguccauacaggugaccagcaccaggugggcaacgagacccaagggguuacugcagaaaucacgccucaggcuuccacaaccgaggccauccucccagaauauggaacucuuggccuggagugcucuccgcgaaccgguuuggacuucaaugagaugauucuacugacaaugaaaaacaaggcguggauggugcauagacagugguuuuucgaucucccccugccuuggaccagcggggccacuacagaaacgccaaccuggaauaggaaagagcuucuggucacuuuuaagaacgcacacgcuaaaaagcaagaagugguaguuuugggcucccaggagggagccaugcacacagcucucaccggcgccacagaaauacagaauucagggggaacuaguaucuucgcaggucaucugaagugucgguuaaaaauggacaagcuggagcuaaaaggcaugagcuacgccaugugcaccaacgcuuuugugcucaagaaagaggucucugaaacgcagcacgggaccauucugaucaagguggaguacaagggagaagauguccccuguaaaauaccuuucuccacagaggacggccaagguaaggcgcauaacgggcgucuuauuacugcaaauccagugguuaccaaaaaggaggaacccgugaacaucgaggccgaaccgccuuucggcgagucaaauaucguaauuggaaucggcgauaacgcuuugaaaauuaauugguauaagaaggggagcaguauaggaaaaauguuugaagccacagcacgcggugccagaaggauggcuauccugggcgacacugccugggauuucgggucugucggaggcgugcucaacucccuggguaagaugguucaccagauuuuugggagcgcauacaccgcgcuuuucucgggcgugucuugggucaugaaaaucggaaucggcgugcuguugacguggauugggcucaauuccaagaacacaucaaugaguuuuagcugcauagcuaucggaauuaucacccuguauuuaggcgccguagugcaggcagacauggguuguguuauuaauuggaaagggaaggagcugaagugcggauccggcaucuucgucacuaacgaggugcauacauggaccgaacaguacaaauuucaagccgauucucccaagcggcuagcuacugccauagcaggugcuugggagaauggcgugugugggauccgaagcaccacacgcauggaaaaccuccuguggaaacagauugccaaugagcuuaacuauaucuugugggaaaauaacauuaagcugacggucguugugggagacaucauaggcgugcucgagcaggggaaaagaacccugacuccacagccuauggaguuaaaguacucauggaaaacauggggaaaggcgaagauuguaaccgccgaaacacaaaacaguuccuucaucauugauggccccaauacuccagagugccccagcgucucuagggcuuggaacgugugggaaguugaggacuaugguuuugggguguucaccacgaauaucuggcugaaacuucgggaagucuacacacaguugugugaccaccgccucaugucagcagccgugaaggaugagagagcuguucacgccgacaugggauacuggauagagagucagaaaaacggcagcuggaagcuggaaaaagcaucccuaaucgaggugaagaccugcacuuggccuaagucucauacccuguggucgaaugguguacucgaaagcgauaugauuaucccaaaaucccuggcgggcccgauuucacagcacaaccauaggcccggguaucacacacaaacugccggaccuuggcaccuuggcaaguuggagcuggacuuuaauuacugcgaggggaccacagucgugaucacggaaaacuguggaacccguggcccaaguuuacggacuacaaccgugucugguaaacucauacaugaguggugcugucgaagcugcacucugcccccucuuagauauaugggggaagauggauguugguacggcauggagauuaggccaaucuccgaaaaggaggagaauauggucaaaucacugguuagcgcugguucuggcaagguggacaacuucacaauggggguauugugccucgccauccuguuugaagaggugaugcgcggaaaguucggcaaaaagcacaugauugcaggggucuucuuuaccuucgugcuacugcucuccggacagaucacguggcgggauauggcucauacucugauuaugauaggcaguaaugccagcgacagaauggguauggggguuaccuaucuugcauugaucgccacauuuaaaauucagcccuuccuggcuuuaggauuuuuccucaggaagcugaccucucgcgaaaaccuucugcuaggcgugggccucgcgauggucacuacacugcaauugccggaggauaucgaacagauggccaaugggauugcacugggauuaauggcucucaaacugaucacccaguuugagacauaccagcuuuggacugcccugauauccuugaccuguucaaacacgaucuucacacucaccguggccuggcgaacugcuacccugauucuagcagguguuagucugcuuccugugugccaaagcucguccaugcggaagacagacuggcucccaauggccgucgcggcuaugggcguacccccucugcccuuguuuaucuucgggcugaaggauacuuuaaaacguagaucuuggccacucaaugagggagugauggccguuggccuggugagcauucuugcaucaagucuguugaggaacgacgucccuauggccgguccccucguggcugggggacugcuaaucgcauguuauguaauaaccggcacguccgccgaucugacaguggaaaaggcggcugacauuaccugggaggaagaggccgaacagacuggcgucucucacaaccuuaugaucacaguugacgaugacgggaccaugcgcaucaaagaugacgagacugagaauauucucacagugcuguugaagaccgcauuacugauagugagcggaaucuuuccauacuccauuccggccacgcuccuggucuggcauacuuggcagaaacagacccaacggucaggugugcuuugggauguuccuagccccccagaaacacagaaggcugagcuggaagagggcguauacagaaucaaacagcaggggauuuucggaaagacccaagugggcgucggugugcagaaggaggggguuuuucacacaauguggcacgugacuaggggagccgucuugaccuauaacggcaaacgacuagaacccaauugggcaagugugaagaaagaccugaucucuuacggcgggggauggcgccucuccgcucaguggcaaaagggugaggaaguacaggucauagccguggagccuggcaaaaacccaaagaauuuccagacgaugcccgggacauuccagacuaccacaggagaaaucggcgcgauugcccuggauuuuaagccugguaccagcgggucgccgaucauuaaccgggagggaaaaguugugggccuuuauggcaauggggucgugacuaagaacggagguuacguuucaggcaucgcacaaaccaaugcugagccagacgggcccacaccugaauuagaggaagagauguucaaaaagagaaaccugacgauaauggaucuccauccaggaucuggcaaaacuaggaaguauuugcccgccauugugcgugaagcuaucaagcgccggcugagaacccucauccuggcaccuacaagggucguggccgccgagauggaggaagcucuuaaaggucugccgauucgauaccagaccacugcgacaaagagugagcacaccgggcgggaaaucguagacuugaugugccaugcaacguuuacuaugcgccuacugucccccgugagaguuccaaauuauaaccucauaauuauggaugaggcccacuucacagacccugcuagcaucgccgcaaggggauacauuucuacccgggucggcaugggcgaagccgcugcgaucuuuaugaccgccacucccccagggacagcagaugcuuucccucagagcaaugcccccauacaggacgaggagcgagacauuccagaaagauccuggaacucaggaaaugaguggaucaccgauuuugcagguaaaacagugugguucgugccgaguaucaaggucggcaacgacauugccaacuguuuacgcaaaaaugggaagaagguaauccaacugagcaggaaaacuuuugauacggaauaccagaagaccaaacuuaacgacugggauuucgugguuacaacugacauuucugagaugggagcuaauuuuaaggccgaucgugugauagacccucggagaugccugaaacccgucauccucaccgauggcccagagagggugauuuuggcgggucccaugccuguuacagcagccuccgcugcccagcgccgagggagagugggccggaacccacagaaggaaaaugaccaauauaucuucaccggacagccccugaacaaugaugaggaccaugcucacuggacugaagcaaagaugcuccuggacaacaucaauacgccugagggcauuauaccggcccuuuucgaaccagagagggagaaaucagcugccaucgauggggaauaccgccuaaagggagagagucguaaaaccuuugucgaacugaugagacggggugacuugcccgugugguuagcacacaagguagcgagcgagggcauuaaauauacagauaggaaguggugcuucgacgggcagcgcaacaaucagauccuggaagagaacauggauguggagauuuggacuaaagaaggagagaagaagaaacuccgaccuagauggcuggacgcccggaccuacuccgauccccuugcucugaaggaauuuaaagaguucgccgcaggcaggaagucuaucgcucucgacuugguuacagaaauaggucgcgucccaucgcaucuggcccacagaaccaggaaugcacuagauaaccuggugaugcuccauacuagcgagcacgggggccgggccuaucgucacgcuguggaggaacuuccugagacaauggaaacgcuguuauugcugggacucaugauccugcuuaccggcggggcgaugcuguuucucauuucaggaaaagguaucggcaagacuuccauuggguugaucugugucauagccaguucuggaaugcuguggauggcagagauucccuuacaauggaucgcuagcgccauuguucuagaguucuuuaugauggugcugcucaucccagaaccugagaagcagcgcacaccgcaggacaaucaacuugccuacguagugauaggcauccugaccuuggcagcuauuaucgccgcgaacgaaaugggucugcucgagaccacaaaacgagaucuggggauguccaaggaacccggcgucgugucaccaacuucuuaucuugacguugaucuccauccugcuagcgccuggacgcuguacgcaguggccaccacagucauuacucccauguugagacacaccaucgagaauaguacagcuaacguaucccuggcagccauagcgaaccaggcugugguuuuaaugggacuagacaaaggcuggccaauuagcaagauggaccugggggugccucuccuugcccugggaugcuacucucaggucaaucccuugacccugacugcagccgugcuccugcuuaucacgcauuaugcuaucauuggcccggguuuacaggccaaagcaacaagggaggcucaaaagcggaccgccgcggggaucaugaagaacccaacugucgauggaauaaugaccauugaccuggauccugugaucuacgacucaaaauucgaaaagcagcucggccagguuauguugcuggugcuaugugccguacagcugcuccuuaugcgcacauccugggcacugugcgaggcuuugacucuggccaccggucccauuacaacgcucugggaaggcaguccagggaaauuuuggaauaccacuaucgcagugagcauggcuaacauauucagaggaucguaucuggccggcgccggguuagcguuuucuaucaugaaguccgucggaacaggcaaaagggguaccgggagccaaggagagacucuuggcgaaaaguggaagaaaaagcugaaucagcucucacggaaagauuucgaccuauacaagaaaagugguauuacagagguugaucgaaccgaggcuaaggaaggccugaaaagaggggagaucacgcaccaugcagugucucgcggauccgccaaguugcagugguuugucgaaaggaacauggugauucccgagggccggguaaucgaccugggguguggacguggcgguuggagcuauuacugcgcugggcucaagaaagugaccgaaguuagaggauauacaaagggcggcccugggcacgaggagccggugcccaugucaacuuacggauggaauauugucaaacuuaugagugguaaggauguguucuaccugccaccugaaaaaugugacaccuugcugugcgauaucggcgagagcucccccucuccuacagucgaagagagcaggacuauacgcgugcucaagaugguugagccaugguuaaagaacaaucaguucuguauuaaaguacugaaccccuauaugccuaccgugaucgaacaccuugagcggcugcaacgaaagcaugggggaaugcuagucagaaauccacucuccaggaacucaacacacgaaauguacuggaucucuaauggcaccgguaacauuguggccaguguuaauauggugucgcgccuguugcugaaccgguuuacuaugacgcauagacgucccacaauagagaaagacgucgaucucggggcaggaaccaggcacgugaacgccgaaccggagacuccuaauauggacguaaucggcgagcggauuaagcgcaucaaagaagagcacaacagcaccuggcauuaugacgaugaaaauccauacaagacaugggcuuaucacggcuccuacgaggugaaggcgacggggucugccucaagcaugauuaacggaguugucaaacuucugaccaagcccugggacguggugccuauggucacucagauggcaaugacagauaccacuccauucggucagcaacgaguuuuuaaagaaaagguggacacaagaacccccagguccaugccgggcacacggcgcguaauggggaucacugcugagugguuauggagaacccugggaaggaauaaaaagccucgauugugcacgcgggaggaauucaccaagaaagugcguacaaacgccgcaaugggcgccgucuuuacugaggaaaaucagugggauagugcuaaggccgcgguggaggacgaagauuucuggaaacucguugacagagagcgcgagcugcauaagcuagguaaaugugggucuugcguguauaacaugaugggaaagagggaaaaaaagcuuggcgaguuuggcaaggcaaaagggagccgggccauaugguacauguggcugggagcuagauaccucgaauucgaggcccuggguuuuuugaaugaggaucacugguucucacgcgaaaacuccuauaguggcgucgagggggaaggacugcauaagcucggcuacauccuuagggacauuagcaaaauccccgguggggcaauguaugcugaugacaccgccggaugggacacacgaauuacugaggaugaccugcacaaugaagagaagaucacccagcagauggauccagagcaccggcaauuagcuaacgccauauuuaaacugacguaccagaauaaggugguaaagguucagagaccuacacccaccggcacugugauggacauuaucucuaggaaagaucagcgcggcuccgggcaagucggaacauaugguuugaacaccuucacuaauauggaagcacagcucauccgucagauggagggcgaaggggugcugucaaaggcggaccuagagaacccacaucuucccgaaaaaaagauuacccaguggcuggagacaaaaggaguggagcggcucaagagaauggccauaagcggcgaugacugcgucguuaagccuaucgaugacagguuugcuaacgcccuguuggcauuaaaugauauggguaaagugcgcaaggacauuccacaauggcagccgucgaaaggguggcacgauuggcagcagguacccuucuguucucaucacuuccacgaacugaucaugaaggacggacgaaaacucguggucccuugccggccacaagacgagcuuauuggcagagcuaggaucagucagggcgccggguggucccugaaggaaacggcaugucuaggaaaggccuacgcgcagauguggagccugauguauuuucaucgcagagaucuccgguuggcuucaaacgccauaugcuccgcagugcccguucacugggugccuaccucuaggacuacauggagcauccaugcccaccaucaauggaugaccacugaggacaugcugacagucuggaaucguguguggauugaagauaacccauggauggaggacaaaacccccguaacgacaugggagaauguuccuuaccuugguaagcgagaagaucagugguguggcagucugaucgggcucaccucccgcgcuacuugggcccagaacauuccgaccgcaauccagcaagugagaagcuuaauuggaaaugaggaauuccuggacuacaugccaucuaugaaacgguuuaggaaggaggaggaaucagagggcgcuauaugguga

SEQ ID NO: 15325 - RNA, 9873 nt, Artificial Sequence
  derived and/or modified CDS sequence (opt3) from DENV-3__JF937633__SS-prME
accagccugugccucaugaugauccuucccgcagcucuggcauuccacuugacauccagagacggcgaaccuagaaugauuguggggaagaacgaacgggguaaaucuuuacuguuuaagacugccucagguauaaauauguguacgcuaaucgcgauggaucucggcgaaaugugcgacgauaccgucacauacaaauguccacauauuacugaaguugaaccggaagacaucgauugcugguguaaccugaccaguacaugggugaccuaugggacuugcaaucaggcuggagaacaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucaaaauucagggggaacaagcauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacuaagaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauaugggggaagauggauguugguacggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcacaugaucgccgggguguucuuuacguucguucuacugcucuccggacagauuacuuggcgggauauggcacauacccugaucaugauuggcaguaaugcuagcgacagaauggguaugggggugacauaucuugccuugauagcaaccuuuaaaauccagcccuuccuggccuuaggauuuuuccucaggaagcugacuucucgcgaaaaccuucugcuaggcgucggccucgcuauggcgacaacccugcaauugccggaggauauugaacagauggccaaugggaucgcacugggauuaauggcucucaaacugauuacacaguuugagacuuaccagcuuuggaccgcccugaucuccuugacguguucaaacacaauauucacccucacuguggccuggcgaaccgcuacacugauccuagccgguguuagucugcuuccugugugccaaagcucguccaugcggaagacugacuggcucccaauggccgucgcggcuaugggcguacccccucugcccuuguuuauuuucgggcugaaggauaccuuaaaacguagaucuuggccacucaaugagggagugauggccguuggccuggugagcauccuugcaucaagucuguugaggaacgacgucccuauggccgguccccucguggcugggggacugcuaauugcauguuauguaaucacgggcacauccgccgaucugaccguggaaaaggcggcugacauaacuugggaggaagaggccgaacagacaggcgucucucacaaccuuaugauuaccguugacgaugacgggacuaugcgcaucaaagaugacgagacagagaauauccucaccgugcuguugaagacggcauuacugauugugagcggaauauuuccauacuccaucccggccacucuccuggucuggcauaccuggcagaaacagacacaacggucaggugugcuuugggauguuccuagucccccagaaacccagaaggcugagcuggaagagggcguauacagaauuaaacagcaggggaucuucggaaagacacaagugggcgucggugugcagaaggaggggguuuuucacacuauguggcacgugaccaggggagccgucuugacguauaacggcaaacgacuagaacccaauugggcaagugugaagaaagaccugauuucuuacggcgggggauggcgccucuccgcucaguggcaaaagggugaggaaguacaggucaucgccguggagccuggcaaaaacccaaagaauuuccagacaaugcccgggacuuuccagaccacaaccggagaaauaggcgcgaucgcccuggauuuuaagccugguacuagcgggucgccgauuaucaaccgggagggaaaaguugugggccuuuauggcaauggggucgugaccaagaacggagguuacguuucaggcauugcacaaacaaaugcugagccagacgggcccacgccugaauuagaggaagagauguucaaaaagagaaaccugacuaucauggaucuccauccaggaucuggcaaaaccaggaaguauuugcccgccauagugcgugaagcuauuaagcgccggcugagaacacucauccuggcaccuaccagggucguggccgccgagauggaggaagcucuuaaaggucugccgauccgauaccagacuacagcgaccaagagugagcacacggggcgggaaauuguagacuugaugugccaugcaacuuuuacaaugcgccuacugucccccgugagaguuccaaauuauaaccucaucauaauggaugaggcccacuucaccgacccugcuagcauugccgcaaggggauacaucucuacccgggucggcaugggcgaagccgcugcgauuuuuaugacugccacacccccagggaccgcagaugcuuucccucagagcaaugcccccauccaggacgaggagcgagacauaccagaaagauccuggaacucaggaaaugaguggauuacagauuuugcagguaaaacugugugguucgugccgaguaucaaggccggcaacgacaucgcuaacuguuuacgcaaaaaugggaagaaggucauucaacugagcaggaaaacguuugauaccgaauaccagaagacaaaacuuaacgacugggauuucguagugacuaccgacaucucugagaugggagccaauuuuaaggcggaucguguuauugacccucggagaugccugaaacccgugauacucacagauggcccagagagggucaucuuggcaggucccaugccugugaccgccgcuuccgccgcucagcgccgagggagaguuggccggaacccacagaaggaaaaugaccaauauauuuucacuggacagccccugaacaaugaugaggaccaugcacacuggacggaagccaagaugcuccuggacaacaucaauaccccugagggcaucauuccggcucuuuucgaaccagagagggagaaaucagccgcaauagauggggaauaccgccuaaagggagagagucguaaaacauuuguggaacugaugagacggggugacuugcccgucugguuagcgcacaagguggccagcgagggcaucaaauauacugauaggaaguggugcuucgacgggcagcgcaacaaucagauucuggaagagaacauggauguagagaucuggaccaaagaaggagagaagaagaaacuccgaccuagauggcuggacgcucggacauacuccgauccccuugcccugaaggaauuuaaagaguucgcagcuggcaggaagucuauuacccucgacuuggugacugaaaucggucgcguuccaucgcaucuggcccacagaacaaggaaugcacuagauaaccuggucaugcuccauacgagcgagcacgggggccgggccuaucgucacgcuguggaggaacuuccugagaccauggaaacucuguuauugcugggacucaugauacugcuuacaggcggggcgaugcuguuucucaucucaggaaaagguauuggcaagaccuccaucggguugauuugugugaucgccaguucuggaaugcuguggauggcagagauacccuuacaauggauugcuagcgccaucguccuagaguucuuuaugaugguucugcucauuccagaaccugagaagcagcgcaccccgcaggacaaucaacuugccuacgugguaaucggcauacugacauuggcagcuaucauugccgcgaacgaaaugggucugcucgagacuacgaaacgagaucuggggauguccaaggaacccggcguggucucaccaaccucuuaucuugacguggaucuccauccugcuagcgccuggacacuguacgcaguugccacuaccgugaucacacccauguugagacacaccauugagaauaguacugcuaacgucucccuggcagccaucgcgaaccaggcuguaguguuaaugggacuagacaaaggcuggccaauaagcaagauggaccuggggguuccucuccuugcccugggaugcuacucucaggugaaucccuugacgcugacagcagccguccuccugcuuauuacccauuaugcuaucaucggcccggguuuacaggccaaagcaacuagggaggcucaaaagcggaccgccgcggggauuaugaagaacccaacaguggauggaaucaugacuauagaccuggauccugucauuuacgacucaaaauucgaaaagcagcucggccaggugauguugcugguucuaugugccgugcagcugcuccuuaugcgcaccuccugggcacugugcgaggcuuugacacuggccacgggucccaucaccacucucugggaaggcaguccagggaaauuuuggaauacaaccauugcaguaagcauggcuaacaucuucagaggaucguaucuggccggcgccggguuagcguuuucuauaaugaaguccgugggaacuggcaaaagggguacagggagccaaggagagacccuuggcgaaaaguggaagaaaaagcugaaucagcucucacggaaagauuucgaccuauacaagaaaagugguaucacggaggucgaucgaaccgaggcuaaggaaggccugaaaagaggggagauuacacaccaugcaguuucucgcggauccgccaaguugcagugguuuguggaaaggaacauggucauccccgagggccgggugauugaccugggguguggacguggcgguuggagcuauuacugcgcugggcucaagaaaguaacugaagugagaggauauaccaagggcggcccugggcacgaggagccgguucccaugucaacauacggauggaauaucgugaaacuuaugagugguaaggaugucuucuaccugccaccugaaaaaugugacacuuugcugugcgauauuggcgagagcucccccucuccuaccguggaagagagcaggacaauccgcguccucaagaugguggagccaugguuaaagaacaaucaguucuguauaaaaguucugaaccccuauaugccuaccguaauugaacaccuugagcggcugcaacgaaagcaugggggaaugcuagugagaaauccacucuccaggaacucaacucacgaaauguacuggaucucuaauggcacggguaacaucgucgccagugugaauaugguuucgcgccuguugcugaaccgguuuacaaugacccauagacgucccacuauugagaaagacguggaucucggggcaggaaccaggcacgucaacgccgaaccggagacaccuaauauggacgugauaggcgagcggaucaagcgcauuaaagaagaacacaacagcacguggcauuaugacgaugaaaauccauacaagaccugggcuuaucacggcuccuacgagguaaaggcgacugggucugccucaagcaugaucaacggagugguuaaacuucugacaaagcccugggacgucgugccuauggugacccagauggcaaugacugauacaaccccauucggucagcaacgagucuuuaaagaaaagguugacacaagaacucccagguccaugccgggcacccggcgcgugauggggauuacggcugagugguuauggagaacccugggaaggaauaaaaagccucgauugugcacacgggaggaguucacuaagaaaguacguaccaacgccgcaaugggcgccguguuuacagaggaaaaucagugggauagugcuaaggccgcggucgaggacgaagauuucuggaaacucguggacagagagcgcgagcugcauaagcuagguaaaugugggucuugcguuuauaacaugaugggaaagagggagaagaaacuuggcgaguuuggcaaagcaaaagggagccgggccaucugguacauguggcugggagcuagauaccucgaguucgaggcccugggauuuuugaaugaggaucacugguucucacgcgaaaacuccuauaguggcguggagggggaaggacugcauaagcucggcuacauacuuagggacaucagcaaaauucccgguggggcaauguaugcugaugacacugccggaugggacacccgaaucacggaggaugaccugcacaaugaagagaagauuacacagcagauggauccagagcaccggcaauuagcuaacgccaucuuuaaacugaccuaccagaauaaggucgugaagguacagagaccuacucccacaggcaccguuauggacauaauuucuaggaaagaucagcgcggcuccgggcaagugggaacuuaugguuugaacaccuucacaaauauggaagcacagcucauccgucagauggagggcgaagggguccugucaaaggcggaccuagagaacccacaucuucccgagaaaaagaucacgcaguggcuggagaccaaaggaguggagcggcucaagagaauggccauuagcggcgaugacugcguggucaagccuauagaugacagguuugcuaacgcccuguuggcauuaaaugauauggguaaaguucgcaaggacaucccacaauggcagccgucgaaaggguggcacgauuggcaacaggugcccuucuguucucaucacuuccacgaacugauuaugaaggacggacgaaaacucguagugccuugccggccacaagacgagcuuaucggcagagcuaggauuagucagggcgccggguggucccugaaggaaacugcaugucuaggaaaggccuacgcgcagauguggagccugauguauuuucaucgcagagaucuccgguuggcuucaaacgccaucugcuccgcaguccccgugcacuggguuccuacaucuaggaccacuuggagcauacaugcccaccaucaauggaugacaaccgaggacaugcugacgguguggaaucgugucuggaucgaagauaacccauggauggaggacaaaacacccgugaccacuugggagaauguaccuuaccuugguaagcgagaagaucagugguguggcagucugauugggcucaccucccgcgcuacaugggcccagaacaucccgacugcaauucagcaaguuaggagcuuaaucggaaaugaggaguuccuggacuacaugccaucuaugaaacgguuuaggaaggaggaggaaucagagggcgcuauuugguga

SEQ ID NO: 15326 - RNA, 9873 nt, Artificial Sequence
  derived and/or modified CDS sequence (opt3) from DENV-3__JF937634__SS-prME
accagccugugccucaugaugauccuucccgccgcucuggcauuccacuugacauccagagacggcgagccuagaaugauuguggggaagaacgaacgggguaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucaaaauucagggggaacaagcauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacuaagaaagaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucguuaaugagcuuaacuauauuuugugggaaaauaacaucaagcugaccguggugguaggagacauuaucggcguccucgagcaggggaaaagaacucugacaccacagccuauggaguuaaaguacucauggaaaaccuggggaaaggcuaagauagugacagccgaaacucaaaacaguuccuucauuaucgauggccccaauaccccagagugccccagcguuucuagggcguggaacgugugggaagucgaggacuaugguuuugggguguucacgacaaauauuuggcugaaacuucgggaaguuuacacccaguugugugaccaccgccucaugucagccgcugugaaggaugagagagcaguacacgccgacaugggauacuggaucgagagucagaaaaacggcagcuggaagcuggaaaaggcuucccuaauagaggucaagacuugcaccuggccuaagucucauacacuguggucgaauggugugcucgaaagcgauaugaucauuccaaaaucccuggccggcccgaucucacagcacaaccauaggcccggguaucacacucaaaccgcaggaccuuggcaccuuggcaaguuggagcuggacuuuaauuacugcgaggggacaacgguggucauuaccgaaaacuguggaacucguggcccaaguuuacggacaaccacuguuucugguaaacucauccaugaguggugcugucgaagcugcacacugcccccucuuagauauaugggggaagauggauguugguacggcauggagauaaggccaauuuccgaaaaggaggagaauauggugaaaucacugguaagcgcggguucuggcaagguggacaacuucaccaugggggucuugugccucgccauccuguuugaagaggugaugcgcggaaaguucggcaaaaagcacaugaucgcugggguuuucuuuacguucgugcuacugcucuccggacagauuacuuggcgggauauggcccauacccugaucaugauuggcaguaaugcaagcgacagaauggguaugggggucacauaucuugcuuugauagccaccuuuaaaauccagcccuuccuggcauuaggauuuuuccucaggaagcugacuucucgcgaaaaccuucugcuaggcgugggccucgccauggcuacaacccugcaauugccggaggauauugaacagauggcgaaugggaucgcccugggauuaauggcacucaaacugauuacacaguuugagacuuaccagcuuuggaccgcucugaucuccuugacguguucaaacacaauauucacccucacuguugccuggcgaaccgccacacugauccuagcuggugugagucugcuuccugucugccaaagcucguccaugcggaagacugacuggcucccaauggcaguagccgcgaugggcgugcccccucugcccuuguuuauuuucgggcugaaggauaccuuaaaacguagaucuuggccacucaaugagggaguuauggcugugggccuggucagcauccuugccucaagucuguugaggaacgacgugccuauggcagguccccucguagccgggggacugcuaauugcuuguuaugugaucacgggcacauccgcagaucugaccgucgaaaaggccgcggacauaacuugggaggaagaggcugaacagacaggcguuucucacaaccuuaugauuaccguggacgaugacgggacuaugcgcaucaaagaugacgagacagagaauauccucaccgugcuguugaagacggccuuacugauugucagcggaauauuuccauacuccaucccggcaacucuccugguguggcauaccuggcagaaacagacacaacggucagguguucuuugggauguaccuagucccccagaaacccagaaggccgagcuggaagagggcguguacagaauuaaacagcaggggaucuucggaaagacacaagucggcguggguguucagaaggaggggguguuucacacuauguggcacgucaccaggggagcuguguugacguauaacggcaaacgacuagaacccaauugggccaguguaaagaaagaccugauuucuuacggcgggggauggcgccucuccgcacaguggcaaaagggugaggaaguccaggugaucgcuguugagccuggcaaaaacccaaagaauuuccagacaaugcccgggacuuuccagaccacaaccggagaaauaggcgccaucgcgcuggauuuuaagccugguacuagcgggucgccgauuaucaaccgggagggaaaaguggucggccuuuauggcaauggggugguuaccaagaacggagguuacgugucaggcauugcccaaacaaaugcagagccagacgggcccacgccugaauuagaggaagagauguucaaaaagagaaaccugacuaucauggaucuccauccaggaucuggcaaaaccaggaaguauuugcccgcuauaguccgugaagccauuaagcgccggcugagaacacucauccuggcuccuaccagggugguagcagccgagauggaggaagcccuuaaaggucugccgauccgauaccagacuacagcuaccaagagugagcacacggggcgggaaauuguggacuugaugugccaugcgacuuuuacaaugcgccuacugucccccguuagagucccaaauuauaaccucaucauaauggaugaggcacacuucaccgacccugccagcauugcugccaggggauacaucucuacccgggugggcaugggcgaagcagccgcuauuuuuaugacugcgacacccccagggaccgccgaugcauucccucagagcaaugcucccauccaggacgaggagcgagacauaccagaaagauccuggaacucaggaaaugaguggauuacagauuuugccgguaaaacugugugguucgucccgaguaucaaggcaggcaacgacaucgccaacuguuuacgcaaaaaugggaagaagguaauucaacugagcaggaaaacguuugauaccgaauaccagaagacaaaacuuaacgacugggauuucgugguuacuaccgacaucucugagaugggagcuaauuuuaaggccgaucgugugauugacccucggagaugccugaaacccgucauacucacagauggcccagagagggugaucuuggcgggucccaugccuguuaccgcagccuccgcugcccagcgccgagggagagugggccggaacccacagaaggaaaaugaccaauauauuuucacuggacagccccugaacaaugaugaggaccaugcucacuggacggaagcaaagaugcuccuggacaacaucaauaccccugagggcaucauuccggcccuuuucgaaccagagagggagaaaucagcugccauagauggggaauaccgccuaaagggagagagucguaaaacauuugucgaacugaugagacggggugacuugcccgugugguuagcacacaagguagcgagcgagggcaucaaauauacugauaggaaguggugcuucgacgggcagcgcaacaaucagauucuggaagagaacauggauguggagaucuggaccaaagaaggagagaagaagaaacuccgaccuagauggcuggacgcccggacauacuccgauccccuugcucugaaggaauuuaaagaguucgccgcaggcaggaagucuauugcucucgacuugguuaccgaaaucggucgcgucccaucgcaucuggcccacagaacuaggaaugcacuagauaaccuggugaugcuccauacaagcgagcacgggggccgggccuaucgucacgcuguggaggaacuuccugagacgauggaaacccuguuauugcugggacucaugauacugcuuacuggcggggcgaugcuguuucucaucucaggaaaagguauuggcaagacauccaucggguugauuugugucaucgccaguucuggaaugcuguggauggcagagauacccuuacaauggauugcuagcgccaucguucuagaguucuuuaugauggugcugcucauuccagaaccugagaagcagcgcaccccgcaggacaaucaacuugccuacguagugaucggcauacugaccuuggcagcuaucauugccgcgaacgaaaugggucugcucgagacaacuaaacgagaucuggggauguccaaggaacccggcgucgugucaccaacgucuuaucuugacguugaucuccauccugcuagcgccuggacccuguacgcaguggccacaacugucaucacccccauguugagacacacaauugagaauaguaccgcuaacguaucccuggcagccaucgcgaaccaggcugugguuuuaaugggacuagacaaaggcuggccaauaagcaagauggaccugggggugccucuccuugcccugggaugcuacucucaggucaaucccuugacucugacggcagccgugcuccugcuuauuacacauuaugcuaucaucggcccggguuuacaggccaaagcaaccagggaggcucaaaagcggacugccgcggggauuaugaagaacccaaccgucgauggaaucaugacaauagaccuggauccugugauuuacgacucaaaauucgaaaagcagcucggccagguuauguugcuggugcuaugugccguacagcugcuccuuaugcgcacuuccugggcacugugcgaggcuuugacccuggccacaggucccaucacgacccucugggaaggcaguccagggaaauuuuggaauacuacaauugcagugagcauggcuaacaucuucagaggaucguaucuggccggcgccggguuagcguuuucuauaaugaaguccgucggaaccggcaaaagggguacugggagccaaggagagacacuuggcgaaaaguggaagaaaaagcugaaucagcucucacggaaagauuucgaccuauacaagaaaagugguaucaccgagguugaucgaacggaggcuaaggaaggccugaaaagaggggagauuacccaccaugcagugucucgcggauccgccaaguugcagugguuugucgaaaggaacauggugauccccgagggccggguaauugaccugggguguggacguggcgguuggagcuauuacugcgcugggcucaagaaagugacagaaguuagaggauauacuaagggcggcccugggcacgaggagccggugcccaugucaaccuacggauggaauaucgucaaacuuaugagugguaaggauguguucuaccugccaccugaaaaaugugacacauugcugugcgauauuggcgagagcucccccucuccuacugucgaagagagcaggaccauccgcgugcucaagaugguugagccaugguuaaagaacaaucaguucuguauaaaaguacugaaccccuauaugccuacagugauugaacaccuugagcggcugcaacgaaagcaugggggaaugcuagucagaaauccacucuccaggaacucaacccacgaaauguacuggaucucuaauggcacugguaacaucguggccaguguuaauauggugucgcgccuguugcugaaccgguuuacgaugacacauagacgucccaccauugagaaagacgucgaucucggggcaggaacuaggcacgugaacgccgaaccggagaccccuaauauggagguaauaggcgaacggaucaagcgcauuaaagaggaacacaacagcacauggcauuaugacgacgagaauccauacaagacgugggcuuaucacggcuccuacgaagugaaggcgaccgggucugccucaagcaugaucaacggaguugucaaacuucugacuaagcccugggauguggugccuauggucacacagauggcaaugaccgacacuacaccauucggucagcaacgaguuuuuaaagagaagguggauaccagaacacccagguccaugccgggcacucggcgcguaauggggauuaccgcugagugguuauggagaacgcugggaaggaauaaaaagccucgauugugcacccgggaagaguucacaaagaaagugcguacuaacgccgcaaugggcgccgucuuuaccgaagagaaucagugggacagugcuaaggccgcgguggaagaugaggacuucuggaaacucguugauagagagcgcgaacugcauaagcuagguaaaugugggucuugcguguauaacaugaugggaaagagggagaagaaacuuggcgaauuuggcaaagcaaaagggagccgggccaucugguacauguggcugggagcuagauaccucgaguucgaggcccugggauuuuugaaugaagaccacugguucucacgcgagaacuccuauaguggcgucgaaggggagggacugcauaagcucggcuacauacuuagggauaucagcaaaauucccgguggggcaauguaugcugacgauacagccggaugggacacucgaaucaccgaagacgaucugcacaaugaggagaagauuacgcagcagauggacccagaacaccggcaauuagcugaugccaucuuuaaacugacauaccagaacaaggugguaaagguucagagaccuacccccacuggcacagugauggacauaauuucuaggaaagaucagcgcggcuccgggcaagucggaaccuaugguuugaauacuuucaccaacauggaggcacagcucauccgucagauggaaggcgagggggugcugucaaaggcggaccuagaaaauccacaucuucccgagaaaaagaucacacaguggcuggagacgaaaggaguggaacggcucaagagaauggccauuagcggcgaugacugcgucguuaagccuauagaugacagguuugcuaacgcccuguuggcauuaaacgauauggguaaagugcgcaaggacaucccacaauggcagccgucgaaaggguggcacgauuggcagcagguacccuucuguucucaucacuuccacgagcugauuaugaaggacggacgaaaacucguggucccuugccggccacaagacgaacuuaucggcagagcuaggauuagucagggcgccggguggucccugaaggagaccgcaugucuaggaaaggccuacgcgcagauguggagccugauguauuuucaucgcagagaucuccgguuggcuucaaaugccaucugcuccgcagugcccguucacugggugccuacuucuaggacaaccuggagcauacaugcccaccaucaauggaugacuacagaagacaugcugaccgucuggaaccguguguggaucgaggauaauccauggauggaggacaaaacgcccguaacaaccugggaaaacguuccuuaccuugguaagcgagaggaucagugguguggcagucugauugggcucacuucccgcgcuaccugggcccagaauaucccgacagcaauucagcaagugaggagcuuaaucggaaacgaagaguuccuggacuacaugccaucuaugaaacgguuuaggaaggaggaagagucagaaggcgcuauuugguga

SEQ ID NO: 15327 - RNA, 9873 nt, Artificial Sequence
  derived and/or modified CDS sequence (opt3) from DENV-3__JF937636__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauaugggggaagauggauguugguacggcauggagauaaggccaauuuccgaaaaggaggagaauaugguuaaaucacuggugagcgccgguucuggcaagguagacaacuucaccauggggaucuugugccucgcuauccuguuugaagaggugaugcgcggaaaguucggcaaaaagcacaugauugccggggucuucuuuacguucgugcuacugcucuccggacagaucacuuggcgggauauggcacauacccugauuaugauaggcaguaaugcuagcgacagaauggguauggggguuacauaucuugccuugaucgcaaccuuuaaaauucagcccuuccuggccuuaggauuuuuccucaggaagcugacuucucgcgaaaaccuucugcuaggcgugggccucgcuauggcgacaacccugcaauugccggaggauaucgaacagauggccaaugggauugcacugggauuaauggcucucaaacugaucacacaguuugagacuuaccagcuuuggaccgcccugauauccuugacguguucaaacacaaucuucacccucacugucgccuggcgaaccgcuacacugauucuagcaggugugagucugcuuccuguuugccaaagcucguccaugcggaagacugacuggcucccaauggccguggcggcuaugggcguccccccucugcccuuguuuaucuucucucugaaggauaccuuaaaacguagaagcuggccacucaaugaggggguaauggccgugggacugguuucaauucuugcaaguucccuguugaggaacgacgugccuauggccggcccccucgucgcuggugggcugcuaaucgcauguuaugugauaacgggaacaucugccgaucugaccguagaaaaggcggcugacauuacuugggaggaagaggccgaacagacaggcgugagccacaaccuuaugaucaccgucgacgaugacggcacuaugcgcaucaaagaugacgagacagagaauauucucaccguucuguugaagacggcauuacugauaguguccgggaucuuuccauacucaauuccggccacucuccugguguggcauaccuggcagaaacagacacaacggagcggaguccuuugggaugugccuagucccccagaaacccagaaggcugagcuggaagaggguguuuacagaaucaaacagcagggcauuuucgggaagacacaaguaggagugggcguccagaaggaggguguguuucacacuauguggcacguuaccaggggggccguguugacguauaacggaaaacgacuagaacccaauugggcaucugucaagaaagaccugaucuccuacggcggcggguggcgccucagcgcucaguggcaaaagggagaggaagugcagguaauagccgucgagccugguaaaaacccaaagaauuuccagacaaugcccggcacuuuccagaccacaaccggggaaaucggagcgauugcccuggauuuuaagccuggcacuucggguucaccgaucauuaaccgggaggggaaagugguuggacuuuauggcaauggcguggucaccaagaacgggggauacgugucugguaucgcacaaacaaaugcugagccagacggccccacgccugaauuagaggaagagauguucaaaaagagaaaccugacuauaauggaucuccauccagggaguggaaaaaccaggaaguauuugcccgccauuguucgugaagcuauccgccggagacugaggacacucauccuggcaccuacccgaguggucgccgccgagauggaggaagcucuuaagggccugccgauucgguaccagacuacagcgaccaaauccgagcacacgggucgcgaaaucguggacuugaugugccaugcaacuuuuacaaugagacuacugagccccguaagggugccaaauuauaaccucauaauuauggaugaggcccacuucaccgacccugcuucuaucgccgcacggggguacauuagcacccgaguuggaaugggcgaagccgcugcgaucuuuaugacugccacacccccaggcaccgcagaugcuuucccucaguccaaugcccccauacaggacgaggagagagacauuccagaacgcucauggaacagugggaaugaguggaucacagauuuugcaggaaagacugucugguucgugccgagcaucaaagccgguaacgacauugcuaacuguuuaaggaagaauggcaaaaaggugauccaacugucucguaagacguuugauaccgaauaccagaaaacaaagcuuaacgacugggauuucgucguaacuaccgacauuuccgagaugggggccaauuuuaaagcggaucgggugauagacccuagaaggugccugaagcccguuauccucacagauggaccagagcgcgugauuuuggcaggccccaugccugucaccgccgcuucagccgcucagcgaagaggucggguggggaggaacccacagaaagaaaaugaccaauauaucuucacuggccagccccugaacaaugaugaggaccaugcacacuggacggaagccaagaugcuccuggacaacaucaauaccccugagggaauuauaccggcucuuuucgaaccagagcgcgagaagagugccgcaaucgauggcgaauaccgucuaaaaggggagagcagaaagacauuuguugaacugaugcggaggggagacuugcccgugugguuagcgcacaaagucgccuccgaggguauuaaguauacugaucgcaaauggugcuucgacggccagcgaaacaaucagauccuggaagagaacauggauguggagauuuggaccaaggaaggggagaaaaagaagcucagaccucgguggcuggacgcuaggacauacucugauccccuugcccugaaagaauuuaaggaguucgcagcuggacgcaaaucgaucgcccucgacuugguaaccgaaauaggcagagugccaagccaucuggcacacaggacucggaaugcccuagauaaccugguuaugcuccauacaucagagcacggugggcgugcuuaucgccacgcggucgaggaacuuccugagacgauggaaacccuguuauugcugggccucaugauccugcuuacuggaggcgccaugcuguuucucauuuccgggaagggaaucgguaaaacaaguauuggcuugaucugugugauagcaucuagcgggaugcuguggauggcugagauucccuuacaauggaucgccuccgccauugugcuagaguucuuuaugaugguccugcucaucccagaaccugagaagcagcgaaccccgcaggacaaucaacuugcauacguugugauaggaauccugaccuuggcugccauuaucgcggcuaacgaaaugggccugcucgagacaacuaagagagaucuggguaugucaaaagaacccgggguagugucuccaacgagcuaucuugacgucgaucuccauccugccagugcauggacccuguacgccguggcuacaacuguuauuacccccauguugaggcacacaaucgagaauuccaccgcaaacgugagccuggccgcgauagcuaaccaggccgucguauuaaugggccuagacaagggauggccaauuucuaaaauggaccugggcgugccucuccuugcacuggggugcuacucacagguuaaucccuugacucugacggccgcugugcuccugcuuaucacacauuaugccaucauuggaccgggcuuacaggcaaaggcuacccgggaggcccaaaaacgcacugcggccgguaucaugaagaacccaaccgucgaugggauaaugacaauugaccuggauccugugaucuacgacuccaaguucgaaaaacagcucggacaggucauguugcuggugcuaugugcaguucagcugcuccuuaugagaacuaguugggcucugugcgaggccuugacccuggcaacaggccccauuacgacccucugggaagguagcccaggcaaguuuuggaauacuacaaucgcugugucgauggccaacauauucagggggucuuaucuggccggagcgggcuuagcuuuuuccaucaugaaaagcguagggaccggaaagcggggcacugguucacaaggggagacacuuggagaaaaauggaagaagaaacugaaucagcucagucgaaaggauuucgaccuauacaaaaagucuggcauuaccgagguggauagaacggaggcaaaagaaggucugaagcgcggcgagaucacccaccaugccgucuccagggggagcgcuaaauugcagugguuuguugaacggaacauggugauucccgagggacgugucaucgaccugggcugugggagaggaggcuggucauauuacugcgccggucucaagaaggugacagaaguaaggggguauacuaaaggaggcccuggccacgaggagccggugcccaugaguaccuacggguggaauauuguuaagcuuaugagcggaaaagauguguucuaccugccaccugaaaagugugacacauugcugugcgauaucggugaguccucucccagcccuacugucgaagagucccgcaccauacgggugcucaaaauggucgagccaugguuaaagaacaaucaguucuguauuaaggugcugaaccccuauaugccuacaguuaucgaacaccuugagcgacugcaaagaaaacauggcgggaugcuaguaaggaauccacucucacgcaacucuacccacgaaauguacuggaucaguaauggaacuggcaacauuguggcaucggucaauauggugagccggcuguugcugaacagauuuacgaugacacaucguaggcccaccauagagaaggacguugaucucggugccgggacucggcacgugaacgcugaaccggagaccccuaauauggacgucaucggagagcgcauuaaacgaaucaaggaagagcacaacuccacauggcauuaugacgaugaaaauccauacaaaacgugggcguaucacggcucuuacgaggugaaggccaccggcucagcaagcuccaugauuaacgggguagugaagcuucugacuaaacccugggacguugucccuauggugacacagauggcuaugaccgauacuacaccauucggacagcaaagaguguuuaaggaaaaagucgacaccaggacaccccggaguaugccggguacucgcagaguuaugggcaucaccgccgagugguuauggaggacgcuggggcgaaauaagaaaccucgguugugcacccgugaggaauucacaaagaaggugagaacuaacgcagccaugggagcuguauuuaccgaggaaaaucagugggauucugccaaagcggcaguggaggacgaagauuucuggaagcucgucgaccgcgagagggagcugcauaaacuaggcaagugugguagcugcguguauaacaugauggggaaacgggaaaagaaacuuggagaguuuggcaaggccaagggcucaagagcuauaugguacauguggcugggggcccgcuaccucgaauucgaggcacugggauuuuugaaugaggaucacugguucuccagggaaaacaguuauagcgguguugagggcgaagggcugcauaaacucggauacauccuucgagacauuucuaagauccccggcggugcuauguaugccgaugacacagcugggugggacacucggauuaccgaggaugaccugcacaaugaagagaaaaucacgcagcagauggauccagagcacagacaauuagccaacgcaauauuuaagcugacauaccagaauaaaguggucaaggugcagaggccuacccccacuggaacaguaauggacauuaucucccgcaaggaucagcguggcucaggccaaguugggaccuauggauugaacacuuucaccaauauggaagcgcagcucauccggcagauggagggugaaggcgugcugagcaaagccgaccuagagaacccacaucuucccgaaaagaaaauuacacaguggcuggagacgaagggggucgagagacucaaaaggauggcuauaucgggagaugacugcguggugaagccuaucgaugaccgcuuugccaacgcacuguuggcuuuaaaugauaugggcaagguccgaaaagacauuccacaauggcagccgucuaaggguuggcacgauuggcagcagguucccuucuguagucaucacuuccacgaacugaucaugaaagacgggcggaagcucgugguaccuugcagaccacaagacgagcuuauuggaagggcccgcaucucccagggcgcaggcuggagccugaaagaaaccgccugucuagggaaggcguacgcucagauguggucacugauguauuuucauagacgggaucucagguuggccuccaacgcaauaugcucugccgugcccguccacugggugccuacuagccguacaaccuggaguauccaugcucaccaucaauggaugacuacagaggacaugcugaccguuuggaaucgaguguggauugaagauaacccauggauggaggacaagacgcccgucacaaccugggagaaugugccuuaccuuggaaaacgcgaagaucaguggugugguucccugaucggccucacuagcagagccaccugggcacagaacauuccgacagcuauccagcaaguacggucuuuaauugggaaugaggaauuccuggacuacaugccaucaaugaagagguuucgcaaagaggaggaaagugagggagccauaugguga

SEQ ID NO: 15328 - RNA, 9873 nt, Artificial Sequence
  derived and/or modified CDS sequence (opt3) from DENV-3__JF937626__SS-prME
accagccugugccucaugaugauccuucccgcagcucuggcauuccacuugacauccagagacggcgaaccuagaaugauuguggggaagaacgaacgggguaaaucuuuacuguuuaagacugccucagguauaaauauguguacgcuaaucgcgauggaucucggcgaaaugugcgacgauaccgucacauacaaauguccacauauuacugaaguugaaccggaagacaucgauugcugguguaaccugaccaguacaugggugaccuaugggacuugcaaucaggcuggagaacaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucaaaauucagggggaacaagcauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacuaagaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauaugggggaagauggauguugguacggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcacaugaucgccgggguguucuuuacguucguucuacugcucuccggacagauuacuuggcgggauauggcacauacccugaucaugauuggcaguaaugcuagcgacagaauggguaugggggugacauaucuugccuugauagcaaccuuuaaaauccagcccuuccuggccuuaggauuuuuccucaggaagcugacuucucgcgaaaaccuucugcuaggcgucggccucgcuauggcgacaacccugcaauugccggaggauauugaacagauggccaaugggaucgcacugggauuaauggcucucaaacugauuacacaguuugagacuuaccagcuuuggaccgcccugaucuccuugacguguucaaacacaauauucacccucacuguggccuggcgaaccgcuacacugauccuagccgguguuagucugcuuccugugugccaaagcucguccaugcggaagacugacuggcucccaauggccgucgcggcuaugggcguacccccucugcccuuguuuauuuucgggcugaaggauaccuuaaaacguagaucuuggccacucaaugagggagugauggccguuggccuggugagcauccuugcaucaagucuguugaggaacgacgucccuauggccgguccccucguggcugggggacugcuaauugcauguuauguaaucacgggcacauccgccgaucugaccguggaaaaggcggcugacaugacuugggaggaagaggccgaacagacaggcgucucucacaaccuuaugauaaccguugacgaugacgggacuaugcgcauuaaagaugacgagacagagaauauccucaccgugcuguugaagacggcauuacugaucgugagcggaauuuuuccauacuccauaccggccacucuccuggucuggcauaccuggcagaaacagacacaacggucaggugugcuuugggauguuccuagucccccagaaacccagaaggcugagcuggaagagggcguauacagaaucaaacagcaggggauuuucggaaagacacaagugggcgucggugugcagaaggaggggguuuuucacacuauguggcacgugaccaggggagccgucuugacguauaacggcaaacgacuagaacccaauugggcaagugugaagaaagaccugaucucuuacggcgggggauggcgccucuccgcucaguggcaaaagggugaggaaguacaggucauugccguggagccuggcaaaaacccaaagaauuuccagacaaugcccgggacuuuccagaccacaaccggagaaaucggcgcgauagcccuggauuuuaagccugguacuagcgggucgccgaucauuaaccgggagggaaaaguugugggccuuuauggcaauggggucgugaccaagaacggagguuacguuucaggcaucgcacaaacaaaugcugagccagacgggcccacgccugaauuagaggaagagauguucaaaaagagaaaccugacuauuauggaucuccauccaggaucuggcaaaaccaggaaguauuugcccgccaucgugcgugaagcuauaaagcgccggcugagaacacucauucuggcaccuaccagggucguggccgccgagauggaggaagcucuuaaaggucugccgauccgauaccagacuacagcgaccaagagugagcacacggggcgggaaaucguagacuugaugugccaugcaacuuuuacaaugcgccuacugucccccgugagaguuccaaauuauaaccucauuaucauggaugaggcccacuucaccgacccugcuagcauagccgcaaggggauacauuucuacccgggucggcaugggcgaagccgcugcgaucuuuaugacugccacacccccagggaccgcagaugcuuucccucagagcaaugcccccauucaggacgaggagcgagacaucccagaaagauccuggaacucaggaaaugaguggauaacagauuuugcagguaaaacugugugguucgugccgaguauuaaggccggcaacgacaucgcuaacuguuuacgcaaaaaugggaagaaggucauccaacugagcaggaaaacguuugauaccgaauaccagaagacaaaacuuaacgacugggauuucguagugacuaccgacauuucugagaugggagccaauuuuaaggcggaucguguuaucgacccucggagaugccugaaacccgugauucucacagauggcccagagagggucauauuggcaggucccaugccugugaccgccgcuuccgccgcucagcgccgagggagaguuggccggaacccacagaaggaaaaugaccaauauaucuucacuggacagccccugaacaaugaugaggaccaugcacacuggacggaagccaagaugcuccuggacaacauuaauaccccugagggcaucaucccggcucuuuucgaaccagagagggagaaaucagccgcaauugauggggaauaccgccuaaagggagagagucguaaaacauuuguggaacugaugagacggggugacuugcccgucugguuagcgcacaagguggccagcgagggcauaaaauauacugauaggaaguggugcuucgacgggcagcgcaacaaucagauccuggaagagaacauggauguagagauuuggaccaaagaaggagagaagaagaaacuccgaccuagauggcuggacgcucggacauacuccgauccccuugcccugaaggaauuuaaagaguucgcagcuggcaggaagucuaucgcccucgacuuggugaccgaaauuggucgcguuccaucgcaucuggcacacagaacuaggaaugcccuagauaaccuggucaugcuccauacaagcgagcacgggggccgggcuuaucgucacgcgguggaggaacuuccugagacgauggaaacccuguuauugcugggacucaugauccugcuuacuggcggggccaugcuguuucucauaucaggaaaagguaucggcaagacauccauuggguugaucugugugauugcaaguucuggaaugcuguggauggcugagauccccuuacaauggauagccagcgccauuguccuagaguucuuuaugaugguucugcucaucccagaaccugagaagcagcgcaccccgcaggacaaucaacuugcauacgugguaauuggcauccugaccuuggcugccauaaucgcggcuaacgaaaugggucugcucgagacaacuaaacgagaucuggggauguccaaggaacccggcguggucucaccaacgucuuaucuugacguggaucuccauccugccagcgcauggacccuguacgccguugcuacaacugugauuacccccauguugagacacacaaucgagaauaguaccgcaaacgucucccuggccgcgauugcuaaccaggccguaguguuaaugggacuagacaaaggcuggccaaucagcaagauggaccuggggguuccucuccuugcacugggaugcuacucucaggugaaucccuugacucugacggccgcuguccuccugcuuauaacacauuaugccauuaucggcccggguuuacaggcaaaagcuaccagggaggcccaaaagcggacugcggccgggaucaugaagaacccaaccguggauggaauuaugacaaucgaccuggauccugucauauacgacucaaaauucgaaaagcagcucggccaggugauguugcugguucuaugugcagugcagcugcuccuuaugcgcacuuccugggcucugugcgaggccuugacccuggcaacaggucccauuacgacccucugggaaggcaguccagggaaauuuuggaauacuacaaucgcuguaagcauggccaacauuuucagaggaucguaucuggccggcgcgggguuagcuuuuucuaucaugaaguccgugggaaccggcaaaagggguacugggagccaaggagagacacuuggcgaaaaguggaagaaaaagcugaaucagcucucacggaaagauuucgaccuauacaagaaaagugguauaaccgaggucgaucgaacggaggcaaaggaaggccugaaaagaggggagaucacccaccaugccguuucucgcggauccgcuaaguugcagugguuuguggaaaggaacauggucgugcccgagggccggguaauugaccugggguguggacguggcgguuggagcuauuacugcgccgggcucaagaaagugacagaaguuagaggauauacuaagggcggcccugggcacgaggagccggugcccaugucaaccuacggauggaauaucgucaaacuuaugagugguaaggauguguucuaccugccaccugaaaaaugugacacauugcugugcgauauuggcgagagcucccccucuccuacugucgaagagagcaggaccauccgcgugcucaagaugguugagccaugguuaaagaacaaucaguucuguauuaaaguacugaaccccuauaugccuacagugaucgaacaccuugagcggcugcaacgaaagcaugggggaaugcuagucagaaauccacucuccaggaacucaacccacgaaauguacuggauaucuaauggcacugguaacauuguggcaaguguuaauauggugucgcgccuguugcugaaccgguuuacgaugacacauagacgucccaccaucgagaaagacgucgaucucggggccggaacuaggcacgugaacgcugaaccggagaccccuaauauggacguaaucggcgagcggauuaagcgcauaaaagaagaacacaacagcacauggcauuaugacgaugaaaauccauacaagacgugggcguaucacggcuccuacgaggugaaggccaccgggucugcaucaagcaugaucaacggaguugucaaacuucugacuaagcccugggacguggugccuauggucacacagauggcuaugaccgauacuacaccauucggucagcaacgaguuuuuaaagaaaagguggacaccagaacacccagguccaugccgggcacucggcgcguaauggggauuaccgccgagugguuauggagaacgcugggaaggaauaaaaagccucgauugugcacccgggaggaguucacaaagaaagugcguacuaacgcagccaugggcgcugucuuuaccgaggaaaaucagugggauagugccaaggcggcaguggaggacgaagauuucuggaaacucguugacagagagcgcgagcugcauaagcuagguaaaugugggucuugcguguauaacaugaugggaaagagggagaagaaacuuggcgaguuuggcaaagccaaagggagccgggcuaucugguacauguggcugggagccagauaccucgaguucgaggcacugggauuuuugaaugaggaucacugguucucacgcgaaaacuccuauaguggcgucgagggggaaggacugcauaagcucggcuacauucuuagggacaucagcaaaauacccgguggggcuauguaugccgaugacacagcuggaugggacacucgaaucaccgaggaugaccugcacaaugaagagaagauuacgcagcagauggauccagagcaccggcaauuagccaacgcaaucuuuaaacugacauaccagaauaaggugguaaagguucagagaccuacccccacuggcacagugauggacauuaucucuaggaaagaucagcgcggcuccgggcaagucggaaccuaugguuugaacacuuucaccaauauggaagcgcagcucauacgucagauggagggcgaaggggugcugucaaaggccgaccuagagaacccacaucuucccgagaaaaagauuacacaguggcuggagacgaaaggaguggagcggcucaagagaauggcuaucagcggcgaugacugcgucguuaagccuaucgaugacagguuugccaacgcacuguuggcuuuaaaugauauggguaaagugcgcaaggacauuccacaauggcagccgucgaaaggguggcacgauuggcagcagguacccuucuguucucaucacuuccacgaacugauaaugaaggacggacgaaaacucguggucccuugccggccacaagacgagcuuaucggcagagccaggauuagucagggcgcaggguggucccugaaggaaaccgccugucuaggaaaggcguacgcucagauguggagccugauguauuuucaucgcagagaucuccgguuggccucaaacgcaaucugcuccgccgugcccguucacugggugccuacuucuaggacaaccuggagcauucaugcucaccaucaauggaugacuacagaggacaugcugaccgucuggaaucguguguggaucgaagauaacccauggauggaggacaaaacgcccguaacaaccugggagaauguuccuuaccuugguaagcgagaagaucagugguguggcagucugauagggcucacuucccgcgccaccugggcacagaacaucccgacagcuauucagcaagugaggagcuuaaucggaaaugaggaguuccuggacuacaugccaucuaugaaacgguuuaggaaggaggaggaaucagagggcgccauuugguga

SEQ ID NO: 15329 - RNA, 9873 nt, Artificial Sequence
  derived and/or modified CDS sequence (opt3) from DENV-3__JF937621__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauaugggggaagauggauguugguacggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcacaugaucgccgggguguucuuuacguucguucuacugcucuccggacagauuacuuggcgggauauggcacauacccugaucaugauuggcaguaaugcuagcgacagaauggguaugggggugacauaucuugccuugauagcaaccuuuaaaauccagcccuuccuggccuuaggauuuuuccucaggaagcugacuucucgcgaaaaccuucugcuaggcgucggccucgcuauggcgacaacccugcaauugccggaggauauugaacagauggccaaugggaucgcacugggauuaauggcucucaaacugauuacacaguuugagacuuaccagcuuuggaccgcccugaucuccuugacguguucaaacacaauauucacccucacuguggccuggcgaaccgcuacacugauccuagcagguguuagucugcuuccugugugccaaagcucguccaugcggaagacugacuggcucccaauggccgucgcggcuaugggcguacccccucugcccuuguuuauuuucgggcugaaggauaccuuaaaacguagaucuuggccacucaaugagggagugauggccguuggccuggugagcauccuugcaucaagucuguugaggaacgacgucccuauggccgguccccucguggcugggggacugcuaauugcauguuauguaaucacgggcacauccgccgaucugaccguggaacgcgcggcugacauaacuugggaggaagaggccgaacagacaggcgucucucacaaccuuaugauuaccguugacgaugacgggacuaugcggaucaaggaugacgagacagagaauauccucaccgugcuguugaaaacggcauuacugauugugagcggaauauuuccauacuccaucccggccacucuccuggucuggcauaccuggcagaagcagacacaaagaucaggugugcuuugggauguuccuagccccccagaaacccagaaagcugagcuggaagagggcguauacaggauuaagcagcaggggaucuucggaaaaacacaagugggcgucggugugcagaaggaggggguuuuucacacuauguggcacgugacccgaggagccgucuugacguauaacggcaagcgccuagaacccaauugggcaagugugaaaaaggaccugauuucuuacggcgggggauggcggcucuccgcucaguggcaaaaaggugaggaaguacaggucaucgccguggagccuggcaagaacccaaaaaauuuccagacaaugcccgggacuuuccagaccacaaccggagaaauaggcgcgaucgcccuggauuuuaagccugguacuagcgggucgccgauuaucaacagagagggaaagguugugggccuuuauggcaauggggucgugaccaaaaacggagguuacguuucaggcauugcacaaacaaaugcugagccagacgggcccacgccugaauuagaggaagagauguucaagaaaaggaaccugacuaucauggaucuccauccaggaucuggcaagacccguaaauauuugcccgccauagugcgcgaagcuauuaagcggagacugaggacacucauccuggcaccuacccgagucguggccgccgagauggaggaagcucuuaagggucugccgauccgguaccagacuacagcgaccaaaagugagcacacggggcgcgaaauuguagacuugaugugccaugcaacuuuuacaaugagacuacugucccccgugaggguuccaaauuauaaccucaucauaauggaugaggcccacuucaccgacccugcuagcauugccgcacggggauacaucucuacccgagucggcaugggcgaagccgcugcgauuuuuaugacugccacacccccagggaccgcagaugcuuucccucagagcaaugcccccauccaggacgaggagagagacauaccagaacgcuccuggaacucaggaaaugaguggauuacagauuuugcagguaagacugugugguucgugccgaguaucaaagccggcaacgacaucgcuaacuguuuaaggaagaaugggaaaaaggucauucaacugagccguaagacguuugauaccgaauaccagaaaacaaagcuuaacgacugggauuucguagugacuaccgacaucucugagaugggagccaauuuuaaagcggaucggguuauugacccuagaaggugccugaagcccgugauacucacagauggcccagagcgcgucaucuuggcaggucccaugccugugaccgccgcuuccgccgcucagcgaagagggcggguuggcaggaacccacagaaagaaaaugaccaauauauuuucacuggacagccccugaacaaugaugaggaccaugcacacuggacggaagccaagaugcuccuggacaacaucaauaccccugagggcaucauuccggcucuuuucgaaccagagcgcgagaagucagccgcaauagauggggaauaccgucuaaaaggagagaguagaaagacauuuguggaacugaugcggaggggugacuugcccgucugguuagcgcacaaaguggccagcgagggcaucaaguauacugaucgcaaauggugcuucgacgggcagcgaaacaaucagauucuggaagagaacauggauguagagaucuggaccaaggaaggagagaaaaagaagcucagaccucgguggcuggacgcuaggacauacuccgauccccuugcccugaaagaauuuaaggaguucgcagcuggccgcaaaucuauugcccucgacuuggugaccgaaaucgguagaguuccaucgcaucuggcacacaggacucggaaugcccuagauaaccuggucaugcuccauacaagcgagcacgggggccgugcuuaucgccacgcgguggaggaacuuccugagacgauggaaacccuguuauugcugggacucaugauacugcuuacuggcggggccaugcuguuucucaucucaggaaaggguauuggcaaaacauccaucggguugauuugugugaucgcaaguucuggaaugcuguggauggcugagauacccuuacaauggauugccagcgccaucguccuagaguucuuuaugaugguucugcucauuccagaaccugagaagcagcgaaccccgcaggacaaucaacuugcauacgugguaaucggcauacugaccuuggcugccaucauugcggcuaacgaaaugggucugcucgagacaacuaagagagaucuggggauguccaaagaacccggcguggucucaccaacgucuuaucuugacguggaucuccauccugccagcgcauggacccuguacgccguugcuacaacugugaucacccccauguugaggcacacaauugagaauaguaccgcaaacgucucccuggccgcgaucgcuaaccaggccguaguguuaaugggacuagacaagggcuggccaauaagcaaaauggaccuggggguuccucuccuugcacugggaugcuacucucaggugaaucccuugacucugacggccgcuguccuccugcuuauuacacauuaugccaucaucggcccggguuuacaggcaaaggcuacccgggaggcccaaaaacgcacugcggccgggauuaugaagaacccaaccguggauggaaucaugacaauagaccuggauccugucauuuacgacucaaaguucgaaaaacagcucggccaggugauguugcugguucuaugugcagugcagcugcuccuuaugagaacuuccugggcucugugcgaggccuugacccuggcaacaggucccaucacgacccucugggaaggcaguccagggaaguuuuggaauacuacaauugcuguaagcauggccaacaucuucaggggaucguaucuggccggcgcgggguuagcuuuuucuauaaugaaauccgugggaaccggcaagcgggguacugggagccaaggagagacacuuggcgaaaaauggaagaagaaacugaaucagcucucacgaaaggauuucgaccuauacaaaaagagugguaucaccgaggucgauagaacggaggcaaaagaaggccugaagcgcggggagauuacccaccaugccguuucuaggggauccgcuaaauugcagugguuuguggaacggaacauggucauccccgagggccgugugauugaccugggguguggaagaggcgguuggagcuauuacugcgccgggcucaagaagguaacagaagugaggggauauacuaaaggcggcccugggcacgaggagccgguucccaugucaaccuacggauggaauaucgugaagcuuaugagugguaaagaugucuucuaccugccaccugaaaagugugacacauugcugugcgauauuggcgagagcucccccucuccuacuguggaagagagccgcaccauccggguccucaaaaugguggagccaugguuaaagaacaaucaguucuguauaaagguucugaaccccuauaugccuacaguaauugaacaccuugagcgacugcaaagaaaacaugggggaaugcuagugaggaauccacucucccgcaacucaacccacgaaauguacuggaucucuaauggcacugguaacaucgucgcaagugugaauaugguuucgcggcuguugcugaacagauuuacgaugacacaucguaggcccaccauugagaaggacguggaucucggggccggaacucggcacgucaacgcugaaccggagaccccuaauauggacgugauaggcgagcgcaucaaacgaauuaaggaagagcacaacagcacauggcauuaugacgaugaaaauccauacaaaacgugggcguaucacggcuccuacgagguaaaggccaccgggucugcaucaagcaugaucaacggagugguuaagcuucugacuaaacccugggacgucgugccuauggugacacagauggcuaugaccgauacuacaccauucggucagcaaagagucuuuaaggaaaaaguugacaccaggacaccccgguccaugccgggcacucgcagagugauggggauuaccgccgagugguuauggaggacgcugggacgaaauaagaaaccucgguugugcacccgugaggaauucacaaagaagguaagaacuaacgcagccaugggcgcuguguuuaccgaggaaaaucagugggauagugccaaagcggcagucgaggacgaagauuucuggaagcucguggaccgcgagagggagcugcauaaacuagguaagugugggucuugcguuuauaacaugaugggaaaacgggaaaagaaacuuggcgaguuuggcaaggccaaggggagcagagcuaucugguacauguggcugggagcccgcuaccucgaauucgaggcacuggguuuuuugaaugaggaucacugguucucaagggaaaacuccuauaguggcguggagggggaaggacugcauaaacucggcuacauacuucgagacaucagcaagauucccgguggggcuauguaugccgaugacacagcuggaugggacacucggaucaccgaggaugaccugcacaaugaagagaaaauuacgcagcagauggauccagagcacagacaauuagccaacgcaaucuuuaagcugacauaccagaauaaagucgugaagguacagaggccuacccccacuggcacaguuauggacauaauuucucgcaaggaucagcguggcuccgggcaagugggaaccuaugguuugaacacuuucaccaauauggaagcgcagcucauccggcagauggagggcgaagggguccugucaaaagccgaccuagagaacccacaucuucccgaaaagaaaaucacacaguggcuggagacgaagggaguggagagacucaaaaggauggcuauuagcggcgaugacugcguggucaagccuauagaugaccgcuuugccaacgcacuguuggcuuuaaaugauauggguaagguucgaaaagacaucccacaauggcagccgucgaagggguggcacgauuggcagcaggugcccuucuguucucaucacuuccacgaacugauuaugaaagacggacggaagcucguagugccuugcagaccacaagacgagcuuaucggcagggcccgcauuagucagggcgcaggguggucccugaaagaaaccgccugucuaggaaaggcguacgcucagauguggagccugauguauuuucauagacgggaucucagguuggccucaaacgcaaucugcuccgccguccccgugcacuggguuccuacuucucguacaaccuggagcauacaugcucaccaucaauggaugacuacagaggacaugcugaccguguggaaucgagucuggaucgaagauaacccauggauggaggacaagacgcccgugacaaccugggagaauguaccuuaccuugguaaacgcgaagaucagugguguggcagucugauugggcucacuuccagagccaccugggcacagaacaucccgacagcuauucagcaaguucggagcuuaaucggaaaugaggaauuccuggacuacaugccaucuaugaagagguuucgcaaagaggaggaaucagagggcgccauuugguga

SEQ ID NO: 15330 - RNA, 9873 nt, Artificial Sequence
  derived and/or modified CDS sequence (opt3) from DENV-3__JF937623__SS-prME
gccagccugugccucaugaugauccuucccgcugcacuggccuuccacuugaccuccagagacggcgagccuaggaugauuguggggaagaacgaacggggaaaaucuuuacuguuuaagacagcgucagguauaaauauguguacucuaaucgcuauggaucucggcgagaugugcgacgauacggucaccuacaaauguccacauauuacagaaguugagccggaagacaucgauugcugguguaaccugacuaguaccugggugacauaugggaccugcaaucaggccggagagcaccgccgagacaagcguagcguagcacuugccccccaugugggcaugggucuggauacuagaacacaaaccuggauguccgcugagggggcauggaggcaggucgaaaaaguggagacgugggccuugcggcacccuggauucacuauucucgcucuguuucuggcccauuacaucggcaccucucucacacagaagguugugauauucaucuuacugaugcuugucacuccaucgaugaccaugcgcugugugggcguagggaacagagacuuuguugaaggauugucaggugcgacauggguggaugucgugcuggagcacggcgggugcgugaccacgauggcaaagaauaaacccacucuagacauugagcuccagaagacagaagccacccaacuggcuacucuuaggaaacuguguaucgagggaaagauuacaaacaucaccacggauagccggugcccuacccagggcgaagccacauugccagaggaacaggaccagaauuaugucuguaaacacacuuacguugaucgcgguugggggaacggaugcggccucuucggcaaggggagucuggugaccugcgcaaaguuucaauguuuagagcccauagagggaaaaguagugcaguaugaaaaucugaaguacacagucauuaucacugugcauaccggugaccagcaccagguuggcaacgagacacaaggggugaccgcugaaauuacuccucaggccuccacgacagaggcgauccucccagaauauggaacccuuggccuggagugcucuccgcgaacugguuuggacuucaaugagaugauccuacugaccaugaaaaacaaggccuggaugguccauagacagugguuuuucgaucucccccugccuuggacaagcggggcaaccacugaaacaccaacguggaauaggaaagagcuucuggugaccuuuaagaacgcucacgccaaaaagcaagaaguaguuguguugggcucccaggagggagcuaugcacacugcccucacaggcgcaaccgaaauucagaauucagggggaacaaguauauucgccggucaucugaagugucgguuaaaaauggacaagcuggagcuaaaaggcaugagcuacgcuaugugcacuaacaccuuuguccucaagaaagaggugucugaaacgcagcacgggaccauccugauuaaggucgaguacaagggagaagaugugcccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgcaggugcuugggagaauggcgucugugggauacgaagcaccacacgcauggaaaaccuccuguggaaacagaucgccaaugagcuuaacuauauuuugugggaaaauaacaucaagcugacgguuguggugggagacauuaucggcguacucgagcaggggaaaagaacccugacuccacagccuauggaguuaaaguacucauggaaaacauggggaaaggcgaagauagucaccgccgaaacacaaaacaguuccuucauuaucgauggccccaauacuccagagugccccagcgugucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaaccauaggcccggguaucacacacaaacugccggaccuuggcaccuuggcaaguuggagcuggacuuuaauuacugcgaggggaccacaguggugauuacggaaaacuguggaacccguggcccaaguuuacggacuacaaccgucucugguaaacucauccaugaguggugcugucgaagcugcacucugcccccucuuagauauaugggggaagauggauguugguacggcauggagauaaggccaauuuccgaaaaggaggagaauaugguuaaaucacuggugagcgcugguucuggcaagguagacaacuucacaauggggguguugugccucgccauccuguuugaagaggucaugcgcggaaaguucggcaaaaagcacaugaucgcagggauuuucuuuaccuucgugcuacugcucuccggacagaucacguggcgggauauggcucauacucugauuaugauaggcaguaaugccagcgacagaauggguauggggguuaccuaucuugcauugaucgccacauuuaaaauucagcccuuccuggcuuuaggauuuuuccucaggaagcugaccucucgcgaaaaccuucugcuaggcgugggccucgcgauggccacuacacugcaauugccggaggauaucgaacagauggcaaaugggauugcucugggauuaauggcccucaaacugaucacccaguuugagacauaccagcuuuggacugcccugauauccuugaccuguucaaacacgaucuucacacucaccgucgcuuggcgaacugcaacccugauucuagccggugugagucugcuuccuguuugccaaagcucguccaugcggaagacagacuggcucccaauggcgguggcugccaugggcguccccccucugcccuuguuuaucuucgggcugaaggauacuuuaaaacguagaucuuggccacucaaugagggaguaauggcagugggccugguuagcauucuugccucaagucuguugaggaacgacgugccuauggcugguccccucgucgcagggggacugcuaaucgccuguuaugugauaaccggcacguccgcggaucugacaguagaaaaggcugccgacaugaccugggaggaagaggcagaacagacuggcgugucucacaaccuuaugauuacagucgacgaugacgggaccaugcgcaucaaagaugacgagacugagaauauccucacaguucuguugaagaccgccuuacugauugugagcggaauauuuccauacuccaucccggcuacgcuccugguguggcauacuuggcagaaacagacccaacggucagguguccuuugggaugugccuagccccccagaaacacagaaggccgagcuggaagagggcauuuacagaaucaaacagcaggggauuuucggaaagacccaaguuggcguaggugugcagaaggagggggucuuucacacaauguggcacgugacuaggggagcaguuuugaccuauaacggcaaacgacuagaacccaauugggcuagugugaagaaagaccugaucucuuacggcgggggauggcgccucuccgcccaguggcaaaagggugaggaaguccaggugauagcgguagagccuggcaaaaacccaaagaauuuccagacgaugcccgggacauuccagacuaccacaggagaaaucggcgccauugcacuggauuuuaagccugguaccagcgggucgccgaucauuaaccgggagggaaaagucgugggccuuuauggcaaugggguugugacuaagaacggagguuacgucucaggcaucgcucaaaccaaugccgagccagacgggcccacaccugaauuagaggaagagauguucaaaaagagaaaccugacgauaauggaucuccauccaggaucuggcaaaacuaggaaguauuugcccgcuauugugcgugaagcaaucaagcgccggcugagaacccucauccuggccccuacaaggguuguggccgcugagauggaggaagcgcuuaaaggucugccgauucgauaccagaccacugcaacaaagagugagcacaccgggcgggaaaucgucgacuugaugugccaugccacguuuacuaugcgccuacugucccccgugagaguaccaaauuauaaccucauaauuauggaugaggcucacuucacagacccugccagcaucgcagccaggggauacauuucuacccgggugggcaugggcgaagcugcggccaucuuuaugaccgcaacucccccagggacagcugaugccuucccucagagcaaugcacccauacaggacgaggagcgagacauuccagaaagauccuggaacucaggaaaugaguggaucaccgauuuugccgguaaaacaguuugguucgucccgaguaucaaggcuggcaacgacauugccaacuguuuacgcaaaaaugggaagaaggugauccaacugagcaggaaaacuuuugauacggaauaccagaagaccaaacuuaacgacugggauuucguggucacaacugacauuucugagaugggagcgaauuuuaaggcagaucguguaauagacccucggagaugccugaaacccgugauccucaccgauggcccagagaggguuauuuuggccggucccaugccugugacagcugccuccgcugcacagcgccgagggagagucggccggaacccacagaaggaaaaugaccaauauaucuucaccggacagccccugaacaaugaugaggaccaugcccacuggacugaagcuaagaugcuccuggacaacaucaauacgccugagggcauuauaccggcccuuuucgaaccagagagggagaaaucagcagcgaucgauggggaauaccgccuaaagggagagagucguaaaaccuuuguggaacugaugagacggggugacuugcccguuugguuagcccacaagguggcuagcgagggcauuaaauauacagauaggaaguggugcuucgacgggcagcgcaacaaucagauccuggaagagaacauggaugucgagauuuggacuaaagaaggagagaagaagaaacuccgaccuagauggcuggacgcccggaccuacuccgauccccuugcacugaaggaauuuaaagaguucgcugccggcaggaagucuaucgcacucgacuuggugacagaaauaggucgcguaccaucgcaucuggcccacagaaccaggaaugcucuagauaaccuggugaugcuccauacuagcgagcacgggggccgggcguaucgucacgccguugaggaacuuccugagacaauggaaacgcuguuauugcugggacucaugauccugcuuaccggcggggcaaugcuguuucucauuucaggaaaagguaucggcaagacuuccauuggguugaucugugucauagcuaguucuggaaugcuguggauggccgagauucccuuacaauggaucgccagcgcaauugugcuagaguucuuuaugauggugcugcucaucccagaaccugagaagcagcgcacaccgcaggacaaucaacuugcuuacgucguuauaggcauccugaccuuggccgcgauuaucgcugccaacgaaaugggucugcucgagaccacaaaacgagaucuggggauguccaaggaacccggcgugguaucaccaacuucuuaucuugacguggaucuccauccugcaagcgccuggacgcuguacgcugucgcaaccacagugauuacucccauguugagacacaccaucgagaauaguacagccaacguuucccuggcggcuauagccaaccaggcaguggucuuaaugggacuagacaaaggcuggccaauuagcaagauggaccuggggguaccucuccuugcccugggaugcuacucucaggugaaucccuugacccugacugcugccguucuccugcuuaucacgcauuaugcaaucauuggcccggguuuacaggcuaaagccacaagggaggcgcaaaagcggaccgccgcagggaucaugaagaacccaacuguggauggaauaaugaccauugaccuggauccugucaucuacgacucaaaauucgaaaagcagcucggccaggugauguugcugguccuaugugcugugcagcugcuccuuaugcgcacauccugggcccugugcgaggcauugacucuggcuaccggucccauuacaacgcucugggaaggcaguccagggaaauuuuggaauaccacuaucgccguuagcauggccaacauauucagaggaucguaucuggcgggcgcuggguuagcauuuucuaucaugaaguccgugggaacaggcaaaagggguaccgggagccaaggagagacucuuggcgaaaaguggaagaaaaagcugaaucagcucucacggaaagauuucgaccuauacaagaaaagugguauuacagagguagaucgaaccgaggccaaggaaggccugaaaagaggggagaucacgcaccaugcugugucucgcggauccgccaaguugcagugguuugucgaaaggaacaugguuauucccgagggccgggugaucgaccugggguguggacguggcgguuggagcuauuacugcgcagggcucaagaaagucaccgaagugagaggauauacaaagggcggcccugggcacgaggagccgguacccaugucaacuuacggauggaauauugugaaacuuaugagugguaaggauguuuucuaccugccaccugaaaaaugugacaccuugcugugcgauaucggcgagagcucccccucuccuacaguggaagagagcaggacuauacgcguccucaagaugguggagccaugguuaaagaacaaucaguucuguauuaaaguccugaaccccuauaugccuaccgugaucgaacaccuugagcggcugcaacgaaagcaugggggaaugcuaguuagaaauccacucuccaggaacucaacacacgaaauguacuggaucucuaauggcaccgguaacauuguagccagugugaauauggucucgcgccuguugcugaaccgguuuacuaugacgcauagacgucccacaauagagaaagacguggaucucggggcuggaaccaggcacguuaacgcggaaccggagacuccuaauauggacgugaucggcgagcggauuaagcgcaucaaagaagagcacaacagcaccuggcauuaugacgaugaaaauccauacaagacaugggccuaucacggcuccuacgaggucaaggcaacggggucugcuucaagcaugauuaacggagugguaaaacuucugaccaagcccugggacgugguuccuauggucacucagauggccaugacagauaccacuccauucggucagcaacgaguguuuaaagaaaagguggacacaagaacccccagguccaugccgggcacacggcgcgucauggggaucacugcagagugguuauggagaacccugggaaggaauaaaaagccucgauugugcacgcgggaggaauucaccaagaaaguucguacaaacgccgcuaugggcgccguguuuacugaggaaaaucagugggauagugcgaaggcagccguagaggacgaagauuucuggaaacucguggacagagagcgcgagcugcauaagcuagguaaaugugggucuugcgucuauaacaugaugggaaagagggaaaaaaagcuuggcgaguuuggcaaggcuaaagggagccgggccauaugguacauguggcugggagcaagauaccucgaauucgaggcucuggguuuuuugaaugaggaucacugguucucacgcgaaaacuccuauaguggcguggagggggaaggacugcauaagcucggcuacauccuuagggacauuagcaaaauccccgguggggccauguaugcugaugacaccgccggaugggacacacgaauuacugaggaugaccugcacaaugaagagaagaucacccagcagauggauccagagcaccggcaauuagcaaacgcgauauuuaaacugacguaccagaauaagguugugaagguccagagaccuacacccaccggcacugugauggacauuaucucuaggaaagaucagcgcggcuccgggcaaguaggaacauaugguuugaacaccuucacuaauauggaagcccagcucauccgucagauggagggcgaagggguucugucaaaggcugaccuagagaacccacaucuucccgaaaaaaagauuacccaguggcuggagacaaaaggaguggagcggcucaagagaauggccauaagcggcgaugacugcgucgugaagccuaucgaugacagguuugcaaacgcucuguuggccuuaaaugauauggguaaagugcgcaaggacauuccacaauggcagccgucgaaaggguggcacgauuggcagcagguccccuucuguucucaucacuuccacgaacugaucaugaaggacggacgaaaacucguugugccuugccggccacaagacgagcuuauuggcagagcaaggaucagucagggcgccggguggucccugaaggaaacggcgugucuaggaaaggcuuacgcccagauguggagccugauguauuuucaucgcagagaucuccgguuggcaucaaacgccauaugcuccgcuguacccgugcacugggucccuaccucuaggacuacauggagcauccaugcccaccaucaauggaugaccacugaggacaugcugacaguguggaaucguguuuggauugaagauaacccauggauggaggacaaaacccccgugacgacaugggagaaugucccuuaccuugguaagcgagaagaucagugguguggcagucugaucgggcucaccucccgcgcaacuugggcucagaacauuccgaccgccauccagcaagugagaagcuuaauuggaaaugaggaauuccuggacuacaugccaucuaugaaacgguuuaggaaggaggaggaaucagagggcgcgauaugguga

SEQ ID NO: 15331 - RNA, 9873 nt, Artificial Sequence
  derived and/or modified CDS sequence (opt3) from DENV-3__JF937637__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacgcuuuuguccucaagaaagaggugucugaaacgcagcacgggaccauccugauuaaggucgaguacaagggagaagaugugcccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgcaggugcuugggagaauggcgucugugggauacgaagcaccacacgcauggaaaaccuccuguggaaacagaucgccaaugagcuuaacuauauuuugugggaaaauaacaucaagcugacgguuguggugggagacauuaucggcguacucgagcaggggaaaagaacccugacuccacagccuauggaguuaaaguacucauggaaaacauggggaaaggcgaagauagucaccgccgaaacacaaaacaguuccuucauuaucgauggccccaauacuccagagugccccagcgugucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaaccauaggcccggguaucacacacaaacugccggaccuuggcaccuuggcaaguuggagcuggacuuuaauuacugcgaggggaccacaguggugauuacggaaaacuguggaacccguggcccaaguuuacggacuacaaccgucucugguaaacucauccaugaguggugcugucgaagcugcacucugcccccucuuagauauaugggggaagauggauguugguacggcauggagauaaggccaauuuccgaaaaggaggagaauaugguuaaaucacuggugagcgcugguucuggcaagguagacaacuucacaauggggguguugugccucgccauccuguuugaagaggucaugcgcggaaaguucggcaaaaagcacaugaucgcagggguguucuuuaccuucguucuacugcucuccggacagauuacguggcgggauauggcucauacucugaucaugauuggcaguaaugccagcgacagaauggguaugggggugaccuaucuugcauugauagccacauuuaaaauccagcccuuccuggcuuuaggauuuuuccucaggaagcugaccucucgcgaaaaccuucugcuaggcgucggccucgcgauggccacuacacugcaauugccggaggauauugaacagauggcaaaugggaucgcucugggauuaauggcccucaaacugauuacccaguuugagacauaccagcuuuggacugcccugaucuccuugaccuguucaaacacgauauucacacucaccguggcuuggcgaacugcaacccugauccuagccgguguuagucugcuuccugugugccaaagcucguccaugcggaagacagacuggcucccaauggcggucgcugccaugggcguacccccucugcccuuguuuauuuucgggcugaaggauacuuuaaaacguagaucuuggccacucaaugagggagugauggcaguuggccuggugagcauccuugccucaagucuguugaggaacgacgucccuauggcugguccccucguggcagggggacugcuaauugccuguuauguaaucaccggcacguccgcggaucugacaguggaaaaggcugccgacauaaccugggaggaagaggcagaacagacuggcgucucucacaaccuuaugauuacaguugacgaugacgggaccaugcgcaucaaagaugacgagacugagaauauccucacagugcuguugaagaccgccuuacugauugugagcggaauauuuccauacuccaucccggcuacgcuccuggucuggcauacuuggcagaaacagacccaacggucaggugugcuuugggauguuccuagccccccagaaacacagaaggccgagcuggaagagggcguauacagaauuaaacagcaggggaucuucggaaagacccaagugggcgucggugugcagaaggaggggguuuuucacacaauguggcacgugacuaggggagcagucuugaccuauaacggcaaacgacuagaacccaauugggcuagugugaagaaagaccugauuucuuacggcgggggauggcgccucuccgcccaguggcaaaagggugaggaaguacaggucaucgcgguggagccuggcaaaaacccaaagaauuuccagacgaugcccgggacauuccagacuaccacaggagaaauaggcgccaucgcacuggauuuuaagccugguaccagcgggucgccgauuaucaaccgggagggaaaaguugugggccuuuauggcaauggggucgugacuaagaacggagguuacguuucaggcauugcucaaaccaaugccgagccagacgggcccacaccugaauuagaggaagagauguucaaaaagagaaaccugacgaucauggaucuccauccaggaucuggcaaaacuaggaaguauuugcccgcuauagugcgugaagcaauuaagcgccggcugagaacccucauccuggccccuacaagggucguggccgcugagauggaggaagcgcuuaaaggucugccgauccgauaccagaccacugcaacaaagagugagcacaccgggcgggaaauuguagacuugaugugccaugccacguuuacuaugcgccuacugucccccgugagaguuccaaauuauaaccucaucauaauggaugaggcucacuucacagacccugccagcauugcagccaggggauacaucucuacccgggucggcaugggcgaagcugcggccauuuuuaugaccgcaacucccccagggacagcugaugccuucccucagagcaaugcacccauccaggacgaggagcgagacauaccagaaagauccuggaacucaggaaaugaguggauuaccgauuuugccgguaaaacagugugguucgugccgaguaucaaggcuggcaacgacaucgccaacuguuuacgcaaaaaugggaagaaggucauucaacugagcaggaaaacuuuugauacggaauaccagaagaccaaacuuaacgacugggauuucguagugacaacugacaucucugagaugggagcgaauuuuaaggcagaucguguuauugacccucggagaugccugaaacccgugauacucaccgauggcccagagagggucaucuuggccggucccaugccugugacagcugccuccgcugcacagcgccgagggagaguuggccggaacccacagaaggaaaaugaccaauauauuuucaccggacagccccugaacaaugaugaggaccaugcccacuggacugaagcuaagaugcuccuggacaacaucaauacgccugagggcaucauuccggcccuuuucgaaccagagagggagaaaucagcagcgauagauggggaauaccgccuaaagggagagagucguaaaaccuuuguggaacugaugagacggggugacuugcccgucugguuagcccacaagguggcuagcgagggcaucaaauauacagauaggaaguggugcuucgacgggcagcgcaacaaucagauucuggaagagaacauggauguagagaucuggacuaaagaaggagagaagaagaaacuccgaccuagauggcuggacgcccggaccuacuccgauccccuugcacugaaggaauuuaaagaguucgcugccggcaggaagucuauugcacucgacuuggugacagaaaucggucgcguuccaucgcaucuggcccacagaaccaggaaugcucuagauaaccuggucaugcuccauacuagcgagcacgggggccgggcguaucgucacgccguggaggaacuuccugagacaauggaaacgcuguuauugcugggacucaugauacugcuuaccggcggggcaaugcuguuucucaucucaggaaaagguauuggcaagacuuccaucggguugauuugugugaucgcuaguucuggaaugcuguggauggccgagauacccuuacaauggauugccagcgcaaucguccuagaguucuuuaugaugguucugcucauuccagaaccugagaagcagcgcacaccgcaggacaaucaacuugcuuacgugguaaucggcauacugaccuuggccgcgaucauugcugccaacgaaaugggucugcucgagaccacaaaacgagaucuggggauguccaaggaacccggcguggucucaccaacuucuuaucuugacguggaucuccauccugcaagcgccuggacgcuguacgcuguugcaaccacagugaucacucccauguugagacacaccauugagaauaguacagccaacgucucccuggcggcuaucgccaaccaggcaguaguguuaaugggacuagacaaaggcuggccaauaagcaagauggaccuggggguuccucuccuugcccugggaugcuacucucaggugaaucccuugacccugacugcugccguccuccugcuuauuacgcauuaugcaaucaucggcccggguuuacaggcuaaagccacaagggaggcgcaaaagcggaccgccgcagggauuaugaagaacccaacuguggauggaaucaugaccauagaccuggauccugucauuuacgacucaaaauucgaaaagcagcucggccaggugauguugcugguucuaugugcugugcagcugcuccuuaugcgcacauccugggcccugugcgaggcauugacucuggcuaccggucccaucacaacgcucugggaaggcaguccagggaaauuuuggaauaccacuauugccguaagcauggccaacaucuucagaggaucguaucuggcgggcgcuggguuagcauuuucuauaaugaaguccgugggaacaggcaaaagggguaccgggagccaaggagagacucuuggcgaaaaguggaagaaaaagcugaaucagcucucacggaaagauuucgaccuauacaagaaaagugguaucacagaggucgaucgaaccgaggccaaggaaggccugaaaagaggggagauuacgcaccaugcuguuucucgcggauccgccaaguugcagugguuuguggaaaggaacauggucauccccgagggccgggugauugaccugggguguggacguggcgguuggagcuauuacugcgcagggcucaagaaaguaaccgaagugagaggauauacaaagggcggcccugggcacgaggagccgguucccaugucaacuuacggauggaauaucgugaaacuuaugagugguaaggaugucuucuaccugccaccugaaaaaugugacaccuugcugugcgauauuggcgagagcucccccucuccuacaguggaagagagcaggacuauccgcguccucaagaugguggagccaugguuaaagaacaaucaguucuguauaaaaguucugaaccccuauaugccuaccguaauugaacaccuugagcggcugcaacgaaagcaugggggaaugcuagugagaaauccacucuccaggaacucaacacacgaaauguacuggaucucuaauggcaccgguaacaucgucgccagugugaauaugguuucgcgccuguugcugaaccgguuuacuaugacgcauagacgucccacaauugagaaagacguggaucucggggcuggaaccaggcacgucaacgcggaaccggagacuccuaauauggacgugauaggcgagcggaucaagcgcauuaaagaagagcacaacagcaccuggcauuaugacgaugaaaauccauacaagacaugggccuaucacggcuccuacgagguaaaggcaacggggucugcuucaagcaugaucaacggagugguuaaacuucugaccaagcccugggacgucgugccuauggugacucagauggccaugacagauaccacuccauucggucagcaacgagucuuuaaagaaaagguugacacaagaacccccagguccaugccgggcacacggcgcgugauggggauuacugcagagugguuauggagaacccugggaaggaauaaaaagccucgauugugcacgcgggaggaauucaccaagaaaguacguacaaacgccgcuaugggcgccguguuuacugaggaaaaucagugggauagugcgaaggcagccgucgaggacgaagauuucuggaaacucguggacagagagcgcgagcugcauaagcuagguaaaugugggucuugcguuuauaacaugaugggaaagagggaaaaaaagcuuggcgaguuuggcaaggcuaaagggagccgggccaucugguacauguggcugggagcaagauaccucgaauucgaggcucuggguuuuuugaaugaggaucacugguucucacgcgaaaacuccuauaguggcguggagggggaaggacugcauaagcucggcuacauacuuagggacaucagcaaaauucccgguggggccauguaugcugaugacaccgccggaugggacacacgaaucacugaggaugaccugcacaaugaagagaagauuacccagcagauggauccagagcaccggcaauuagcaaacgcgaucuuuaaacugacguaccagaauaaggucgugaagguacagagaccuacacccaccggcacuguuauggacauaauuucuaggaaagaucagcgcggcuccgggcaagugggaacauaugguuugaacaccuucacuaauauggaagcccagcucauccgucagauggagggcgaagggguccugcuaaaggcugaccuugagaacccacaucugcccgaaaaaaagaucacccaguggcucgagacaaaaggaguggagcggcugaagagaauggccauuucaggcgaugacugcguggucaagccuauagaugacagguuugcaaacgcuuuguuagcccugaaugauauggguaaaguucgcaaggacaucccacaauggcagccgagcaaaggguggcacgauuggcagcaggugcccuucuguucgcaucacuuccacgaacucauuaugaaggacggacgaaaacuuguagugccuugccggccacaagacgagcugaucggcagagcaaggauuucucagggcgccggguggagucuaaaggaaacggcgugucugggaaaggcuuacgcccagauguggucccucauguauuuucaucgcagagauuugcggcuggcaagcaacgccaucugcucagcuguccccgugcacuggguuccuaccuccaggacuacauggucuauacaugcccaccaucaauggaugaccacugaggacaugcuuacaguguggaaucgugucuggaucgaagauaacccauggauggaggacaaaacccccgugacgacaugggagaauguaccuuaccuggguaagcgagaagaucagugguguggcagccucauuggguuaaccagucgcgcaacuugggcucagaacaucccgaccgccauucagcaaguuagaucccugaucggaaaugaggaauucuuggacuacaugccaagcaugaaacgguuuaggaaggaggaggaaucugagggcgcgauuugguga

SEQ ID NO: 15332 - RNA, 9873 nt, Artificial Sequence
  derived and/or modified CDS sequence (opt3) from DENV-3__JF937638__SS-prME
accagccugugccuccuuaugauccugcccgccgcuuuggcauuccacuuaacauccagagacggcgagccuaggaugauuguggggaagaacgaacggggaaaaucucugcuauuuaagacugccucagguauaaauauguguacgcucaucgcgauggaucugggcgagaugugcgacgauaccgucacauacaaauguccacauauuacugaaguugagccggaagacaucgauugcugguguaaccuuaccaguacaugggugaccuaugggacuugcaaucaggcuggagagcaccgccgagacaagcguagcguagcccuggcaccccaugugggcauggguuuggauacaagaacccaaacguggauguccgccgagggggcuuggaggcaggucgaaaaaguggagacuugggcacuccggcacccuggauucaccauucuggcccuguuucucgcucauuacaucggcacaucuuuaacucagaagguugugauauucauccugcuuauguuggucaccccaucgaugacaaugcgcugugugggcguagggaacagagacuuuguugaaggacugucaggugccaccuggguggaugucgugcuagagcacggcgggugcgugacgacuauggcgaagaauaaacccacacucgacauugagcugcagaagaccgaagcaacucaacuugccacacugaggaaauuguguaucgagggaaagauuaccaacaucacgaccgauagccggugcccuacacagggcgaagcuacucucccagaggaacaggaccagaauuaugucuguaaacacaccuacguugaucgcgguugggggaacggaugcggccuguucggcaaggggaguuuagugacaugcgccaaguuucaaugucuggagcccauagagggaaaaguagugcaguaugaaaaucucaaguacacugucauuaucaccgugcauacaggugaccagcaccagguuggcaacgagacccaaggggugacugcagaaauuacgccucaggcuuccacaaccgaggccauccuuccagaauauggaacucugggcuuggagugcucuccgcgaaccggucuagacuucaaugagaugauccugcucacaaugaaaaacaaggcguggaugguccauagacagugguuuuucgaucugccccuuccuuggaccagcggggccacuacagaaacgccaaccuggaauaggaaagagcuguuggugacuuuuaagaacgcacacgcuaaaaagcaagaaguaguugugcucggcucccaggagggagccaugcacacagcucugaccggcgccacagaaauucagaauucagggggaacuaguauauucgcaggucauuuaaagugucggcugaaaauggacaagcuagagcucaaaggcaugagcuacgccaugugcaccaacacguuuguccugaagaaagaggugucugaaacccagcacgggacaauccuuauuaaggucgaguacaagggagaagaugugcccuguaaaaucccuuucuccacugaggacggccaagguaaggcucauaacgggcguuugauaaccgcgaauccaguugugacaaaaaaggaggaacccguaaacauugaggcagaaccgccuuucggcgagucaaauaucgucaucggaauuggcgauaacgcccugaaaaucaauugguauaagaaggggagcaguauuggaaaaauguuugaagcuacugcccgcggugcaagaaggauggccauacucggcgacaccgcuugggauuucgggucugugggaggcguucugaacucccuugguaagauggugcaccagaucuuugggagcgccuacacggcacuguucucgggcgucucuugggugaugaaaauuggaaucggcguauugcucacauggaucgggcugaauuccaagaacaccucaaugaguuuuagcugcauugcgauaggaaucauuacuuuauaucugggcgcugugguucaggccgacauggguugugucaucaauuggaaagggaaggagcuaaagugcggauccggcauuuucgugacaaacgaggugcauaccuggacugaacaguacaaauuucaagcagauucucccaagcggcucgccaccgcuaucgccggugcaugggagaauggcgucugugggauacgaagcacaacgcgcauggaaaaccugcuuuggaaacagaucgcuaaugaguugaacuauauucugugggaaaauaacaucaagcucaccguuguggugggagacauuaucggcguacuggagcaggggaaaagaacuuuaacaccacagccuauggagcugaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcuuaaauugcgggaaguguacacccagcucugugaccaccgccugaugucagcugcaguuaaggaugagagagccgugcacgcugacaugggauacuggaucgagagucagaaaaacggcagcuggaagcuagaaaaagccucccugauagagguaaagacuugcaccuggccuaagucucauacacucuggucgaaugguguccuggaaagcgauaugaucauuccaaaaucccuugcaggcccgaucucacagcacaaccauaggcccggguaucacacucaaaccgcgggaccuuggcacuugggcaagcuggaguuagacuuuaauuacugcgaggggacaacgguggugauuaccgaaaacuguggaacucguggcccaagucuccggacaaccacugucucugguaaacugauccaugaguggugcugucgaagcugcacacuucccccucugagauauaugggggaagauggauguugguacggcauggagauaaggccaauuuccgaaaaggaggagaauaugguuaaaucauuggugagcgccgguucuggcaagguagacaacuucaccaugggggugcucugccuggcuauccuauuugaagaggucaugcgcggaaaguucggcaaaaagcacaugaucgccgggguguucuuuacguucguucugcuccuguccggacagauuacuuggcgggauauggcacauacccuuaucaugauuggcaguaaugcuagcgacagaauggguaugggggugacauauuuggcccugauagcaaccuuuaaaauccagcccuucuuagcccucggauuuuuccugaggcgccuuacuucucgagaaaaccugcuacucggcgucggccuggcuauggcgacaaccuugcaacugccggaggauauugaacagauggccaaugggaucgcauuaggacucauggcucugaagcuuauuacacaguuugagacuuaccagcuguggaccgccuugaucucccucacguguucaaacacaauauucacccugacuguggccuggcggaccgcuacacuaauccuggcagguguuagucuucucccugugugccguagcucguccaugagaaaaacugacuggcugccaauggccgucgcggcuaugggcguacccccuuugccccuguuuauuuucucuuuaaaggauacccucaagaggcgcagcuggccacugaaugagggggugauggccguuggacuugugucaauccuggcaaguuccuugcuccggaacgacgucccuauggccggcccccugguggcuggugggcuacugauugcauguuauguaaucacgggaacaucugccgaucuuaccguggaaaaagcggcugacauaacuugggaggaagaggccgaacaaacaggcgucagccacaaccucaugauuaccguugacgaugacggcacuaugagaaucaaggaugacgagacagagaauauccugaccguguuguuaaaaacggcacugcucauuguguccgggauauuuccauacucaaucccggccacucugcuugucuggcauaccuggcagaagcagacacagaggagcggagugcugugggauguuccuagucccccagaaacccaaaaagcugaguuggaagaggguguauaccgaauuaagcagcagggcaucuucgggaaaacacaggugggagucggcgugcaaaaggaggguguuuuucacacuauguggcacgugacccgcggggccguccuaacguauaacggaaagcggcuggaacccaauugggcaucugugaaaaaggaccucauuuccuacggcggcggguggagacugagcgcucaguggcagaaaggagaggaaguacaagucaucgccguggagccugguaagaacccaaaaaauuuccagacaaugcccggcacuuuccagaccacaaccggggaaauaggagcgaucgcccuugauuuuaagccuggcacuucggguucaccgauuaucaacagggaggggaagguugugggauuauauggcaauggcgucgugaccaaaaacgggggauacguuucugguauugcacagacaaaugcugagccagacggccccacgccugaacuggaggaagagauguucaagaaacguaaccucacuaucauggauuugcauccagggaguggaaagacccgcaaauaucugcccgccauagugcgggaagcuauuaagagaaggcuccgaacacugauccuugcaccuacccgggucguggccgccgagauggaggaagcucugaagggcuugccgauccgcuaccaaacuacagcgaccaaauccgagcacacggguagagaaauuguagaccuaaugugccaugcaacuuuuacaaugaggcugcucagccccgugcggguuccaaauuauaacuuaaucauaauggaugaggcccacuucaccgacccugcuucuauugccgcacgaggguacaucagcaccagagucggaaugggcgaagccgcugcgauuuuuaugacugccacacccccaggcaccgcagaugcuuucccucaguccaaugcccccauccaggacgaggagcgcgacauaccagaaaggucauggaacagugggaaugaguggauuacagauuuugcaggaaagacugugugguucgugccgagcaucaaagccgguaacgacaucgcuaacugucugcguaagaauggcaaaaaggucauucagcuuucucggaagacguuugauaccgaauaccaaaaaacaaagcugaacgacugggauuucguagugacuaccgacaucuccgagaugggggccaauuuuaaagcggauagaguuauugacccuaggcgcugccucaagcccgugauauugacagauggaccagagcgagucauccuggcaggccccaugccugugaccgccgcuucagccgcucagagacgggguaggguugggcgcaacccacagaaagaaaaugaccaguauauuuucacuggccaaccccucaacaaugaugaggaccaugcacacuggacggaagccaagaugcugcuugacaacaucaauaccccugagggaaucauuccggcucuauucgaaccagagcgugagaagagugccgcaauagauggcgaauacagacugaaaggggagagccggaagacauuuguggaauugaugaggcgcggagacuuacccgucuggcuggcgcacaaaguggccuccgaggguaucaaguauacugaucgaaaauggugcuucgacggccagagaaacaaucagauucucgaagagaacauggauguagagaucuggaccaaggaaggggagaaaaagaagcugcggccuagguggcuugacgcucgcacauacucugauccccuggcccucaaagaauuuaaggaguucgcagcuggaagaaaaucgauugccuuggaccuggugaccgaaaucggcaggguuccaagccaucuagcacaccggacucguaaugcccuggauaaccucgucaugcuucauacaucagagcacggugggcgcgcuuaucgacacgcgguggaggaacugccugagacgauggaaaccuuauugcugcucggccugaugauacuucugacuggaggcgccaugcucuuuuugaucuccgggaagggaauugguaaaacaaguaucggccugauuugugugaucgcaucuagcgggauguuauggauggcugagauaccccuacaguggauugccuccgccaucguccuggaguucuuuaugaugguucuccuuauuccagaaccugagaagcaaagaaccccgcaggacaaucagcuggcauacgugguaaucggaauauugacccuggcugccaucauugcggcuaacgaaaugggccuccuggagacaacuaagagggaucuugguaugucaaaagaacccgggguggucucuccaacgagcuaucucgacguggaucugcauccugccagugcauggaccuuguacgccguugcuacaacugugaucacccccaugcugcggcacacaauugagaauuccaccgcaaacgucagcuuagccgcgaucgcuaaccaagccguagugcuaaugggccuggacaagggauggccaauaucuaaaauggaccucggcguuccucuucuggcauuggggugcuacucacaggugaauccccugacucucacggccgcuguccugcuuuuaauuacacauuaugccaucaucggaccgggccugcaggcaaaggcuacccgcgaggcccagaaaagaacugcggccgguauuaugaagaacccaaccguggaugggaucaugacaauagaccucgauccugucauuuacgacuccaaguucgaaaaacaauugggacaggugaugcugcuaguucugugugcagugcagcuccuucugaugaggacuaguugggcuuugugcgaggcccugacccucgcaacaggccccaucacgacccugugggaagguagcccaggcaaguuuuggaauacuacaauugcuguaucgauggccaacaucuuccgggggucuuauuuagccggagcgggccuugcuuuuuccauaaugaaaagcguggggaccggaaagcgaggcacugguucacagggggagacacugggagaaaaauggaagagaaagcucaaucaacuaagucgcaaagauuucgaccuguacaagaaaucuggcaucaccgaggucgauaggacggaggcaaaggaagguuugaaacggggcgagauuacccaccaugccguuucccgugggagcgcuaagcugcagugguuuguggaaagaaacauggucacacccgagggaagggugaucgaccucggcugugggcgcggaggcuggucauauuacugcgccggucuuaaaaagguaacugaagugcggggguauaccaagggaggcccuggccacgaggagccgguucccaugaguacauacggguggaauauugugaaacugaugagcggaaaggaugucuucuacuugccaccugaaaaaugugacacucugcucugcgauaucggugaguccucucccagcccuaccguggaagagucccgaacaauuagagucuuaaagaugguggagccauggcugaaaaacaaucaguucuguaucaagguucuuaaccccuauaugccuaccguaauagaacaccuggagaggcuacagcgcaagcauggcgggaugcucgugcggaauccacugucaagaaacucuacucacgaaauguacuggauuaguaauggaacgggcaacaucgucgcaucggugaauaugguuagccguuugcugcucaacagguuuacaaugacccaucggcgccccacuaucgagaaagacguggaucuuggugccgggacccgacacgucaacgcugaaccggagacaccuaauauggacgugauuggagagagaauaaagaggaucaaagaagagcacaaccugacguggcauuaugacgaugaaaauccauacaagaccugggcguaucacggcuccuacgagguaaaagccacuggcucugcaucaagcaugauuaacggggugguuaaguuacugacaaagcccugggacgucgugccuauggugacccaaauggcuaugacugauacaaccccauucggacagcagcgggucuuuaaagaaaagguugacacacgcacucccagauccaugccggguaccaggcgagugaugggcaucacggccgagugguuguggcggacccucgggcguaauaaaaagccuagacugugcacacgcgaggaauucacuaaaaagguaaggaccaacgcagccaugggagcuguguuuacagaggaaaaucaaugggauagugccaaggcggcagucgaggacgaagauuucuggaaacuaguggaccgggagagagagcuucauaagcugggcaaaugugguucuugcguuuauaacaugauggggaagcgcgaaaaaaagcucggagaguuuggcaaagccaagggcagcagggcuauuugguacauguggcugggggcccgauacuuggaauucgaggcacugggauuucucaaugaggaucacugguucucacgggaaaacuccuauagugguguggagggcgaagggcuucauaagcugggauacaucuuaagagacauaagcaaaauccccggcggugcuauguaugccgaugacacugcugggugggacaccaggauuacggaggaugaccugcacaaugaagagaagaucacacagcagauggauccagagcaccgccaguuggccaacgcaauuuuuaaacucaccuaccaaaauaaggucgugaaaguacagcguccuacucccacaggaaccguuauggacaucauaucucggaaggaucagagaggcuccggccagguggggacuuauggacugaacaccuucacaaauauggaagcgcaaauuaucaggcagauggagggugaaggcguccuaucaaaggccgaccuugagaacccacaucugcccgaaaaaaagaucacgcaguggcucgagaccaaagggguggagcgccugaagcgaauggcuauuagcggagaugacugcguggucaaaccuauagaugaccgguuugccaacgcauuguuagcucugaaugauaugggcaagguuagaaaggacaucccacaguggcaaccgucgaaagguuggcacgauuggcagcaggugcccuucuguucucaucacuuccacgaacucauuaugaaggacgggaggaaacuuguagugccuugccgcccacaggacgagcugaucggaagagcccggauuagucaaggcgcaggcuggucccuaaaggaaacugccugucuggggaaagcguacgcucagauguggagccucauguauuuucauaggcgugauuugcgacuggccucaaacgcaaucugcuccgccguccccgugcacuggguuccuacaucucgcaccacuuggagcauacaugcucaccaucaguggaugacaaccgaggacaugcuuacgguguggaauagagucuggaucgaagauaacccauggauggaggacaagacacccgugaccacuugggagaauguaccuuaccugggaaagcgggaagaucaauggugugguagucucauuggcuuaaccuccagggccacaugggcacagaacaucccgacugcuauucagcagguucgcagccugaucgggaaugaggaauucuuggacuacaugccaucuaugaaaagauuucggaaggaggaggaaucagagggagccauuugguga

SEQ ID NO: 15333 - RNA, 9873 nt, Artificial Sequence
  derived and/or modified CDS sequence (opt3) from DENV-3__JF937639__SS-prME
accagccugugccucaugaugauccuucccgcagcucuggcauuccacuugacuuccagagacggcgaaccuaggaugauuguggggaagaacgaacggggaaaaucuuuacuguuuaagacugccucagguauaaauauguguacgcucaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucaaaauucagggggaacaaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugcucccuguaaaaucccuuucuccacugaggacggccaagguaaggcgcauaacgggcgucuuauaaccgcaaauccagugguuacuaagaaggaggaacccgugaacauugaggccgaaccgccuuucggcgagucaaauaucguaaucggaauuggcgauaacgcuuugaaaaucaauugguauaagaaggggagcaguauuggaaaaauguuugaagccacugcacgcggugccagaaggauggcuauacugggcgacaccgccugggauuucgggucugucggaggcgugcucaacucccuggguaagaugguucaccagaucuuugggagcgcauacacggcgcuuuucucgggcgugucuugggucaugaaaauuggaaucggcgugcuguugacauggaucgggcucaauucccggaacaccucaaugaguuuuagcugcauugcuauaggaaucauuacucuguauuuaggcgccguagugcaggcagacauggguuguguuaucaauuggaaggggaaagagcugaagugcggauccggcauuuucgucacaaacgaggugcauaccuggacugaacaguacaaguuucaagccgauucucccaaacgacuagcuaccgccaucgccggugcuugggagaauggcgugugugggauacgcagcacaacgagaauggaaaaccuccuguggaagcagaucgccaaugagcuuaacuauauuuugugggaaaauaacaucaaacugaccgucguugugggagacauuaucggcgugcucgagcaggggaagaggacucugacaccacagccuauggaguuaaaauacucauggaagaccuggggaaaagcgaagauaguaacagccgaaacucaaaacaguuccuucauuaucgauggccccaauaccccagagugccccagcgucucucgggcuuggaacgugugggaaguugaggacuaugguuuugggguguucacgacaaauauuuggcugaaacuucgcgaagcauacacccaguugugugaccacagacucaugucagccgcugucaaagaugagagggccgugcacgcagacaugggauacuggaucgagagucagaagaacggcagcuggaaacuggaaaaggcgucccuaauagagguuaaaacuugcaccuggccuaagucucauacaaucuggucgaauggugugcuggaaagcgauaugauuaucccaaagucccucgccggcccgauuucacagcacaaccaucgucccggguaucacacucaaaccgcuggaccuuggcaccugggcaaacuugaguuggacuuuaauuacugcgaggggacaacgguagucaucaccgaaaacuguggaacucggggcccaagucugcgaacaaccacugugucugguaaguuaauacaugaguggugcuguagaagcugcacacuacccccucugagguauaugggggaagauggauguugguacggcauggagauucgcccaaucuccgaaaaagaggagaauauggugaagucacuugucagcgccgguucuggcaaaguugacaacuucaccaugggggugcugugcuuggcaauccucuuugaagagguaaugcggggaaaguucggcaagaaacacaugauugcugggguguuccugacguuuguccuacugcucuccggacagaucacuuggagagauauggcccauacccugauuaugauaggcaguaaugcaagcgacaggauggguaugggggugacauaucuugccuugaucgcuaccuucaagauucagcccuuucuggcguuaggauucuuucuccgcaaacugacuucucgagaaaaccuucugcuaggcguuggccucgccauggcaacaacccugcaauugccggaggauaucgaacagauggcuaaugggauugcccugggauuaauggcccucaagcugaucacacaguucgagacuuaccagcuuuggaccgcucugauauccuugacguguucaaacacaaucuuuacccucacuguggcauggcggaccgccacacugauucuagcgggugucagucugcuuccugugugccaaagcucguccaugcguaaaacugacuggcucccaauggcuguugccgcaaugggcgugcccccucugcccuuguucaucuuuucucugaaggauaccuuaaagagaaggagcuggccacucaaugagggggucauggccguaggacuggugucaauucuugcuaguucccuguugcgcaacgacguuccuauggcaggcccccucguggccggugggcugcuaaucgcguguuaugucauaacgggaacaucugcugaucugaccguggaaaaagccgcagacauuacuugggaggaagaggccgaacagacaggcguaagccacaaccuuaugaucaccguggacgaugacggcacuaugcggaucaaggaugacgagacagagaauauucucaccguccuguugaaaacggcuuuacugauaguuuccgggaucuucccauacucaauuccggccacucuccugguguggcauaccuggcagaagcagacaaaaagaagcggagugcuuugggaugucccuagucccccagaaacccaaaaggcagagcuggaagaggguguguacaggaucaaacagcagggcauuuuugggaagacacagguuggaguaggcgugcaaaaggagggugucuuccacacuauguggcacgugacccgaggggcuguuuugacguauaacggaaaacgccuagaacccaauugggccucugugaagaaagaccugaucuccuacggcggcggguggcggcucagcgcgcaguggcagaagggagaggaaguccaagugauagccguagagccugguaaaaacccaaagaauuuucagacaaugcccggcacuuuccagaccacaaccggggaaaucggagcaauugcucuggauuucaagccuggcacuucggguucaccgaucauuaacagagaggggaaagucgugggacuuuauggcaauggcguugugaccaagaacgggggauacgucucugguaucgcccagacaaaugcugagccagacggccccacgccugaauuagaggaagagauguuuaaaaagaggaaccugacuauaauggaucuccauccagggaguggaaaaacccguaaguauuugcccgcaauugugcgcgaagccaucaagcggagacugaggacacucauccuggccccuacccgaguuguggcugcggagauggaggaagcacuuaaaggccugccgauucgguaccaaacuacagccaccaaguccgagcacacgggucgcgaaaucgucgacuugaugugccaugcuacuuucacaaugagacuacugagccccgugaggguaccaaauuauaaccucauaauuauggaugaggcccacuuuaccgacccugcaucuaucgccgcucggggguacauuagcacccgagugggaaugggcgaagcggccgcaaucuucaugacugcuacacccccaggcaccgccgaugcauuuccucaguccaaugcccccauacaggacgaggagagagacauuccagaacgcucauggaacagugggaaugaguggaucacagauuucgcuggaaaaacuguuugguuugucccgagcaucaaggccgguaacgacauugcgaacuguuuaaggaaaaauggcaagaaggugauccagcugucucguaaaacguucgauaccgaauaccaaaagacaaaacuuaacgacugggauuuuguggucacuaccgacauuuccgagaugggggcaaauuucaaggccgaucggguaauagacccuagaaggugccugaaacccgugauccucacagauggaccagagcgcguuauuuuggcuggccccaugccugugaccgccgcuucagcagcccagcgaagaggucgggucgggaggaacccacagaaggaaaaugaccaguauaucuuuacuggccaaccccugaacaaugaugaggaccaugcucacuggacggaagccaagaugcuccuggacaacaucaauaccccugagggaauuauaccggcacuuuucgaaccagagcgcgagaaaagugcggccaucgauggcgaauaccgucuaaagggggagagcagaaaaacauucguggaacugaugcggaggggagacuugcccguuugguuagcucacaagguggccuccgaggguauuaaauauacugaucgcaaguggugcuuugacggccagcgaaacaaucagauccuggaagagaacauggaugucgagauuuggaccaaagaaggggagaagaagaaacucagaccucgguggcuggacgcaaggacauacucugauccccuugcucugaaggaguucaaagaguuugccgcaggacgcaagucgaucgcccucgacuuggugaccgaaauaggcagaguaccaagccaucuggcucacaggacucggaaugcgcuagauaaccuggugaugcuccauacaucagagcacggugggcgugccuaucgccacgcaguugaggaacuuccugagacgauggaaacccuguuauugcugggccucaugauccugcuuacuggaggcgcuaugcuguuccucauuuccgggaaaggaaucgguaagacaaguauuggcuugaucugugucauagccucuagcgggaugcuguggauggccgagauucccuuacaguggaucgcauccgcuauugugcuagaguuuuucaugauggugcugcucaucccagaaccugagaagcaacgaaccccgcaggacaaucagcuugccuacgucguuauaggaauccugaccuuggcggcuauuaucgccgcaaacgaaaugggccugcucgagacaacuaaaagagaucuggguaugucaaaggaacccggggugguaucuccaacgagcuaucuugacguggaucuccauccugccagugcuuggacccuguacgcagucgccacaacugugauuacccccauguugaggcacacaaucgaaaauuccaccgcgaacguuagccuggcugccauagcaaaccaagccguggucuuaaugggccuagacaaaggauggccaauuucuaagauggaccugggcguaccucuccuugcucuggggugcuacucacaggugaaucccuugacucugacggccgcaguucuccugcuuaucacacauuaugcuaucauuggaccgggcuuacaggccaaagcgacccgggaggcccagaagcgcacugcagcugguaucaugaagaacccaaccguggaugggauaaugacaauugaccuggauccugucaucuacgacuccaaauuugaaaagcaacucggacaggugauguugcugguccuaugugccgugcagcugcuccuuaugagaacaaguugggcacugugcgaggcuuugacccuggccacaggccccauuacgacccucugggaagguagcccaggcaaauucuggaauacuacaaucgccguuucgauggcgaacauauuuagggggucuuaucuggcuggagcaggcuuagccuucuccaucaugaaaagcguggggaccggaaaacggggcacugguucacagggggagacacuuggagaaaaguggaagaaaaagcugaaucaacucagucgaaaagauuuugaccuauacaagaaaucuggcauuaccgagguagauagaacggaggcuaaggaaggucugaaacgcggcgagaucacccaccaugccguguccagggggagcgcaaaguugcagugguucgucgaacggaacaugguuauucccgagggacgugugaucgaccugggcugugggagaggaggcuggucauauuacugcgccggucucaagaaagucacagaagugaggggguauacuaagggaggcccuggccacgaggagccgguacccaugaguaccuacggguggaauauugugaaacuuaugagcggaaaggauguguuuuaccugccaccugaaaaaugugacacauugcugugcgauaucggugaguccucucccagcccuacuguugaagagucccgcaccauacggguccucaagaugguggagccaugguuaaagaacaaucaguucuguauuaaaguccugaaccccuauaugccuacagugaucgaacaccuugagcgacugcagagaaagcauggcgggaugcuaguuaggaauccacucucacgcaacucuacccacgaaauguacuggaucaguaauggaacuggcaacauuguagcuucggugaauauggucagccggcuguugcugaacagauucacgaugacacaucguaggcccaccauagagaaagacguggaucucggugcggggacucggcacguuaacgccgaaccggagaccccuaauauggacgugaucggagagcgcauuaagcgaaucaaagaagaacacaacuccacauggcauuaugacgaugaaaauccauacaagacgugggcauaucacggcucuuacgaggucaaggcuaccggcucagccagcuccaugauuaacggggugguaaaacuucugacuaagcccugggacgugguuccuauggucacacaaauggcaaugaccgauacuacaccauuuggacagcagagaguguucaaagaaaagguggacaccaggacaccccggaguaugccggguacucgcagagucaugggcaucaccgccgagugguuauggaggacgcuggggcgaaauaaaaagccucgguugugcacccgugaggaauuuacaaagaaaguuagaacuaacgcugccaugggagcgguguucaccgaggaaaaucaaugggauucugcaaaggccgcuguagaggacgaagauuuuuggaaacucguggaccgcgagagggagcugcauaagcuaggcaaaugugguagcugcgucuauaacaugauggggaagcgggagaagaaacuuggagaguucggcaaggccaaaggcucaagagcaauaugguacauguggcugggggcucgcuaccucgaauuugaggcccugggauucuugaaugaggaucacugguuuuccagggaaaacaguuauagcgguguggagggcgaagggcugcauaagcucggauacauccuucgagacauuucuaaaauccccggcggugcuauguaugccgaugacacagcagggugggacacucggauuaccgaggaugaccugcacaaugaagagaagaucacgcagcagauggauccagagcacagacaguuagcgaacgccauauucaaacugacauaccaaaauaagguugugaagguccagaggccuacccccacuggaacagugauggacauuaucucccgcaaagaucagcguggcucaggccagguagggaccuauggauugaacacuuuuaccaauauggaagcucaacucauccggcagauggagggugaaggcguucugagcaaggccgaccuagagaacccacaucuucccgagaagaagauuacacaguggcuggagacgaaagggguggagagacucaagaggauggcaauaucgggagaugacugcgucgugaagccuaucgaugaccgcuucgcuaacgcccuguuggcauuaaaugauaugggcaaagugcgaaaggacauuccacaguggcaaccgucuaaagguuggcacgauuggcagcagguccccuuuuguagucaucacuuccacgaacugaucaugaaggacgggcggaaacucguugugccuugcagaccacaggacgagcuuauuggaagggcccgcaucucccaaggcgcgggcuggagccugaaggaaaccgcuugucuagggaaggccuacgcacagauguggucacugauguauuuccauagacgggaucucagguuggccuccaacgcuauaugcucugccguacccgugcacugggucccuacuagccguacaaccuggaguauccaugcacaccaucaguggaugacuacagaggacaugcugaccguguggaaucgaguuuggauugaagauaacccauggauggaggacaaaacgcccgugacaaccugggagaaugucccuuaccuuggaaagcgcgaagaucaauggugugguucccugaucggccucacuagcagagcuaccugggcccagaacauuccgacagcgauccaacaggugcggucuuuaauugggaaugaggaauuucuggacuacaugccaucaaugaaaagguuccgcaaggaggaggaaagugagggagcuauaugguga

SEQ ID NO: 15334 - RNA, 9873 nt, Artificial Sequence
  derived and/or modified CDS sequence (opt3) from DENV-3__JF937627__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcagcaugaaaaucugaaguauacugucauuaucaccgugcacacaggugaccagcaucagguuggcaacgagacccaaggggugacugcagaaauuacgccucaggcuuccacaaccgaggccauccucccagaauacggaacucuuggccuggagugcucuccgcgaaccgguuuggacuucaaugagaugauccuacugacaaugaaaaacaaggcguggaugguccacagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcauacagcucucaccggcgccacagaaauucagaauucagggggaacuaguauauucgcaggucaccugaagugucgguuaaaaauggacaagcuggagcuaaaaggcaugagcuaugccaugugcaccaacacguuuguccucaagaaagaggugucugaaacccagcaugggacaauccugauuaaggucgaguacaagggagaagaugugcccuguaaaaucccuuucuccacugaggacggccaagguaaggcucacaacgggcgucuuauaaccgcgaauccaguugugacaaaacgcgaggaacccguaaacauugaggcagaaccgccuuucggcgagucaaauaucgucaucggaauuggcgauaacgccuugaagaucaauugguacaaaaaggggagcaguauuggaaagauguuugaagcuacugccagaggugcaaggcggauggccauacugggcgacaccgcuugggauuucgggucugugggaggcguucucaacucccuggguaaaauggugcaucagaucuuugggagcgccuauacggcacuuuucucgggcgucucuugggugaugaagauuggaaucggcguacuguugacauggaucgggcucaauuccaaaaacaccucaaugaguuuuagcugcauugcgauaggaaucauuacucuguacuuaggcgcugugguucaggccgacauggguugugucaucaauuggaaggggaaagagcugaagugcggauccggcauuuucgugacaaacgaggugcacaccuggacugaacaguauaaguuucaagcagauucucccaaacgacuagccaccgcuaucgccggugcaugggagaauggcgucugugggauacgcagcacaacgagaauggaaaaccuccuguggaagcagaucgcuaaugagcuuaacuacauuuugugggaaaauaacaucaaacugaccguuguggugggagacauuaucggcguacucgagcaggggaagaggacucugacaccacagccuauggaguuaaaauauucauggaagaccuggggaaaagccaagauagucacagcggaaacucaaaacaguuccuucauuaucgauggccccaauaccccagagugccccagcgugucucgggccuggaacguuugggaaguggaggacuacgguuuuggggucuucacgacaaauauuuggcugaagcuucgcgaaguguauacccaguugugugaccacagacucaugucagcugcaguuaaagaugagagggccgugcaugcugacaugggauacuggaucgagagucagaagaacggcagcuggaaacuggaaaaggccucccuaauagagguaaaaacuugcaccuggccuaagucucacacacuguggucgaaugguguccucgaaagcgauaugaucauuccaaagucccuggcaggcccgaucucacagcauaaccaccgucccggguaccacacucaaaccgcgggaccuuggcaucuuggcaaauuggagcuggacuuuaauuauugcgaggggacaacgguggugauuaccgaaaacuguggaacucggggcccaaguuuacgaacaaccacugucucugguaagcucauccacgaguggugcuguagaagcugcacacugcccccucuuagguacaugggggaagauggauguugguauggcauggagauacgcccaauuuccgaaaaagaggagaauaugguuaagucacuggugagcgccgguucuggcaaaguagacaacuucaccauggggguguugugccucgcuauccuguuugaagaggucaugcggggaaaguucggcaagaaacauaugaucgccgggguguucuuuacguucguucuacugcucuccggacagauuacuuggagagauauggcacacacccugaucaugauuggcaguaaugcuagcgacaggauggguaugggggugacauaccuugccuugauagcaaccuuuaagauccagcccuuccuggccuuaggauuuuuccuccgcaaacugacuucucgagaaaaccuucugcuaggcgucggccucgcuauggcgacaacccugcaauugccggaggauauugaacagauggccaaugggaucgcacugggauuaauggcucucaagcugauuacacaguuugagaucuaucagcuuuggacugcccugauauccuugaccuguucaaacacgaucuucacacucaccguggccuggcggacugcuacccugauucuagcagguguuagucugcuuccuaugugccaaagcucguccaugcguaaaacagacuggcucccaauggccguggcggcuaugggcguccccccucugcccuuguuuaucuucucucugaaggauacuuuaaagagaaggagcuggccacucaaugaggggguaauggccgugggacugguuucaauucuugcaaguucccuguugcgcaacgacgugccuauggccggcccccucgucgcuggugggcugcuaaucgcauguuacgugauaaccggaacgucugccgaucugacaguagaaaaagcggcugacauuaccugggaggaagaggccgaacagacuggcgugagccauaaccuuaugaucacagucgacgaugacggcaccaugcggaucaaggaugacgagacugagaauauucucacaguucuguugaaaaccgcauuacugauaguguccgggaucuuuccauauucaauuccggccacgcuccugguguggcacacuuggcagaagcagacccaaagaagcggaguccuuugggaugugccuagucccccagaaacacagaaagcugagcuggaagaggguguuuacaggaucaagcagcagggcauuuucgggaaaacccaaguaggagugggcguccagaaggaggguguguuucacacaauguggcauguuacucgaggggccguguugaccuacaacggaaagcgccuagaacccaauugggcaucugucaaaaaggaccugaucuccuauggcggcggguggcggcucagcgcucaguggcaaaaaggagaggaagugcagguaauagccgucgagccugguaagaacccaaaaaauuuccagacgaugcccggcacauuccagacuaccacaggggaaaucggagcgauugcccuggauuuuaagccuggcaccucggguucaccgaucauuaacagagaggggaaggugguuggacuuuacggcaauggcguggucacuaaaaacgggggauaugugucugguaucgcacaaaccaaugcugagccagacggccccacaccugaauuagaggaagagauguucaagaaaaggaaccugacgauaauggaucuccacccagggaguggaaagacucguaaauacuugcccgccauuguucgcgaagcuaucaagcggagacugaggacccucauccuggcaccuacacgaguggucgccgccgagauggaggaagcucuuaagggccugccgauucgguaucagaccacugcgacaaaauccgagcauaccggucgcgaaaucguggacuugaugugccacgcaacguuuacuaugagacuacugagccccguaagggugccaaauuacaaccucauaauuauggaugaggcccauuucacagacccugcuucuaucgccgcacggggguauauuagcacccgaguuggaaugggcgaagccgcugcgaucuuuaugaccgccacucccccaggcacagcagaugcuuucccucaguccaaugcccccauacaggacgaggagagagacauuccagaacgcucauggaacagugggaaugaguggaucaccgauuuugcaggaaagacagucugguucgugccgagcaucaaagccgguaacgacauugcuaacuguuuaaggaagaauggcaaaaaggugauccaacugucucguaagacuuuugauacggaauaccagaaaaccaagcuuaacgacugggauuucgucguaacaacugacauuuccgagaugggggccaauuuuaaagcggaucgggugauagacccuagaaggugccugaagcccguuauccucaccgauggaccagagcgcgugauuuuggcaggccccaugccugucacagccgcuucagccgcucagcgaagaggucggguggggaggaacccacagaaagaaaaugaccaauacaucuucaccggccagccccugaacaaugaugaggaccacgcacacuggacugaagccaagaugcuccuggacaacaucaauacgccugagggaauuauaccggcucuuuucgaaccagagcgcgagaagagugccgcaaucgauggcgaauaucgucuaaaaggggagagcagaaagaccuuuguugaacugaugcggaggggagacuugcccgugugguuagcgcauaaagucgccuccgaggguauuaaguacacagaucgcaaauggugcuucgacggccagcgaaacaaucagauccuggaagagaacauggauguggagauuuggacuaaggaaggggagaaaaagaagcucagaccucgguggcuggacgcuaggaccuauucugauccccuugcccugaaagaauuuaaggaguucgcagcuggacgcaaaucgaucgcccucgacuugguaacagaaauaggcagagugccaagccaccuggcacauaggacccggaaugcccuagauaaccugguuaugcuccacacuucagagcacggugggcgugcuuaccgccaugcggucgaggaacuuccugagacaauggaaacgcuguuauugcugggccucaugauccugcuuaccggaggcgccaugcuguuucucauuuccgggaagggaaucgguaaaacuaguauuggcuugaucugugugauagcaucuagcgggaugcuguggauggcugagauucccuuacaauggaucgccuccgccauugugcuagaguucuuuaugaugguccugcucaucccagaaccugagaagcagcgaacaccgcaggacaaucaacuugcauauguugugauaggaauccugaccuuggcugccauuaucgcggcuaacgaaaugggccugcucgagaccacaaagagagaucuggguaugucaaaagaacccgggguagugucuccaacuagcuaccuugacgucgaucuccacccugccagugcauggacgcuguaugccguggcuaccacaguuauuacucccauguugaggcauaccaucgagaauuccacagcaaacgugagccuggccgcgauagcuaaccaggccgucguauuaaugggccuagacaagggauggccaauuucuaaaauggaccugggcgugccucuccuugcacuggggugcuacucacagguuaaucccuugacccugacugccgcugugcuccugcuuaucacgcacuacgccaucauuggaccgggcuuacaggcaaaggcuacacgggaggcccaaaaacgcaccgcggccgguaucaugaagaacccaacugucgaugggauaaugaccauugaccuggauccugugaucuaugacuccaaguucgaaaaacagcucggacaggucauguugcuggugcuauguguugugcagcugcuccuuaugagaacaaguugggcacugugcgaggcuuugacucuggccaccggccccauuacaacgcucugggaagguagcccaggcaaguuuuggaauaccacuaucgcaguaucgauggcuaacauauucagggggucuuaccuggccggagccggcuuagcguuuuccaucaugaaaagcguggggacaggaaagcggggcaccgguucacaaggggagacucuuggagaaaaauggaagaagaaacugaaucagcucagucgaaaggauuucgaccuauauaaaaagucuggcauuacagaggucgauagaaccgaggcuaaagaaggucugaagcgcggcgagaucacgcaucacgcaguuuccagggggagcgccaaauugcagugguuuguggaacggaacauggucauucccgagggacgugugaucgaccugggcugugggagaggaggcuggucauacuauugcgcuggucucaagaagguaaccgaagugaggggguacacaaaaggaggcccuggccacgaggagccgguucccaugaguacuuauggguggaauauugugaagcuuaugagcggaaaagaugucuucuaccugccaccugaaaagugugacaccuugcugugcgauaucggugaguccucucccagcccuacaguggaagagucccgcacuauacggguccucaaaaugguggagccaugguuaaagaacaaucaguucuguauuaagguucugaaccccuacaugccuaccguaaucgaacaucuugagcgacugcaaagaaaacacggcgggaugcuagugaggaauccacucucacgcaacucuacacaugaaauguauuggaucaguaauggaaccggcaacauugucgccucggugaauaugguuagccggcuguugcugaacagauuuacuaugacgcaccguaggcccacaauagagaaggacguggaucucggugcagggacccggcacgucaacgccgaaccggagacuccuaauauggacaucauuggagagcgcaucaaacgaauuaaggaagagcauaacuccaccuggcacuacgacgaugaaaauccauauaaaacaugggcuuaccauggcucuuaugaggugaaggcgacgggcucagccagcuccaugaucaacgggguagugaagcuucugaccaaacccugggacguugucccuauggugacucagauggcaaugacagauaccacuccauucggacagcaaagaguguuuaaggaaaaagucgacacaaggaccccccggaguaugccggguacacgcagaguuaugggcauaacugcugagugguuauggaggacccuggggcgaaauaagaaaccucgguugugcacgcgugaggaauucaccaagaaggugagaacaaacgccgcaaugggagccguauuuacugaggaaaaucagugggauucugcuaaagccgcgguggaggacgaagauuucuggaagcucgucaacaaagagcgcgagcugcacaagcuaggcaaaugugguagcugcguguacaauaugauggggaagagggaaaaaaagcuuggagaguuuggcaaggcaaaaggcucacgggccaucugguauauguggcugggggcuagauaccucgaauucgaggcccugggauuuuugaacgaggaccauugguucucccgcgaaaauaguuacagcgguguugagggcgaagggcugcacaagcucggauauauucuuagggauaucucuaaaauucccggcggugcaauguacgcugacgauaccgccgggugggacacacgaaucacugaggacgaucugcacaacgaagagaagauaacccagcagauggacccagagcaucggcaauuagcuaaugccauuuuuaaacugacguaucagaacaagguggucaaggugcagagaccuacacccaccggaacuguaauggauaucaucuccaggaaagaccagcgcggcucaggccaaguugggacauacggauugaauaccuucacuaacauggaagcacagcucauucgucagauggagggugaaggcgugcugagcaaggcggaucuagagaacccacaccuucccgaaaaaaagauaacccaguggcuggagacaaaaggggucgagcggcucaagagaauggccaucucgggagacgauugcguggugaagccuauugacgauagguuugcuaaugcccuguuggcauuaaacgacaugggcaaaguccgcaaggauaucccacaauggcagccgucuaaagguuggcaugacuggcagcagguucccuucuguagucaccacuuccaugaacugauuaugaaggaugggcgaaaacucgugguaccuugccggccacaagacgagcuuaucggaagagcuaggauaucccagggcgccggcuggagccugaaggaaacggcaugucuagggaaggccuaugcgcagauguggucacugauguacuuucaccgcagagaccuccgguuggcuuccaaugccaucugcucugcagugcccguccauugggugccuaccagcaggacuacauggaguauucacgcccaucaccaauggaugaccacugaggauaugcugacaguuuggaaccguguguggaucgaagacaauccauggauggaggauaaaacccccgucacgacaugggagaacgugccuuaucuuggaaagcgagaagaccaguggugugguucccugauuggccucaccagccgcgcuacuugggcccagaauaucccgaccgcaauucagcaaguaagaucuuuaauagggaacgaggaauuccuggauuacaugccaucaaugaaacgguuuaggaaggaggaggaaagugagggagcuaucugguga

SEQ ID NO: 15335 - RNA, 9873 nt, Artificial Sequence
  derived and/or modified CDS sequence (opt3) from DENV-3__KF973476__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauauaggggaagauggauguugguacggcauggagauuaggccaaucuccgaaaaggaggagaauaugguuaaaucacuggugagcgccgguucuggcaagguagacaacuucaccauggggguguugugccucgcuauccuguuugaagaggucaugcgcggaaaguucggcaaaaagcacaugauugccgggguguucuuuacguucguucuacugcucuccggacagaucacuuggcgggauauggcacauacccugauuaugauaggcaguaaugcuagcgacagaauggguaugggggugacauaucuugccuugaucgcaaccuuuaaaauucagcccuuccuggccuuaggauuuuuccucaggcgccugacuucucgagaaaaccuucugcuaggcgucggccucgcuauggcgacaacccugcaauugccggaggauaucgaacagauggccaaugggauugcacugggauuaauggcucucaagcugaucacacaguuugagacuuaccagcuuuggaccgcccugauauccuugacguguucaaacacaaucuucacccucacuguggccuggcggaccgcuacacugauucuagcagguguuagucugcuuccugugugccaaagcucguccaugcguaaaacugacuggcucccaauggccgucgcggcuaugggcguacccccucugcccuuguuuaucuucucucugaaggauaccuuaaagagaaggagcuggccacucaaugagggggugauggccguuggacuggugucaauucuugcaaguucccuguugcgcaacgacgucccuauggccggcccccucguggcuggugggcugcuaaucgcauguuauguaauaacgggaacaucugccgaucugaccguggaaaaagcggcugacauuacuugggaggaagaggccgaacagacaggcgucagccacaaccuuaugaucaccguugacgaugacggcacuaugcggaucaaggaugacgagacagagaauauucucaccgugcuguugaaaacggcauuacugauaguguccgggaucuuuccauacucaauuccggccacucuccuggucuggcauaccuggcagaagcagacacaaagaagcggagugcuuugggauguuccuagucccccagaaacccagaaagcugagcuggaagaggguguauacaggaucaagcagcagggcauuuucgggaaaacacaagugggagucggcgugcagaaggaggguguuuuucacacuauguggcacgugacccgaggggccgucuugacguauaacggaaagcgccuagaacccaauugggcaucugugaaaaaggaccugaucuccuacggcggcggguggcggcucagcgcucaguggcaaaaaggagaggaaguacaggucauagccguggagccugguaagaacccaaaaaauuuccagacaaugcccggcacuuuccagaccacaaccggggaaaucggagcgauugcccuggauuuuaagccuggcacuucggguucaccgaucauuaacagagggggaaagguugugggccuuuauggcaauggggucgugaccaaaaacggagguuacguuucuggcaucgcacaaacaaaugcugagccagacgggcccacgccugaguuagaagaggaaauguucaagaaaaggaaccugacuauaauggaucuccauccaggaaguggcaagacccguaaauauuugcccgccauugugcgcgaggcuaucacacggagacugaggacccucauccuggcaccuacucgagucguggccgccgaaauggaggaggcucuuaagggucugccgauucgguaccagacaaccgcgacgaaguccgaacacacugggcgcgagaucguagacuugaugugccaugcaacauuuaccaugagacuacugagccccgugaggguuccaaauuauaaccucauaauuauggaugaagcccacuucaccgacccugcuucuaucgccgcacggggauacauuagcacucgagucggcaugggcgaggccgcugcgaucuuuaugacagccacccccccagggacagcagaugcuuucccucaguccaaugcccccauacaggacgaagagagagacauuccagagcgcucauggaacaguggaaaugaauggaucacugauuuugcagguaaaacggugugguucgugccgagcaucaaggccggcaacgacauugcuaacuguuuaaggaaaaaugggaagaaagucauccaacugucucguaagaccuuugauacagaguaccagaagacuaaacuuaacgacugggauuucguagugaccacagacauuuccgaaaugggagccaauuuuaaggcggaucggguuauagacccuagaaggugccugaaacccgugauccucaccgauggcccagagcgcgucauuuuggcaggucccaugccugugacugccgcuucagccgcucagcgaagagggcggguuggcaggaacccacagaaggagaaugaccaauauaucuucacgggacagccccugaacaaugaugaagaccaugcacacuggaccgaggccaaaaugcuccuggacaacaucaauacaccugaaggcauuauaccggcucuuuucgagccagaacgcgagaagagugccgcaguggauggggaguaccgucuaaagggagaaagcagaaaaacuuuugucgagcugaugcggaggggugacuugcccgugugguuagcgcacaagguagccuccgaaggcaucaaauauaccgaucgcaaguggugcuucgacgggcagcgaaacaaucagauucuggaggaaaacauggauguggagaucuggacaaaagagggagaaaagaaaaagcucagaccucgguggcuggacgcuaggaccuacucugauccccuugcccugaaggaguuuaaagaauucgcagcuggccgcaagucgauugcccucgacuugguuacugagaucgguagagucccaagccaucuggcacacaggacacggaaugcccuagauaaccuggugaugcuccauacgucagaacacgggggccgugcuuaucgccacgcgguggaggagcuuccugaaaccauggagacucuguuauugcugggacucaugauacugcuuacaggcggggccaugcuguuucucaucuccggaaaagguauuggcaagaccaguaucggguugauuugugucaucgcaucuagcggaaugcuguggauggcugaaauacccuuacaauggauugccuccgccaucguucuagaguucuuuaugauggugcugcucauuccagagccugaaaaacagcgaaccccgcaggacaaucaacuugcauacguagugaucggcauacugacauuggcugccaucauugcggcuaacgagaugggucugcucgaaacuacgaagagagaucuggggaugucaaaggagcccggcgucgugucuccaaccagcuaucuugacguugaucuccauccugccagugcauggacacuguacgccguggcuacuaccgucaucacacccauguugaggcacaccauugaaaauuccacugcaaacguaagccuggccgcgaucgcuaaccaggccgugguuuuaaugggacuagacaaaggcuggccaauaucuaagauggaccugggggugccucuccuugcacugggaugcuacucacaggucaaucccuugacgcugacagccgcugugcuccugcuuauuacccauuaugccaucaucggcccggguuuacaggcaaaagcuacucgggaggcccaaaagcgcaccgcggccgggauuaugaaaaacccaacagucgauggaaucaugacuauagaccuggauccugugauuuacgacuccaaguucgagaagcagcucggccagguuauguugcuggugcuaugugcaguacagcugcuccuuaugagaaccaguugggcucugugcgaagccuugacacuggcaacgggucccaucaccacucucugggagggcagcccagggaaauuuuggaauacaaccauugcugugucgauggccaacaucuucaggggaucuuaucuggccggcgcgggguuagcuuuuuccauaaugaagagcgucggaacuggcaaacgggguacagggucacaaggagaaacccuuggcgagaaguggaaacgaaagcugaaucagcucaguagaaaggauuucgaccuauacaaaaagucugguaucacggaaguugaucgcaccgaggcaaaagagggccugaagaggggggaaauuacacaccaugccgugucccggggaagcgcuaaauugcagugguuugucgagcguaacauggugauccccgaaggcagaguaauugaccugggguguggaaggggcgguuggucauauuacugcgccgggcucaagaaagugacugagguucgcggauauaccaagggcggcccugggcacgaagagccggugcccaugaguacauacggauggaauaucgucaagcuuaugagcgguaaagauguguucuaccugccaccugagaagugugacacuuugcugugcgauauuggcgaauccucucccagcccuaccgucgaggaaucccggacaauccgagugcucaaaaugguugagccaugguuaaagaacaaucaguucuguauaaaaguacugaaccccuauaugccuaccgugauugagcaccuugaaagacugcaaaggaagcaugggggaaugcuaguccgcaauccacucucacggaacucuacucacgagauguacuggaucaguaauggcacggguaacaucguggcaucgguuaauauggugagcagacuguugcugaaccguuuuacaaugacccauaggcggcccacuauugaaaaggacgucgaucucggggccggaacccgccacgugaacgcugagccggaaacaccuaauauggacguaauaggcgagcgaaucaaaagaauuaaggaggaacacaacuccacguggcauuaugacgaugagaauccauacaaaaccugggcguaucacggcucuuacgaagugaaggccacugggucagcaagcuccaugaucaacggaguugucaaacuucugacaaagcccugggacguggugccuauggucacccagauggcuaugacugauacaaccccauucggucagcaaaggguuuuuaaggagaaaguggacacacggacuccccgcaguaugccgggcaccagaaggguaauggggauuacggccgaaugguuauggcgaacccugggacggaauaagaaaccucguuugugcacaagagaggaguucacuaagaaagugcgcaccaacgcagccaugggcgcugucuuuacagaagagaaucagugggauucugccaaggcggcaguggaagacgaggauuucuggaagcucguugacagggaacgggagcugcauaaacuagguaagugugggagcugcguguauaacaugaugggaaaaagagagaagaaacuuggcgaauuuggcaaggccaaagggucacgcgcuaucugguacauguggcugggagccagguaccucgaguucgaagcacuggguuuuuugaaugaggaucacugguucucccgagagaacaguuauagcggcgucgaaggggagggacugcauaagcucggcuacauacuucgggacaucucuaagauucccgguggggcuauguaugccgaugacacugcuggaugggacaccagaaucacggaagaugaccugcacaaugaggaaaaaauuacacagcagauggauccagagcacaggcaauuagccaacgcaaucuuuaagcugaccuaccagaauaaagugguaaagguucagcgcccuacucccacaggcaccgugauggacauaauuucccguaaagaucagcggggcucagggcaagucggaacuuaugguuugaacaccuucacaaauauggaggcgcagcucaucagacagauggaaggcgagggggugcugagcaaggccgaccuagaaaacccauaccuucccgagaagaaaaucacgcaguggcuggaaaccaagggaguggagaggcucaaacgcauggcuauuucgggcgaugacugcgucguuaagccuauagaugaccgauuugccaacgcacuguuggcuuuaaaugauauggguaaagugcggaaggacaucccacaauggcagccgucuaagggguggcaugauuggcagcagguacccuucuguagucaccauuuccacgagcugauuaugaaagacggaagaaagcucguggucccuugcaggccacaagacgaacuuaucggccgcgccagaauuucccagggcgcaggguggagccugaaagagacugccugucuaggaaaggcguaugcucagauguggucacugauguacuuucaccggagggaucuccguuuggccuccaacgcaaucugcucugccgugcccguucauugggugccuacaagccgaaccacuuggaguauacacgcucaucaccaauggaugacaaccgaagacaugcugacggucuggaaucgcguguggaucgaggauaacccauggauggaagacaaaacacccguaaccacuugggagaauguuccuuaccuugguaagagagaggaucagugguguggcucccugauugggcucaccagccgggccacaugggcacagaacaucccgacugcuauucagcaagugaggucuuuaaucggaaaugaagaguuccuggacuauaugccaucaaugaagcgcuuuagaaaagaagaggagagugaaggcgccauuugguga

SEQ ID NO: 15336 - RNA, 9873 nt, Artificial Sequence
  derived and/or modified CDS sequence (opt3) from DENV-3__KF973478__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcagcaugaaaaucugaaguauacugucauuaucaccgugcacacaggugaccagcaucagguuggcaacgagacccaaggggugacugcagaaauuacgccucaggcuuccacaaccgaggccauccucccagaauacggaacucuuggccuggagugcucuccgcgaaccgguuuggacuucaaugagaugauccuacugacaaugaaaaacaaggcguggaugguccacagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcauacagcucucaccggcgccacagaaauucagaauucagggggaacuaguauauucgcaggucaccugaagugucgguuaaaaauggacaagcuggagcuaaaaggcaugagcuaugccaugugcaccaacacguuuguccucaagaaagaggugucugaaacccagcaugggacaauccugauuaaggucgaguacaagggagaagaugugcccuguaaaaucccuuucuccacugaggacggccaagguaaggcucacaacgggcgucuuauaaccgcgaauccaguugugacaaaaaaggaggaacccguaaacauugaggcagaaccgccuuucggcgagucaaauaucgucaucggaauuggcgauaacgccuugaaaaucaauugguacaagaaggggagcaguauuggaaaaauguuugaagcuacugcccgcggugcaagaaggauggccauacugggcgacaccgcuugggauuucgggucugugggaggcguucucaacucccuggguaagauggugcaucagaucuuugggagcgccuauacggcacuuuucucgggcgucucuugggugaugaaaauuggaaucggcguacuguugacauggaucgggcucaauuccaagaacaccucaaugaguuuuagcugcauugcgauaggaaucauuacucuguacuuaggcgcugugguucaggccgacauggguugugucaucaauuggaaagggaaggagcugaagugcggauccggcauuuucgugacaaacgaggugcacaccuggacugaacaguauaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuacauuuugugggaaaauaacaucaagcugaccguuguggugggagacauuaucggcguacucgagcaggggaaaagaacucugacaucacagccaauggaguuaaaguauaguuggaaaaccuggggaaaggccaagauagucacagcggaaacucaaaacuccagcuucauuaucgauggcccuaauacccccgagugcccaucugugucaagggccuggaacguuugggaaguggaggacuacgguuuuggggucuucacgacaaauauuuggcugaaacuucgggaaguguauacccaguugugugaccaccgccucaugagugcugcaguuaaggaugagagagccgugcaugcugacaugggauacuggaucgagagccagaaaaacggcuccuggaagcuggaaaaagccucucuaauagagguaaagacuugcaccuggcccaagucgcacacacuguggagcaaugguguccucgaauccgauaugaucauuccuaaaucacuggcaggcccaaucagucagcauaaccacaggccgggguaccacacucaaaccgcgggacccuggcaucuuggcaaguuggagcuggacuuuaauuauugcgaggggacaacgguggugauuaccgaaaacuguggaacucguggcccuucuuuacggacaaccacugucagcgguaaacucauccacgaguggugcugucgauccugcacacugccaccccuuagauacaugggggaagauggauguugguauggcauggagauaaggccuauuucagaaaaggaggagaauaugguuaaaagccuggugucugccgguuccggcaagguagacaacuucaccauggggguguugugccucgcuauccuguuugaagaggucaugcgcggaaaguucggcaaaaagcauaugaucgccgggguguucuuuacguucguucuacugcucaguggacagauuacuuggcgggauauggcacacacccugaucaugauuggcagcaaugcuucugacagaauggguaugggggugacauaccuugccuugauagcaaccuuuaaaauccagccauuccuggccuuaggauuuuuccucaggaagcugacuucccgcgaaaaccuucugcuaggcgucggccucgcuauggcgacaacccugcaauugcccgaggauauugaacagauggccaaugggaucgcacugggauuaauggcucucaaacugauuacacaguuugagacuuaucagcuuuggaccgcccugaucucauugacguguaguaacacaauauucacccucacuguggccuggcgaaccgcuacacugauccuagcagguguuagccugcuuccggugugccaaucguccucuaugcggaagacugacuggcucccuauggccgucgcggcuaugggcguaccaccccugccuuuguuuauuuucgggcugaaggauaccuuaaaacguagaagcuggccccucaaugagggagugauggccguuggccuggugucaauccuugcaaguucccuguugaggaacgacgucccaauggccgguccucucguggcugggggacugcuaauugcauguuacguaaucacgggcacaucugccgaucugaccguggaaaaggcggcugacauaacuugggaggaagaggccgaacagacaggcgucagccauaaccuuaugauuaccguugacgaugacgggacuaugcgcaucaaagaugacgagacagagaauauccucaccgugcuguugaagacggcauuacugauuguguccggaauauuucccuauucaaucccagccacucuccuggucuggcacaccuggcagaaacagacacaacggagcggugugcuuugggauguuccgaguccucccgaaacccagaaggcugagcuggaagagggcguauacagaauuaaacagcaggggaucuucggaaagacacaagugggcgucggugugcagaaggaggggguuuuucacacuauguggcaugugaccaggggagccgucuugacguacaacggcaaacgacuagaaccaaauugggcaucugugaagaaagaccugauuuccuauggcgggggauggcgccucagcgcucaguggcaaaagggugaggaaguacaggucaucgccguggagcccggcaaaaacccuaagaauuuccagacaaugccagggacuuuccagaccacaaccggagaaauaggcgcgaucgcccuggauuuuaagcccgguacuucggggucaccuauuaucaaccgggagggaaaaguugugggccuuuacggcaauggggucgugaccaagaacggagguuauguuucuggcauugcacaaacaaaugcugagccggacgggccaacgcccgaauuagaggaagagauguucaaaaagagaaaccugacuaucauggaucuccacccuggaaguggcaaaaccaggaaguacuugccagccauagugcgugaagcuauuaagcgccggcugagaacacucauccuggcacccaccagggucguggccgccgagauggaggaagcucuuaaaggucugccuauccgauaucagacuacagcgaccaaguccgagcauacggggcgggaaauuguagacuugaugugccacgcaacuuuuacaaugcgccuacugagcccggugagaguucccaauuacaaccucaucauaauggaugaggcccauuucaccgacccagcuucuauugccgcaaggggauauaucagcacccgggucggcaugggcgaagccgcugcgauuuuuaugacugccacaccucccgggaccgcagaugcuuucccacaguccaaugccccuauccaggacgaggagcgagacauacccgaaagaucauggaacaguggaaaugaguggauuacagauuuugcagguaaaacugugugguucgugccaagcaucaaggccggcaacgacaucgcuaacuguuuacgcaaaaaugggaagaaggucauucaacugucuaggaaaacguuugauaccgaauaccagaagacaaaacuuaacgacugggauuucguagugacuaccgacaucuccgagaugggagccaauuuuaaggcggaucguguuauugacccgcggagaugccugaaaccugugauacucacagauggccccgagagggucaucuuggcagguccaaugcccgugaccgccgcuucagccgcucagcgccgagggagaguuggccggaacccucagaaggaaaaugaccaauacauuuucacuggacagccacugaacaaugaugaggaccacgcacacuggacggaagccaagaugcuccuggacaacaucaauacccccgagggcaucauuccugcucuuuucgaaccggagagggagaaaagugccgcaauagauggggaauaucgccuaaagggagagagccguaaaacauuuguggaacugaugagacggggugacuugccagucugguuagcgcauaagguggccuccgagggcaucaaauacacugauaggaaguggugcuucgacgggcagcgcaacaaucagauucuggaagagaacauggauguagagaucuggaccaaagaaggagagaagaagaaacuccgacccagauggcuggacgcucggacauauucugauccucuugcccugaaggaauuuaaagaguucgcagcuggcaggaagucgauugcccucgacuuggugaccgaaaucggucgcguucccagccaccuggcacauagaacuaggaaugcccuagauaaccuggucaugcuccacacaucagagcacgggggccgggcuuaccgucaugcgguggaggaacuuccagagacgauggaaacccuguuauugcugggacucaugauacugcuuacuggcggggccaugcuguuucucaucuccggaaaagguauuggcaagacaaguaucggguugauuugugugaucgcaucuagcggaaugcuguggauggcugagauaccuuuacaauggauugccuccgccaucguccuagaguucuuuaugaugguucugcucauucccgaaccagagaagcagcgcaccccucaggacaaucaacuugcauaugugguaaucggcauacugaccuuggcugccaucauugcggcuaacgaaaugggucugcucgagacaacuaaacgagaucuggggaugucaaaggaaccgggcguggucucucccacgagcuaccuugacguggaucuccacccagccagugcauggacccuguaugccguugcuacaacugugaucaccccuauguugagacauacaauugagaauuccaccgcaaacgucagccuggccgcgaucgcuaaccaggccguaguguuaaugggacuagacaaaggcuggcccauaucuaagauggaccuggggguuccacuccuugcacugggaugcuacucacaggugaauccuuugacucugacggccgcuguccuccugcuuauuacacacuacgccaucaucggccccgguuuacaggcaaaagcuaccagggaggcccaaaagcggacugcggccgggauuaugaagaacccgaccguggauggaaucaugacaauagaccuggauccagucauuuaugacuccaaauucgaaaagcagcucggccaggugauguugcugguucuaugugcagugcagcugcuccuuaugcgcacuaguugggcucugugcgaggccuugacccuggcaacagguccuaucacgacccucugggaaggcagccccgggaaauuuuggaauacuacaauugcuguaucgauggccaacaucuucagaggaucuuaccuggccggcgcgggguuagcuuuuuccauaaugaagagcgugggaaccggcaaaagggguacugggucacaaggagagacacuuggcgaaaaguggaagaaaaagcugaaucagcucagucggaaagauuucgaccuauauaagaaaucugguaucaccgaggucgaucgaacggaggcaaaggaaggccugaaaagaggggagauuacccaucacgccguuucccgcggaagcgcuaaguugcagugguuuguggaaaggaacauggucaucccagagggccgggugauugaccugggguguggacguggcgguuggucauacuauugcgccgggcucaagaaaguaacagaagugagaggauacacuaagggcggccccgggcacgaggagccuguuccgaugaguaccuauggauggaauaucgugaaacuuaugagcgguaaggaugucuucuaccugcccccagaaaaaugugacacauugcugugcgauauuggcgaguccucuccuagccccacuguggaagaguccaggaccauccgcguccucaagaugguggagccuugguuaaagaacaaucaguucuguauaaaaguucugaacccauacaugcccacaguaauugaacaucuugagcggcugcaacgaaagcacgggggaaugcuagugagaaauccucucucaaggaacucuacccaugaaauguauuggaucaguaauggcacugguaacaucgucgcaucggugaauaugguuagccgccuguugcugaaccgguuuacgaugacacacagacguccaaccauugagaaagacguggaucucggggccggaacuaggcacgucaacgcugaacccgagaccccgaauauggacgugauaggcgagcggaucaagcgcauuaaagaagagcauaacuccacauggcacuacgacgaugaaaauccuuauaagacgugggcguaccauggcucuuaugagguaaaggccaccgggucagcaagcuccaugaucaacggagugguuaaacuucugacuaagccaugggacgucgugcccauggugacacagauggcuaugaccgauacuacaccuuucggucagcaacgagucuuuaaagaaaagguugacaccagaacaccaaggaguaugcccggcacucggcgcgugauggggauuaccgccgagugguuauggagaacgcugggaaggaauaaaaagccgcgauugugcacccgggaggaauucacaaagaaaguacguacuaacgcagccaugggcgcuguguuuaccgaggaaaaucagugggauucugccaaggcggcagucgaggacgaagauuucuggaaacucguggacagagagcgcgagcugcacaagcuagguaaaugugggagcugcguuuacaacaugaugggaaagagggaaaaaaagcuuggcgaguuuggcaaggccaaagggucacgggcuaucugguauauguggcugggagccagauaccucgaauucgaggcacuggguuuuuugaaugaggaucauugguucucccgcgaaaacaguuacagcggcguggagggggaaggacugcacaggcucggcuauauacuucgagacaucucuaagauuccugguggggcuauguacgccgaugacacagcuggaugggacacucggaucaccgaggaugaccugcacaaugaagagaaaauuacgcagcagauggaucccgagcauagacaauuagccaacgcaaucuuuaagcugacauaucagaauaaagucgugaagguacagaggccaaccccuacuggcacaguuauggacauaauuucccgcaaggaucagcguggcucagggcaagugggaaccuacgguuugaacacuuucaccaauauggaagcgcagcucauccggcagauggagggcgaagggguccugagcaaagccgaccuagagaacccccaccuuccagaaaagaaaaucacacaguggcuggagacgaagggaguggagagacucaaaaggauggcuauuucgggcgaugacugcguggucaagcccauagaugaccgcuuugccaacgcacuguuggcuuuaaaugauauggguaagguucgaaaagacaucccucaauggcagccaucuaagggguggcaugauuggcagcaggugccguucuguagucaccacuuccaugaacugauuaugaaagacggacggaagcucguagugcccugcagaccucaagacgagcuuaucggcagggcccgcauuucccagggcgcaggguggagccugaaagaaaccgccugucuaggaaaggcguaugcucagauguggucacugauguacuuucacagacgggaucucagguuggccuccaacgcaaucugcucugccgucccagugcauuggguucccacuagccguacaaccuggaguauacacgcucaucaccaauggaugacuacagaggacaugcugaccguguggaaucgagucuggaucgaagauaacccuuggauggaggacaagacgccagugacaaccugggagaauguacccuaucuugguaaacgcgaagaucagugguguggcucccugauugggcucacuagcagagccaccugggcacagaacaucccuacagcuauucagcaaguucggucuuuaaucggaaaugaggaauuccuggacuacaugccgucaaugaagagguuucgcaaagaggaggaaagugagggcgccauuugguga

SEQ ID NO: 15337 - RNA, 9873 nt, Artificial Sequence
  derived and/or modified CDS sequence (opt3) from DENV-3__KF973479__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaaucuggggggaacuucaauauucgcaggucauuuaaagugucggcugaaaauggacaagcuagagcucaaaggcaugaguuacgccaugugcaccaacacguuuguccugaagaaagaggugagcgaaacccagcacgggacaauccuuauuaaggucgaguacaagggagaagaugcucccuguaaaaucccuuucucuacugaggacggccaagguaaggcgcauaacgggcguuugauaaccgcaaauccagugguuacaaaaaaggaggaacccgugaacauugaggccgaaccgccuuucggcgaguccaauaucguaaucggaauuggcgauaacgcucugaaaaucaauugguauaagaaggggucaagcauuggaaaaauguuugaagccacugcacgcggugccagaaggauggcuauacucggcgacaccgccugggauuucgggagugucggaggcgugcugaacucucuugguaagaugguucaccagaucuuuggguccgcauacacggcgcuguucagcggcgugucgugggucaugaaaauuggaaucggcguguugcucacauggaucgggcugaauucuaagaacaccuccaugucauuuaguugcauugcuauaggaaucauuacuuuauaucugggcgccguagugcaggcagacauggguuguguuaucaauuggaaagggaaggagcuaaagugcggaagcggcauuuucgucacaaacgaggugcauaccuggacugaacaguacaaauuucaagccgauucccccaagcggcucgcuaccgccaucgcaggugcuugggagaauggcgugugugggauacgaucuacaacgcgcauggaaaaccugcuuuggaaacagaucgccaaugaguugaacuauauucugugggaaaauaacaucaagcucaccgucguugugggagacauuaucggcgugcuggagcaggggaaaagaacuuuaacaccacagccuauggagcugaaguacagcuggaaaaccuggggaaaggcgaagauaguaacagccgaaacucaaaacucaaguuucauuaucgauggccccaauaccccagagugccccuccgucagcagggcuuggaacgugugggaaguugaggacuaugguuuugggguguucacgacaaauauuuggcuuaaauugcgggaagucuacacccagcucugugaccaccgccugaugucugcagccgugaaggaugagagagcuguucacgccgacaugggauacuggaucgagucacagaaaaacggcaguuggaagcuagaaaaagcaagccugauagaggugaagacuugcaccuggccuaagucccauacacucuggucuaaugguguacuggaaucggauaugaucauuccaaaaagccuugcgggcccgaucucccagcacaaccauaggcccggguaucacacucaaaccgccggaccuuggcacuugggcaagcuggaguuagacuuuaauuacugcgaggggacaacggucgugauuaccgaaaacuguggaacucguggcccaucacuccggacaaccacugugagugguaaacugauccaugaguggugcugucgaucuugcacacuucccccucugagauauaugggggaagauggauguugguacggcauggagauaaggccaauuagcgaaaaggaggagaauauggucaaauccuugguuucagcugguagcggcaagguggacaacuucaccauggggguacucugccuggccauccuauuugaagaggugaugcgcggaaaguucggcaaaaagcacaugaucgcaggggucuucuuuacguucgugcugcuccugucuggacagauuacuuggcgggauauggcucauacccuuaucaugauuggcuccagugccagcgacagaauggguauggggguuacauauuuggcacugauagccaccuuuaaaauccagcccuucuuagcucucggauuuuuccugaggaagcuuacuucucgcgaaaaucugcuacucggcgugggccuggcgauggccacaaccuugcaacugccggaggauauugaacagauggcaaacgggaucgcuuuaggacucauggcccugaaacuuauuacacaguuugagacuuaccagcuguggaccgccuugaucucccucacguguucaaauacaauauucacccugacugucgcuuggcgaaccgcaacacuaauccuggccggugugagucuucucccuguuugccaaagcucguccaugcggaagacugacuggcugccaauggcgguggcugccaugggcguccccccuuugccccuguuuauuuucggguuaaaggauacccucaaacguagaucuuggccacugaacgagggaguaauggcagugggccuuguuagcauccuggccucaaguuugcucaggaaugacgugccuauggcugguccccuggucgcagggggacuacugauugccuguuaugugaucacgggcacauccgcggaucuuaccguagaaaaggcugccgacauaacuugggaggaagaggcagaacagacaggcgugucucacaaccucaugauuaccgucgacgaugacgggacuaugcgcaucaaagaugacgagacagagaacauccugaccguuuuguuaaagacggcccugcucauugugagcggaauauuuccauacuccaucccggcuacucugcuuguguggcauaccuggcagaaacagacacaacggucagguguccugugggaugugccuagccccccagaaacccagaaggccgaguuggaagagggcguuuacagaauuaaacagcaggggaucuucggaaagacacaaguaggcguggguguccagaaggaggggguguuucacacuauguggcacguuaccaggggagcagugcuaacguauaauggcaaacgacuggaacccaacugggcuagugucaagaaagaccucauuucuuacggcgggggauggcgccuguccgcccaguggcaaaagggugaggaagugcagguaaucgcggucgagccuggcaaaaauccaaagaacuuccagacaaugcccgggacuuuccagaccacaaccggagaaauaggcgccaucgcacuugauuuuaagccugguacuagcgggucgccgauuaucaaucgggagggaaaagugguuggcuuauauggcaacgggguggucaccaagaauggagguuacgugucaggcauugcucaaacaaacgccgagccagacgggcccacgccugaacuggaggaagagauguucaaaaagagaaaucucacuaucauggauuugcauccaggaucuggcaaaaccaggaaguaucugcccgcuauaguucgugaagcaauuaagcgccggcucagaacacugauccuugccccuaccaggguggucgccgcugagauggaggaagcgcugaaagguuugccgauccgauaccagacuacagcaaccaagagugagcacacggggcgggaaauuguggaccuaaugugccaugccacuuuuacaaugcgccugcucucccccguaagagugccaaacuauaauuuaaucauaauggaugaggcucacuucaccgacccugccagcauugcagccaggggauacaucucuacccggguuggcaugggcgaagcugcggccauuuuuaugacugcaacacccccagggaccgcugaugccuucccucagagcaacgcacccauccaggacgaggagcgagacauaccagaaagauccuggaauucaggaaacgaguggauuacagauuuugccgguaaaacugucugguucgugccgaguaucaaggcuggcaaugacaucgccaacugucugcgcaaaaacgggaagaaggugauucaacuuagcaggaaaacguuugauaccgaauaccagaagacaaaacugaaugacugggauuucgucguaacuaccgacaucucugagaugggagcgaacuuuaaggcagaucgugugauugacccucggagaugccucaaacccguuauauugacagauggcccagagagggugauccuggccggucccaugccugucaccgcugccuccgcugcacagcgccgagggagagugggccggaauccacagaaggaaaacgaccaauauauuuucacuggacagccccucaauaacgaugaggaccaugcccacuggacggaagcuaagaugcugcuugacaauaucaacaccccugagggcaucauuccggcccuauucgaaccagagagggagaaaucagcagcgauagauggggaauaccgccugaagggagagagucguaaaacauuuguugaauugaugagacggggugacuuacccguguggcuggcccacaaggucgcuagcgagggcaucaaauauacugauaggaaguggugcuucgacgggcagcgcaauaaccagauucucgaagagaauauggauguggagaucuggaccaaagaaggagagaagaagaaacugcgaccuagauggcuugacgcccggacauacuccgauccccuggcacucaaggaauuuaaagaguucgcugccggcaggaagucuauugcauuggaccugguaaccgaaaucggucgcgugccaucgcaucuagcccacagaacuaggaacgcucuggauaaucucguuaugcuucauacaagcgagcacgggggccgggcguaucgucacgccgucgaggaacugccugagacgauggaaaccuuauugcugcucggacugaugauacuucugacuggcggggcaaugcucuuuuugaucucaggaaaagguauuggcaagacauccaucgggcugauuugugugaucgcuaguucuggaauguuauggauggccgagauaccccuacaauggauugccagcgcaaucgugcuggaguucuuuaugaugguccuccuuauuccagaaccugagaagcagcgcaccccgcaggacaaccaacuggcuuacguugugaucggcauauugacccuggccgcgaucauugcugccaaugaaaugggucuccuggagacaacuaaacgagaucuugggauguccaaggaacccggcguagugucaccaacgucuuaucucgacgucgaucugcauccugcaagcgccuggaccuuguacgcuguggcaacaacuguuaucacccccaugcugagacacacaauugagaacaguaccgccaauguguccuuagcggcuaucgccaaccaggcagucguacuaaugggacuggacaaaggcuggccaauaagcaagauggaccucggggugccucuucuggccuugggaugcuacucucagguuaacccccugacucucacggcugccgugcugcuuuuaauuacacauuaugcaaucaucggcccgggucugcaggcuaaagccaccagggaggcgcaaaagcggacugccgcagggauuaugaagaauccaaccgucgauggaaucaugacaauagaccucgauccugugauuuacgacucaaaauucgaaaagcaguugggccaggucaugcugcuagugcugugugcuguucagcuccuucugaugcgcacuuccugggccuugugcgaggcacugacccucgcuacaggucccaucacgacccugugggaaggcaguccagggaaauuuuggaacacuacaauugccgugagcauggccaauaucuucagaggaucguauuuagcgggcgcugggcuugcauuuucuauaaugaaguccguaggaaccggcaaaagggguacugggagccaaggagagacacugggcgaaaaguggaagaaaaagcucaaccagcuaucacggaaagauuucgaccuguacaagaaaagugguaucaccgagguggaucgaacggaggccaaggaaggcuugaaaagaggggagauuacccaccaugcugucucucgcggauccgccaagcugcagugguuuguugaaaggaauauggugauccccgagggccgggucauugaccucggguguggacguggcgguuggagcuauuacugcgcagggcuuaagaaagugacagaaguaagaggauauacuaagggcggcccugggcacgaggagccggugcccaugucaaccuacggauggaacaucguuaaacugaugagugguaaggauguguucuacuugccaccugaaaaaugugacacacugcucugcgauauuggcgagagcucccccucuccuacugucgaagagagcaggaccauccgcguguuaaagauggucgagccauggcugaagaauaaccaguucuguauaaaagugcuuaaucccuauaugccuacaguuauugaacaccuggagcggcuacaacgaaagcaugggggaaugcucguaagaaacccacuguccaggaauucaacccacgaaauguacuggaucucuaacggcacugguaauaucguggccagugucaacauggugucgcgcuugcugcucaaucgguuuacgaugacacauagacgucccaccauugagaaagacguugaucuuggggcuggaacuaggcacgugaacgcggaaccggagaccccuaacauggacgucauaggcgagcggaucaagcgcauuaaagaagagcacaauagcacauggcauuaugacgaugaaaacccauacaagacgugggccuaucacggcuccuacgaggugaaggcaaccgggucugcuucaagcaugaucaauggaguagugaaacuguuaacuaagcccugggacguugucccuauggugacacagauggccaugaccgauacuacaccauucggucagcaacgaguguuuaaagaaaaggucgacaccagaacacccagguccaugccgggcacucggcgcguuauggggauuaccgcagaguggcuguggagaacguugggaaggaacaaaaagccucgacucugcacccgggaggaauucacaaagaaagugcguacuaaugccgcuaugggcgccguauuuaccgaggaaaaccagugggauagugcgaaggcagccguggaggacgaagauuucuggaaacuggucgacagagagcgcgagcuacauaagcuugguaaaugugggucuugcguguauaauaugaugggaaagagggaaaaaaagcugggcgaguuuggcaaggcuaaagggagccgggccaucugguacauguggcucggagcaagauaccuggaauucgaggcuuuggguuuucugaacgaggaucacugguucucacgcgaaaauuccuauaguggcguugagggggaaggacuccauaagcuuggcuacauacugagggacaucagcaaaauucccgguggggccauguaugcugaugacacagccggaugggacacucgaaucaccgaggaugacuuacacaacgaagagaagauuacgcagcagauggauccagagcaccggcaacuggcaaaugcgaucuuuaaauugacauaccagaacaagguggucaaggugcagagaccuacccccacuggcacaguaauggacauaauuucuaggaaagaucagcgcggcuccgggcaaguuggaaccuauggucucaauacuuucaccaacauggaagcccagcugauccgucagauggagggcgaaggggugcuaucaaaggcugaccuugagaauccacaucugcccgaaaaaaagaucacacaguggcucgagacgaaaggagucgagcggcugaagagaauggccauuagcggcgaugacugcguggugaagccuauagaugacagguuugcaaacgcuuuguuagcccugaacgauauggguaaaguccgcaaggacaucccacaauggcagccgucgaaaggguggcacgauuggcagcagguucccuucuguucucaucacuuccacgaacucauuaugaaggacggacgaaaacuugugguaccuugccggccacaagacgagcugaucggcagagcaaggauuagucagggcgccggguggucccuaaaggaaaccgcgugucugggaaaggcuuacgcccagauguggagccucauguauuuucaucgcagagauuugcggcuggcaucaaaugccaucugcuccgcugugcccguccacugggugccuacuucuaggacaaccuggagcauacaugcccaccaucaauggaugacuacagaggacaugcuuaccguuuggaaccguguguggaucgaagauaauccauggauggaggacaaaacgcccgucacaaccugggagaacgugccuuaccuggguaagcgagaagaucagugguguggcagucucauuggguuaacuucccgcgcaaccugggcucagaauaucccgacagccauucagcaaguaagaagccugaucggaaacgaggaauucuuggacuacaugccaucuaugaaacgguuuaggaaggaggaggaaucagagggcgcgauuugguga

SEQ ID NO: 15338 - RNA, 9873 nt, Artificial Sequence
  derived and/or modified CDS sequence (opt3) from DENV-3__KF973480__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaccuuacugaugcuugucacaccaucgaugaccaugcgcugugugggcguagggaacagagacuuuguugaaggauugucaggugccacguggguggaugucgugcuggagcacggcgggugcgugacuacaauggcgaagaauaaacccacccuagacaucgagcuccagaagacugaagcaacacaacuggccacccuuaggaaacuguguauugagggaaagaucacgaacauuaccacagauagccggugcccuacucagggcgaagcuaccuugccagaggaacaggaccagaauuaugucuguaaacacacauacguugaucgcgguugggggaacggaugcggccucuucggcaaggggagucuggugacuugcgccaaguuucaauguuuagagcccaucgagggaaaaguagugcaguaugaaaaucugaaguacaccgucauaauuacagugcauaccggugaccagcaccagguuggcaacgagacucaaggggugacggcagaaaucacaccucaggcuuccaccacugaggccauucucccagaauauggaacccuuggccuggagugcucuccgcgaacagguuuggacuucaaugagaugauccuacugaccaugaaaaacaaggcguggaugguccauagacagugguuuuucgaucucccccugccuuggacuagcggggccacaacggaaaccccaacuuggaauaggaaagagcuucuggugacauuuaagaacgcacacgcuaaaaagcaagaaguaguuguguugggcucccaggagggagccaugcacaccgcucucacaggcgccacugaaauccagaauucagggggaaccaguauuuucgcaggucaucugaagugucgguuaaaaauggacaagcuggagcuaaaaggcaugagcuacgccaugugcacgaacaccuuuguccucaagaaagaggugucugaaacacagcacgggacuauacugaucaaggucgaguacaagggagaagaugugcccuguaaaauuccuuucuccaccgaggacggccaagguaaggcucauaacgggcgucuuaucacagcgaauccaguugugacuaaaaaggaggaacccguaaacauagaggcagaaccgccuuucggcgagucaaauauugucaucggaaucggcgauaacgccuugaaaauuaauugguauaagaaggggagcaguaucggaaaaauuuuugaagcuaccgcccgcggugcaagaaggauggccauacugggcgacacggcuugggauuucgggucugugggaggcguucucaacucccuggguaagauggugcaccagaucuuugggagcgccuacacagcacuuuucucgggcgucucuugggugaugaaaauuggaaucggcguacuguugaccuggaucgggcucaauuccaagaacacuucaaugaguuuuagcugcauugcgauaggaaucauuacacuguauuuaggcgcugugguucaggccgacauggguugugucaucaauuggaaagggaaggagcugaagugcggauccggcauuuucgugaccaacgaggugcauacuuggaccgaacaguacaaauuucaagcagauucucccaagcggcuagccacagcuaucgccggugcaugggagaauggcgucugugggauacgaagcacgacccgcauggaaaaccuccuguggaaacagaucgcuaaugagcuuaacuauauuuugugggaaaauaacaucaagcugacuguuguggugggagacauuaucggcguacucgagcaggggaaaagaacacugaccccacagccuauggaguuaaaguacucauggaaaacauggggaaaggccaagauagucacugcggaaacccaaaacaguuccuucauuaucgauggccccaauacgccagagugccccagcgugucuagggccuggaacguuugggaaguggaggacuaugguuuuggggucuucacaaccaauauuuggcugaaacuucgggaaguguacacucaguugugugaccaccgccucaugucagcugcaguuaaggaugagagagccgugcacgcugacaugggauacuggaucgagagucagaaaaacggcagcuggaagcuggaaaaagccucccuaauagagguaaagaccugcacauggccuaagucucauacucuguggucgaaugguguccucgaaagcgauaugaucauuccaaaaucccuggcaggcccgaucucacagcacaaccauaggcccggguaucacacccaaacagcgggaccuuggcaccuuggcaaguuggagcuggacuuuaauuacugcgaggggacgaccguggugauuacugaaaacuguggaacacguggcccaaguuuacggaccacuacagucucugguaaacucauccaugaguggugcugucgaagcugcacccugcccccucuuagauauaugggggaagauggauguugguacggcauggagauaaggccaauuuccgaaaaggaggagaauaugguuaaaucacuggugagcgccgguucuggcaagguagacaacuucacgauggggguguugugccucgcuauccuguuugaagaggucaugcgcggaaaguucggcaaaaagcacaugaucgccgggguguucuuuacuuucgcacuacugcucuccggacagauuaccuggcgggauauggcucauacacugaucaugauuggcaguaaugccagcgacagaauggguauggggguuaccuaucuugcauugauagccacuuuuaaaauccagcccuuccuggcuuuaggauuuuuccucaggaagcugacaucucgcgaaaaccuucugcuaggcgugggccucgcgauggccaccacacugcaauugccggaggauauugaacagauggcaaaugggaucgcucugggauuaauggcccucaaacugauuacucaguuugagaccuaccagcuuuggacggcccugaucuccuugacauguucaaacaccauauucacucucaccgucgcuuggcgaacagcaacucugauccuagccggugugagucugcuuccuguuugccaaagcucguccaugcggaagaccgacuggcucccaauggcgguggcugccaugggcguccccccucugcccuuguuuauuuucgggcugaaggauacguuaaaacguagaucuuggccacucaaugagggaguaauggcagugggccugguuagcauccuugccucaagucuguugaggaacgacgugccuauggcugguccccucgucgcagggggacugcuaauugccuguuaugugaucacaggcaccuccgcggaucugacuguagaaaaggcugccgacauaacaugggaggaagaggcagaacagaccggcgugucucacaaccuuaugauuacugucgacgaugacgggacaaugcgcaucaaagaugacgagaccgagaauauccucacgguucuguugaagacugccuuacugauugugagcggaauauuuccauacuccaucccggcuacccuccugguguggcauacauggcagaaacagacccaacggucagguguccuuugggaugugccuagccccccagaaacacagaaggccgagcuggaagagggcguuuacagaauuaaacagcaggggaucuucggaaagacucaaguaggcguggguguccagaaggaggggguguuucacaccauguggcacguuacgaggggagcaguguugacauauaacggcaaacgacuagaacccaauugggcuagugucaagaaagaccugauuucuuacggcgggggauggcgccucuccgcccaguggcaaaagggugaggaagugcagguaaucgcggucgagccuggcaaaaacccaaagaauuuccagacuaugcccgggaccuuccagacaaccacuggagaaauaggcgccaucgcacuggauuuuaagccugguaccagcgggucgccgauuaucaaccgggagggaaaagugguuggccuuuauggcaaugggguggucacaaagaacggagguuacgugucaggcauugcucaaacgaaugccgagccagacgggcccacuccugaauuagaggaagagauguucaaaaagagaaaccugaccaucauggaucuccauccaggaucuggcaaaacaaggaaguauuugcccgcuauaguucgugaagcaauuaagcgccggcugagaacccucauccuggccccuacuaggguggucgccgcugagauggaggaagcgcuuaaaggucugccgauccgauaccagacaaccgcaacgaagagugagcacacugggcgggaaauuguggacuugaugugccaugccacauuuaccaugcgccuacugucccccguaagagugccaaauuauaaccucaucauaauggaugaggcucacuucaccgacccugccagcauugcagccaggggauacaucucuacucggguuggcaugggcgaagcugcggccauuuuuaugacagcaacccccccagggacagcugaugccuucccucagagcaaugcacccauccaggacgaggagcgagacauaccagaaagauccuggaacucaggaaaugaguggauuacugauuuugccgguaaaacggucugguucgugccgaguaucaaggcuggcaacgacaucgccaacuguuuacgcaaaaaugggaagaaggugauucaacugagcaggaaaaccuuugauacagaauaccagaagacuaaacuuaacgacugggauuucgucguaaccacagacaucucugagaugggagcgaauuuuaaggcagaucgugugauugacccucggagaugccugaaacccguuauacucaccgauggcccagagagggugaucuuggccggucccaugccugucacugcugccuccgcugcacagcgccgagggagagugggccggaacccacagaaggaaaaugaccaauauauuuucacgggacagccccugaacaaugaugaggaccaugcccacuggaccgaagcuaagaugcuccuggacaacaucaauacaccugagggcaucauuccggcccuuuucgaaccagagagggagaaaucagcagcgauagauggggaauaccgccuaaagggagagagucguaaaacuuuuguugaacugaugagacggggugacuugcccgugugguuagcccacaaggucgcuagcgagggcaucaaauauaccgauaggaaguggugcuucgacgggcagcgcaacaaucagauucuggaagagaacauggauguggagaucuggacaaaagaaggagagaagaagaaacuccgaccuagauggcuggacgcccggaccuacuccgauccccuugcacugaaggaauuuaaagaguucgcugccggcaggaagucuauugcacucgacuugguaacugaaaucggucgcgugccaucgcaucuggcccacagaacaaggaaugcucuagauaaccugguuaugcuccauacgagcgagcacgggggccgggcguaucgucacgccgucgaggaacuuccugagaccauggaaacucuguuauugcugggacucaugauacugcuuacaggcggggcaaugcuguuucucaucucaggaaaagguauuggcaagaccuccaucggguugauuugugugaucgcuaguucuggaaugcuguggauggccgagauacccuuacaauggauugccagcgcaaucgugcuagaguucuuuaugaugguccugcucauuccagaaccugagaagcagcgcaccccgcaggacaaucaacuugcuuacguugugaucggcauacugacauuggccgcgaucauugcugccaacgaaaugggucugcucgagacuacgaaacgagaucuggggauguccaaggaacccggcguagugucaccaaccucuuaucuugacgucgaucuccauccugcaagcgccuggacacuguacgcuguggcaacuaccguuaucacacccauguugagacacaccauugagaauaguacugccaacgugucccuggcggcuaucgccaaccaggcagucguauuaaugggacuagacaaaggcuggccaauaagcaagauggaccugggggugccucuccuugcccugggaugcuacucucagguuaaucccuugacgcugacagcugccgugcuccugcuuauuacccauuaugcaaucaucggcccggguuuacaggcuaaagccacuagggaggcgcaaaagcggaccgccgcagggauuaugaagaacccaacagucgauggaaucaugacuauagaccuggauccugugauuuacgacucaaaauucgaaaagcagcucggccaggucauguugcuggugcuaugugcuguucagcugcuccuuaugcgcaccuccugggcccugugcgaggcauugacacuggcuacgggucccaucaccacucucugggaaggcaguccagggaaauuuuggaauacaaccauugccgugagcauggccaacaucuucagaggaucguaucuggcgggcgcuggguuagcauuuucuauaaugaaguccguaggaacuggcaaaagggguacagggagccaaggagagacccuuggcgaaaaguggaagaaaaagcugaaucagcucucacggaaagauuucgaccuauacaagaaaagugguaucacggagguggaucgaaccgaggccaaggaaggccugaaaagaggggagauuacacaccaugcugucucucgcggauccgccaaguugcagugguuuguugaaaggaacauggugauccccgagggccgggucauugaccugggguguggacguggcgguuggagcuauuacugcgcagggcucaagaaagugacugaaguaagaggauauaccaagggcggcccugggcacgaggagccggugcccaugucaacauacggauggaauaucguuaaacuuaugagugguaaggauguguucuaccugccaccugaaaaaugugacacuuugcugugcgauauuggcgagagcucccccucuccuaccgucgaagagagcaggacaauccgcgugcucaagauggucgagccaugguuaaagaacaaucaguucuguauaaaagugcugaaccccuauaugccuaccguuauugaacaccuugagcggcugcaacgaaagcaugggggaaugcuaguaagaaauccacucuccaggaacucaacucacgaaauguacuggaucucuaauggcacggguaacaucguggccagugucaauauggugucgcgccuguugcugaaccgguuuacaaugacccauagacgucccacuauugagaaagacguugaucucggggcuggaaccaggcacgugaacgcggaaccggagacaccuaauauggacgucauaggcgagcggaucaagcgcauuaaagaagagcacaacagcacguggcauuaugacgaugaaaauccauacaagaccugggccuaucacggcuccuacgaggugaaggcaacugggucugcuucaagcaugaucaacggaguagugaaacuucugacaaagcccugggacguugucccuauggugacccagauggccaugacugauacaaccccauucggucagcaacgaguguuuaaagaaaaggucgacacaagaacucccagguccaugccgggcacccggcgcguuauggggauuacggcagagugguuauggagaacccugggaaggaauaaaaagccucgauugugcacacgggaggaauucacuaagaaagugcguaccaacgccgcuaugggcgccguauuuacagaggaaaaucagugggauagugcgaaggcagccguggaggacgaagauuucuggaaacucgucgacagagagcgcgagcugcauaagcuagguaaaugugggucuugcguguauaacaugaugggaaagagggaaaaaaagcuuggcgaguuuggcaaggcuaaagggagccgggccaucugguacauguggcugggagcaagauaccucgaauucgaggcucuggguuuuuugaaugaggaucacugguucucacgcgaaaacuccuauaguggcguugagggggaaggacugcauaagcucggcuacauacuuagggacaucagcaaaauucccgguggggccauguaugcugaugacacugccggaugggacacccgaaucacggaggaugaccugcacaaugaagagaagauuacacagcagauggauccagagcaccggcaauuagcaaacgcgaucuuuaaacugaccuaccagaauaagguggucaaggugcagagaccuacucccacaggcaccguaauggacauaauuucuaggaaagaucagcgcggcuccgggcaaguuggaacuuaugguuugaacaccuucacaaauauggaagcccagcucauccgucagauggagggcgaaggggugcugucaaaggcugaccuagagaacccacaucuucccgaaaaaaagaucacgcaguggcuggagaccaaaggagucgagcggcucaagagaauggccauuagcggcgaugacugcguggugaagccuauagaugacagguuugcaaacgcucuguuggccuuaaaugauauggguaaaguccgcaaggacaucccacaauggcagccgucgaaaggguggcacgauuggcagcagguucccuucuguucucaucacuuccacgaacugauuaugaaggacggacgaaaacucgugguaccuugccggccacaagacgagcuuaucggcagagcaaggauuagucagggcgccggguggucccugaaggaaacugcgugucuaggaaaggcuuacgcccagauguggagccugauguauuuucaucgcagagaucuccgguuggcaucaaacgccaucugcuccgcugugcccguccacugggugccuacaucuaggaccacuuggagcauacaugcccaccaucaauggaugacaaccgaggacaugcugacgguuuggaaucguguguggaucgaagauaacccauggauggaggacaaaacacccgucaccacuugggagaaugugccuuaccuugguaagcgagaagaucagugguguggcagucugauugggcucaccucccgcgcaacaugggcucagaacaucccgacugccauucagcaaguaagaagcuuaaucggaaaugaggaauuccuggacuacaugccaucuaugaaacgguuuaggaaggaggaggaaucagagggcgcgauuugguga

SEQ ID NO: 15339 - RNA, 9873 nt, Artificial Sequence
  derived and/or modified CDS sequence (opt3) from DENV-3__KF973481__SS-prME
accagccugugccucaugaugauccuucccgcagcucuggcauuccacuugacauccagagacggcgaaccuagaaugauuguggggaagaacgaacgggguaaaucuuuacuguuuaagacugccucagguauaaauauguguacgcuaaucgcgauggaucucggcgaaaugugcgacgauaccgucacauacaaauguccacauauuacugaaguugaaccggaagacaucgauugcugguguaaccugaccaguacaugggugaccuaugggacuugcaaucaggcuggagaacaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacuauuaucauuaccguccauacaggugaccagcaccaggugggcaacgagacccaagggguuacugcagaaaucacgccucaggcuuccacaaccgaggccauccucccagaauauggaacucuuggccuggagugcucuccgcgaaccgguuuggacuucaaugagaugauucuacugacaaugaaaaacaaggcguggauggugcauagacagugguuuuucgaucucccccugccuuggaccagcggggccacuacagaaacgccaaccuggaauaggaaagagcuucuggucacuuuuaagaacgcacacgcuaaaaagcaagaagugguaguuuugggcucccaggagggagccaugcacacagcucucaccggcgccacagaaauacaaaauucagggggaacaagcaucuucgcaggucaucugaagugucgguuaaaaauggacaagcuggagcuaaaaggcaugagcuacgccaugugcaccaacacguuugugcucaagaaagaggucucugaaacccagcacgggacaauucugaucaagguggaguacaagggagaagauguccccuguaaaauaccuuucuccacugaggacggccaagguaaggcucauaacgggcgucuuauuaccgcgaauccagugguuacuaagaaggaggaacccgugaacaucgaggcagaaccgccuuucggcgagucaaauaucguaauuggaaucggcgauaacgccuugaaaauuaauugguauaagaaggggagcaguauaggaaaaauguuugaagcuacugcccgcggugcaagaaggauggccauccugggcgacaccgcuugggauuucgggucugucggaggcgugcucaacucccuggguaagaugguucaccagauuuuugggagcgccuacacggcacuuuucucgggcgugucuugggucaugaaaaucggaaucggcgugcuguugacauggauugggcucaauuccaagaacaccucaaugaguuuuagcugcauagcgaucggaauuaucacucuguauuuaggcgcuguagugcaggccgacauggguuguguuauuaauuggaaagggaaggagcugaagugcggauccggcaucuucgucacaaacgaggugcauaccuggacugaacaguacaaauuucaagcagauucucccaagcggcuagccaccgcuauagccggugcaugggagaauggcgugugugggauccgaagcacaacgcgcauggaaaaccuccuguggaaacagauugcuaaugagcuuaacuauaucuugugggaaaauaacauuaagcugaccgucguugugggagacaucauaggcgugcucgagcaggggaaaagaacucugacaccacagccuauggaguuaaaguacucauggaaaaccuggggaaaggccaagauuguaacagcggaaacucaaaacaguuccuucaucauugauggccccaauaccccagagugccccagcgucucuagggccuggaacgugugggaaguugaggacuaugguuuugggguguucacgacaaauaucuggcugaaacuucgggaagucuacacccaguugugugaccaccgccucaugucagcugcagugaaggaugagagagccguucacgcugacaugggauacuggauagagagucagaaaaacggcagcuggaagcuggaaaaagccucccuaaucgaggugaagacuugcaccuggccuaagucucauacacuguggucgaaugguguacucgaaagcgauaugauuaucccaaaaucccuggcaggcccgauuucacagcacaaccauaggcccggguaucacacucaaaccgcgggaccuuggcaccuuggcaaguuggagcuggacuuuaauuacugcgaggggacaacggucgugaucaccgaaaacuguggaacucguggcccaaguuuacggacaaccacugugucugguaaacucauacaugaguggugcugucgaagcugcacacugcccccucuuagauauaugggggaagauggauguugguacggcauggagauuaggccaaucuccgaaaaggaggagaauauggucaaaucacugguuagcgccgguucuggcaagguggacaacuucaccguagggguguugugccucgcuauccuguuugaagaggucaugcgcggaaaguucggcaaaaagcacaugauugccgggguguucuuuacguucguucuacugcucuccggacagaucacuuggcgggauauggcacauacccugauuaugauaggcaguaaugcuagcgacagaauggguaugggggugacauaucuugccuugaucgcaaccuuuaaaauucagcccuuccuggccuuaggauuuuuccucaggaagcugacuucucgcgaaaaccuucugcuaggcgucggccucgcuauggcgacaacccugcaauugccggaggauaucgaacagauggccaaugggauugcacugggauuaauggcucucaaacugaucacacaguuugagacuuaccagcuuuggaccgcccugauauccuugacguguucaaacacaaucuucacccucacuguggccuggcgaaccgcuacacugauucuagccgguguuagucugcuuccugugugccaaagcucguccaugcggaagacugacuggcucccaauggccgucgcggcuaugggcguacccccucugcccuuguuuaucuucgggcugaaggauaccuuaaaacguagaucuuggccacucaaugagggagugauggccguuggccuggugagcauucuugcaucaagucuguugaggaacgacgucccuauggccgguccccucguggcugggggacugcuaaucgcauguuauguaauaacgggcacauccgccgaucugaccguggaaaaggcggcugacauuacuugggaggaagaggccgaacagacaggcgucucucacaaccuuaugaucaccguugacgaugacgggacuaugcgcaucaaagaugacgagacagagaauauucucaccgugcuguugaagacggcauuacugauagugagcggaaucuuuccauacuccauuccggccacucuccuggucuggcauaccuggcagaaacagacacaacggucaggugugcuuugggauguuccuagucccccagaaacccagaaggcugagcuggaagagggcguauacagaaucaaacagcaggggauuuucggaaagacacaagugggcgucggugugcagaaggaggggguuuuucacacuauguggcacgugaccaggggagccgucuugacguauaacggcaaacgacuagaacccaauugggcaagugugaagaaagaccugaucucuuacggcgggggauggcgccucuccgcucaguggcaaaagggugaggaaguacaggucauagccguggagccuggcaaaaacccaaagaauuuccagacaaugcccgggacuuuccagaccacaaccggagaaaucggcgcgauugcccuggauuuuaagccugguacuagcgggucgccgaucauuaaccgggagggaaaaguugugggccuuuauggcaauggggucgugaccaagaacggagguuacguuucaggcaucgcacaaacaaaugcugagccagacgggcccacgccugaauuagaggaagagauguucaaaaagagaaaccugacuauaauggaucuccauccaggaucuggcaaaaccaggaaguauuugcccgccauugugcgugaagcuaucaagcgccggcugagaacacucauccuggcaccuaccagggucguggccgccgagauggaggaagcucuuaaaggucugccgauucgauaccagacuacagcgaccaagagugagcacacggggcgggaaaucguagacuugaugugccaugcaacuuuuacaaugcgccuacugucccccgugagaguuccaaauuauaaccucauaauuauggaugaggcccacuucaccgacccugcuagcaucgccgcaaggggauacauuucuacccgggucggcaugggcgaagccgcugcgaucuuuaugacugccacacccccagggaccgcagaugcuuucccucagagcaaugcccccauacaggacgaggagcgagacauuccagaaagauccuggaacucaggaaaugaguggaucacagauuuugcagguaaaacugugugguucgugccgaguaucaaggccggcaacgacauugcuaacuguuuacgcaaaaaugggaagaaggucauccaacugagcaggaaaacguuugauaccgaauaccagaagacaaaacuuaacgacugggauuucguagugacuaccgacauuucugagaugggagccaauuuuaaggcggaucguguuauagacccucggagaugccugaaacccgugauccucacagauggcccagagagggucauuuuggcaggucccaugccugugaccgccgcuuccgccgcucagcgccgagggagaguuggccggaacccacagaaggaaaaugaccaauauaucuucacuggacagccccugaacaaugaugaggaccaugcacacuggacggaagccaagaugcuccuggacaacaucaauaccccugagggcauuauaccggcucuuuucgaaccagagagggagaaaucagccgcaaucgauggggaauaccgccuaaagggagagagucguaaaacauuuguggaacugaugagacggggugacuugcccgucugguuagcgcacaagguggccagcgagggcauuaaauauacugauaggaaguggugcuucgacgggcagcgcaacaaucagauccuggaagagaacauggauguagagauuuggaccaaagaaggagagaagaagaaacuccgaccuagauggcuggacgcucggacauacuccgauccccuugcccugaaggaauuuaaagaguucgcagcuggcaggaagucuaucgcccucgacuuggugaccgaaauaggucgcguuccaucgcaucuggcacacagaacuaggaaugcccuagauaaccuggucaugcuccauacaagcgagcacgggggccgggcuuaucgucacgcgguggaggaacuuccugagacgauggaaacccuguuauugcugggacucaugauccugcuuacuggcggggccaugcuguuucucauuucaggaaaagguaucggcaagacauccauuggguugaucugugugauagcaaguucuggaaugcuguggauggcugagauucccuuacaauggaucgccagcgccauuguccuagaguucuuuaugaugguucugcucaucccagaaccugagaagcagcgcaccccgcaggacaaucaacuugcauacgugguaauaggcauccugaccuuggcugccauuaucgcggcuaacgaaaugggucugcucgagacaacuaaacgagaucuggggauguccaaggaacccggcguggucucaccaacgucuuaucuugacguggaucuccauccugccagcgcauggacccuguacgccguugcuacaacugugauuacccccauguugagacacacaaucgagaauaguaccgcaaacgucucccuggccgcgauagcuaaccaggccguaguguuaaugggacuagacaaaggcuggccaauuagcaagauggaccuggggguuccucuccuugcacugggaugcuacucucaggugaaucccuugacucugacggccgcuguccuccugcuuaucacacauuaugccaucauuggcccggguuuacaggcaaaagcuaccagggaggcccaaaagcggacugcggccgggaucaugaagaacccaaccguggauggaauaaugacaauugaccuggauccugucaucuacgacucaaaauucgaaaagcagcucggccaggugauguugcugguucuaugugcagugcagcugcuccuuaugcgcacuuccugggcucugugcgaggccuugacccuggcaacaggucccauuacgacccucugggaaggcaguccagggaaauuuuggaauacuacaaucgcuguaagcauggccaacauauucagaggaucguaucuggccggcgcgggguuagcuuuuucuaucaugaaguccgugggaaccggcaaaagggguacugggagccaaggagagacacuuggcgaaaaguggaagaaaaagcugaaucagcucucacggaaagauuucgaccuauacaagaaaagugguauuaccgaggucgaucgaacggaggcaaaggaaggccugaaaagaggggagaucacccaccaugccguuucucgcggauccgcuaaguugcagugguuuguggaaaggaacauggucauucccgagggccgggugaucgaccugggguguggacguggcgguuggagcuauuacugcgccgggcucaagaaaguaacagaagugagaggauauacuaagggcggcccugggcacgaggagccgguucccaugucaaccuacggauggaauauugugaaacuuaugagugguaaggaugucuucuaccugccaccugaaaaaugugacacauugcugugcgauaucggcgagagcucccccucuccuacuguggaagagagcaggaccauacgcguccucaagaugguggagccaugguuaaagaacaaucaguucuguauuaaaguucugaaccccuauaugccuacaguaaucgaacaccuugagcggcugcaacgaaagcaugggggaaugcuagugagaaauccacucuccaggaacucaacccacgaaauguacuggaucucuaauggcacugguaacauugucgcaagugugaauaugguuucgcgccuguugcugaaccgguuuacgaugacacauagacgucccaccauagagaaagacguggaucucggggccggaacuaggcacgucaacgcugaaccggagaccccuaauauggacgugaucggcgagcggauuaagcgcaucaaagaagaacacaacagcacauggcauuaugacgaugaaaauccauacaagacgugggcguaucacggcuccuacgagguaaaggccaccgggucugcaucaagcaugauuaacggagugguuaaacuucugacuaagcccugggacgucgugccuauggugacacagauggcuaugaccgauacuacaccauucggucagcaacgagucuuuaaagaaaagguugacaccagaacacccagguccaugccgggcacucggcgcgugauggggaucaccgccgagugguuauggagaacgcugggaaggaauaaaaagccucgauugugcacccgggaggaguucacaaagaaaguacguacuaacgcagccaugggcgcuguguuuaccgaggaaaaucagugggauagugccaaggcggcagucgaggacgaagauuucuggaaacucguggacagagagcgcgagcugcauaagcuagguaaaugugggucuugcguuuauaacaugaugggaaagagggagaagaaacuuggcgaguuuggcaaagccaaagggagccgggcuauaugguacauguggcugggagccagauaccucgaguucgaggcacugggauuuuugaaugaggaucacugguucucacgcgaaaacuccuauaguggcguggagggggaaggacugcauaagcucggcuacauccuuagggacauuagcaaaauccccgguggggcuauguaugccgaugacacagcuggaugggacacucgaauuaccgaggaugaccugcacaaugaagagaagaucacgcagcagauggauccagagcaccggcaauuagccaacgcaauauuuaaacugacauaccagaauaaggucgugaagguacagagaccuacccccacuggcacaguuauggacauuaucucuaggaaagaucagcgcggcuccgggcaagugggaaccuaugguuugaacacuuucaccaauauggaagcgcagcucauccgucagauggagggcgaagggguccugucaaaggccgaccuagagaacccacaucuucccgagaaaaagauuacacaguggcuggagacgaaaggaguggagcggcucaagagaauggcuauaagcggcgaugacugcguggucaagccuaucgaugacagguuugccaacgcacuguuggcuuuaaaugauauggguaaaguucgcaaggacauuccacaauggcagccgucgaaaggguggcacgauuggcaacaggugcccuucuguucucaucacuuccacgaacugaucaugaaggacggacgaaaacucguagugccuugccggccacaagacgagcuuauuggcagagccaggaucagucagggcgcaggguggucccugaaggaaaccgccugucuaggaaaggcguacgcucagauguggagccugauguauuuucaucgcagagaucuccgguuggccucaaacgcaauaugcuccgccguccccgugcacuggguuccuacuucuaggacaaccuggagcauccaugcucaccaucaauggaugacuacagaggacaugcugaccguguggaaucgugucuggauugaagauaacccauggauggaggacaaaacgcccgugacaaccugggagaauguaccuuaccuugguaagcgagaagaucagugguguggcagucugaucgggcucacuucccgcgccaccugggcacagaacauuccgacagcuauccagcaaguuaggagcuuaauuggaaaugaggaguuccuggacuacaugccaucuaugaaacgguuuaggaaggaggaggaaucagagggcgccauaugguga

SEQ ID NO: 15340 - RNA, 9873 nt, Artificial Sequence
  derived and/or modified CDS sequence (opt3) from DENV-3__KF973482__SS-prME
accagccugugccucaugaugauccuucccgcagcucuggcauuccacuugacauccagagacggcgaaccuagaaugauuguggggaagaacgaacgggguaaaucuuuacuguuuaagacugccucagguauaaauauguguacgcuaaucgcgauggaucucggcgaaaugugcgacgauaccgucacauacaaauguccacauauuacugaaguugaaccggaagacaucgauugcugguguaaccugaccaguacaugggugaccuaugggacuugcaaucaggcuggagaacaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacuauuaucauuaccguccauacaggugaccagcaccaggugggcaacgagacccaagggguuacugcagaaaucacgccucaggcuuccacaaccgaggccauccucccagaauauggaacucuuggccuggagugcucuccgcgaaccgguuuggacuucaaugagaugauucuacugacaaugaaaaacaaggcguggauggugcauagacagugguuuuucgaucucccccugccuuggaccagcggggccacuacagaaacgccaaccuggaauaggaaagagcuucuggucacuuuuaagaacgcacacgcuaaaaagcaagaagugguaguuuugggcucccaggagggagccaugcacacagcucucaccggcgccacagaaauacaaaauucagggggaacaagcaucuucgcaggucaucugaagugucgguuaaaaauggacaagcuggagcuaaaaggcaugagcuacgccaugugcaccaacacguuugugcucaagaaagaggucucugaaacccagcacgggacaauucugaucaagguggaguacaagggagaagauguccccuguaaaauaccuuucuccacugaggacggccaagguaaggcucauaacgggcgucuuauuaccgcgaauccagugguuacuaagaaggaggaacccgugaacaucgaggcagaaccgccuuucggcgagucaaauaucguaauuggaaucggcgauaacgccuugaaaauuaauugguauaagaaggggagcaguauaggaaaaauguuugaagcuacugcccgcggugcaagaaggauggccauccugggcgacaccgcuugggauuucgggucugucggaggcgugcucaacucccuggguaagaugguucaccagauuuuugggagcgccuacacggcacuuuucucgggcgugucuugggucaugaaaaucggaaucggcgugcuguugacauggauugggcucaauuccaagaacaccucaaugaguuuuagcugcauagcgaucggaauuaucacucuguauuuaggcgcuguagugcaggccgacauggguuguguuauuaauuggaaagggaaggagcugaagugcggauccggcaucuucgucacaaacgaggugcauaccuggacugaacaguacaaauuucaagcagauucucccaagcggcuagccaccgcuauagccggugcaugggagaauggcgugugugggauccgaagcacaacgcgcauggaaaaccuccuguggaaacagauugcuaaugagcuuaacuauaucuugugggaaaauaacauuaagcugaccgucguugugggagacaucauaggcgugcucgagcaggggaaaagaacucugacaccacagccuauggaguuaaaguacucauggaaaaccuggggaaaggccaagauuguaacagcggaaacucaaaacaguuccuucaucauugauggccccaauaccccagagugccccagcgucucuagggccuggaacgugugggaaguugaggacuaugguuuugggguguucacgacaaauaucuggcugaaacuucgggaagucuacacccaguugugugaccaccgccucaugucagcugcagugaaggaugagagagccguucacgcugacaugggauacuggauagagagucagaaaaacggcagcuggaagcuggaaaaagccucccuaaucgaggugaagacuugcaccuggccuaagucucauacacuguggucgaaugguguacucgaaagcgauaugauuaucccaaaaucccuggcaggcccgauuucacagcacaaccauaggcccggguaucacacucaaaccgcgggaccuuggcaccuuggcaaguuggagcuggacuuuaauuacugcgaggggacaacggucgugaucaccgaaaacuguggaacucguggcccaaguuuacggacaaccacugugucugguaaacucauacaugaguggugcugucgaagcugcacacugcccccucuuagauauaugggggaagauggauguugguacggcauggagauuaggccaaucuccgaaaaggaggagaauauggucaaaucacugguuagcgccgguucuggcaagguggacaacuucaccguagggguguugugccucgcuauccuguuugaagaggucaugcgcggaaaguucggcaaaaagcacaugauugccgggguguucuuuacguucguucuacugcucuccggacagaucacuuggcgggauauggcacauacccugauuaugauaggcaguaaugcuagcgacagaauggguaugggggugacauaucuugccuugaucgcaaccuuuaaaauucagcccuuccuggccuuaggauuuuuccucaggaagcugacuucucgcgaaaaccuucugcuaggcgucggccucgcuauggcgacaacccugcaauugccggaggauaucgaacagauggccaaugggauugcacugggauuaauggcucucaaacugaucacacaguuugagacuuaccagcuuuggaccgcccugauauccuugacguguucaaacacaaucuucacccucacuguggccuggcgaaccgcuacacugauucuagccgguguuagucugcuuccugugugccaaagcucguccaugcggaagacugacuggcucccaauggccgucgcggcuaugggcguacccccucugcccuuguuuaucuucgggcugaaggauaccuuaaaacguagaucuuggccacucaaugagggagugauggccguuggccuggugagcauucuugcaucaagucuguugaggaacgacgucccuauggccgguccccucguggcugggggacugcuaaucgcauguuauguaauaacgggcacauccgccgaucugaccguggaaaaggcggcugacauuacuugggaggaagaggccgaacagacaggcgucucucacaaccuuaugaucaccguugacgaugacgggacuaugcgcaucaaagaugacgagacagagaauauucucaccgugcuguugaagacggcauuacugauagugagcggaaucuuuccauacuccauuccggccacucuccuggucuggcauaccuggcagaaacagacacaacggucaggugugcuuugggauguuccuagucccccagaaacccagaaggcugagcuggaagagggcguauacagaaucaaacagcaggggauuuucggaaagacacaagugggcgucggugugcagaaggaggggguuuuucacacuauguggcacgugaccaggggagccgucuugacguauaacggcaaacgacuagaacccaauugggcaagugugaagaaagaccugaucucuuacggcgggggauggcgccucuccgcucaguggcaaaagggugaggaaguacaggucauagccguggagccuggcaaaaacccaaagaauuuccagacaaugcccgggacuuuccagaccacaaccggagaaaucggcgcgauugcccuggauuuuaagccugguacuagcgggucgccgaucauuaaccgggagggaaaaguugugggccuuuauggcaauggggucgugaccaagaacggagguuacguuucaggcaucgcacaaacaaaugcugagccagacgggcccacgccugaauuagaggaagagauguucaaaaagagaaaccugacuauaauggaucuccauccaggaucuggcaaaaccaggaaguauuugcccgccauugugcgugaagcuaucaagcgccggcugagaacacucauccuggcaccuaccagggucguggccgccgagauggaggaagcucuuaaaggucugccgauucgauaccagacuacagcgaccaagagugagcacacggggcgggaaaucguagacuugaugugccaugcaacuuuuacaaugcgccuacugucccccgugagaguuccaaauuauaaccucauaauuauggaugaggcccacuucaccgacccugcuagcaucgccgcaaggggauacauuucuacccgggucggcaugggcgaagccgcugcgaucuuuaugacugccacacccccagggaccgcagaugcuuucccucagagcaaugcccccauacaggacgaggagcgagacauuccagaaagauccuggaacucaggaaaugaguggaucacagauuuugcagguaaaacugugugguucgugccgaguaucaaggccggcaacgacauugcuaacuguuuacgcaaaaaugggaagaaggucauccaacugagcaggaaaacguuugauaccgaauaccagaagacaaaacuuaacgacugggauuucguagugacuaccgacauuucugagaugggagccaauuuuaaggcggaucguguuauagacccucggagaugccugaaacccgugauccucacagauggcccagagagggucauuuuggcaggucccaugccugugaccgccgcuuccgccgcucagcgccgagggagaguuggccggaacccacagaaggaaaaugaccaauauaucuucacuggacagccccugaacaaugaugaggaccaugcacacuggacggaagccaagaugcuccuggacaacaucaauaccccugagggcauuauaccggcucuuuucgaaccagagagggagaaaucagccgcaaucgauggggaauaccgccuaaagggagagagucguaaaacauuuguggaacugaugagacggggugacuugcccgucugguuagcgcacaagguggccagcgagggcauuaaauauacugauaggaaguggugcuucgacgggcagcgcaacaaucagauccuggaagagaacauggauguagagauuuggaccaaagaaggagagaagaagaaacuccgaccuagauggcuggacgcucggacauacuccgauccccuugcccugaaggaauuuaaagaguucgcagcuggcaggaagucuaucgcccucgacuuggugaccgaaauaggucgcguuccaucgcaucuggcacacagaacuaggaaugcccuagauaaccuggucaugcuccauacaagcgagcacgggggccgggcuuaucgucacgcgguggaggaacuuccugagacgauggaaacccuguuauugcugggacucaugauccugcuuacuggcggggccaugcuguuucucauuucaggaaaagguaucggcaagacauccauuggguugaucugugugauagcaaguucuggaaugcuguggauggcugagauucccuuacaauggaucgccagcgccauuguccuagaguucuuuaugaugguucugcucaucccagaaccugagaagcagcgcaccccgcaggacaaucaacuugcauacgugguaauaggcauccugaccuuggcugccauuaucgcggcuaacgaaaugggucugcucgagacaacuaaacgagaucuggggauguccaaggaacccggcguggucucaccaacgucuuaucuugacguggaucuccauccugccagcgcauggacccuguacgccguugcuacaacugugauuacccccauguugagacacacaaucgagaauaguaccgcaaacgucucccuggccgcgauagcuaaccaggccguaguguuaaugggacuagacaaaggcuggccaauuagcaagauggaccuggggguuccucuccuugcacugggaugcuacucucaggugaaucccuugacucugacggccgcuguccuccugcuuaucacacauuaugccaucauuggcccggguuuacaggcaaaagcuaccagggaggcccaaaagcggacugcggccgggaucaugaagaacccaaccguggauggaauaaugacaauugaccuggauccugucaucuacgacucaaaauucgaaaagcagcucggccaggugauguugcugguucuaugugcagugcagcugcuccuuaugcgcacuuccugggcucugugcgaggccuugacccuggcaacaggucccauuacgacccucugggaaggcaguccagggaaauuuuggaauacuacaaucgcuguaagcauggccaacauauucagaggaucguaucuggccggcgcgggguuagcuuuuucuaucaugaaguccgugggaaccggcaaaagggguacugggagccaaggagagacacuuggcgaaaaguggaagaaaaagcugaaucagcucucacggaaagauuucgaccuauacaagaaaagugguauuaccgaggucgaucgaacggaggcaaaggaaggccugaaaagaggggagaucacccaccaugccguuucucgcggauccgcuaaguugcagugguuuguggaaaggaacauggucauucccgagggccgggugaucgaccugggguguggacguggcgguuggagcuauuacugcgccgggcucaagaaaguaacagaagugagaggauauacuaagggcggcccugggcacgaggagccgguucccaugucaaccuacggauggaauauugugaaacuuaugagugguaaggaugucuucuaccugccaccugaaaaaugugacacauugcugugcgauaucggcgagagcucccccucuccuacuguggaagagagcaggaccauacgcguccucaagaugguggagccaugguuaaagaacaaucaguucuguauuaaaguucugaaccccuauaugccuacaguaaucgaacaccuugagcggcugcaacgaaagcaugggggaaugcuagugagaaauccacucuccaggaacucaacccacgaaauguacuggaucucuaauggcacugguaacauugucgcaagugugaauaugguuucgcgccuguugcugaaccgguuuacgaugacacauagacgucccaccauagagaaagacguggaucucggggccggaacuaggcacgucaacgcugaaccggagaccccuaauauggacgugaucggcgagcggauuaagcgcaucaaagaagaacacaacagcacauggcauuaugacgaugaaaauccauacaagacgugggcguaucacggcuccuacgagguaaaggccaccgggucugcaucaagcaugacuaacggagugguuaaacuucugacaaagcccugggacgucgugccuauggugacccagauggcuaugacugauacaaccccauucggucagcaacgagucuuuaaagaaaagguugacacaagaacucccagguccaugccgggcacccggcgcgugauggggauuacggccgagugguuauggagaacccugggaaggaauaaaaagccucgauugugcacacgggaggaguucacuaagaaaguacguaccaacgcagccaugggcgcuguguuuacagaggaaaaucagugggauagugccaaggcggcagucgaggacgaagauuucuggaaacucguggacagagagcgcgagcugcauaagcuagguaaaugugggucuugcguuuauaacaugaugggaaagagggagaagaaacuuggcgaguuuggcaaagccaaagggagccgggcuaucugguacauguggcugggagccagauaccucgaguucgaggcacugggauuuuugaaugaggaucacugguucucacgcgaaaacuccuauaguggcguggagggggaaggacugcauaagcucggcuacauacuuagggacaucagcaaaauucccgguggggcuauguaugccgaugacacugcuggaugggacacccgaaucacggaggaugaccugcacaaugaagagaagauuacacagcagauggauccagagcaccggcaauuagccaacgcaaucuuuaaacugaccuaccagaauaaggucgugaagguacagagaccuacucccacaggcaccguuauggacauaauuucuaggaaagaucagcgcggcuccgggcaagugggaacuuaugguuugaacaccuucacaaauauggaagcgcagcucauccgucagauggagggcgaagggguccugucaaaggccgaccuagagaacccacaucuucccgagaaaaagaucacgcaguggcuggagaccaaaggaguggagcggcucaagagaauggcuauuagcggcgaugacugcguggucaagccuauagaugacagguuugccaacgcacuguuggcuuuaaaugauauggguaaaguucgcaaggacaucccacaauggcagccgucgaaaggguggcacgauuggcaacaggugcccuucuguucucaucacuuccacgaacugauuaugaaggacggacgaaaacucguagugccuugccggccacaagacgagcuuaucggcagagccaggauuagucagggcgcaggguggucccugaaggaaacugccugucuaggaaaggcguacgcucagauguggagccugauguauuuucaucgcagagaucuccgguuggccucaaacgcaaucugcuccgccguccccgugcacuggguuccuacaucuaggaccacuuggagcauacaugcucaccaucaauggaugacaaccgaggacaugcugacgguguggaaucgugucuggaucgaagauaacccauggauggaggacaaaacacccgugaccacuugggagaauguaccuuaccuugguaagcgagaagaucagugguguggcagucugauugggcucaccucccgcgccacaugggcacagaacaucccgacugcuauucagcaaguuaggagcuuaaucggaaaugaggaguuccuggacuacaugccaucuaugaaacgguuuaggaaggaggaggaaucagagggcgccauuugguga

SEQ ID NO: 15341 - RNA, 9873 nt, Artificial Sequence
  derived and/or modified CDS sequence (opt3) from DENV-3__KF973483__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucagaauucagggggaacuaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugcucccuguaaaaucccuuucuccacugaggacggccaagguaaggcgcauaacgggcgucuuauaaccgcaaauccagugguuacaaaaaaggaggaacccgugaacauugaggccgaaccgccuuucggcgagucaaauaucguaaucggaauuggcgauaacgcuuugaaaaucaauugguauaagaaggggagcaguauuggaaaaauguuugaagccacugcacgcggugccagaaggauggcuauacugggcgacaccgccugggauuucgggucugucggaggcgugcucaacucccuggguaagaugguucaccagaucuuugggagcgcauacacggcgcuuuucucgggcgugucuugggucaugaaaauuggaaucggcgugcuguugacauggaucgggcucaauucccggaacaccucaaugaguuuuagcugcauugcuauaggaaucauuacucuguauuuaggcgccguagugcaggcagacauggguuguguuaucaauuggaaggggaaagagcugaagugcggauccggcauuuucgucacaaacgaggugcauaccuggacugaacaguacaaguuucaagccgauucucccaaacgacuagcuaccgccaucgugggugcaugggagaauggcgucugugggauacgcagcacaacgagaauggaaaaccuccuguggaagcagaucgcuaaugagcuuaacuauauuuugugggaaaauaacaucaaacugaccguuguggugggagacauuaucggcguacucgagcaggggaagaggacucugacaccacagccuauggaguuaaaauacucauggaagaccuggggaaaagccaagauagucacagcggaaacucaaaacaguuccuucauuaucgauggccccaauaccccagagugccccagcgugucucgggccuggaacguuugggaaguggaggacuaugguuuuggggucuucacgacaaauauuuggcugaagcuucgcgaaaccuacacucaguugugugaccacagacucaugucagcugcagugaaagaugagagggccguucacgcugacaugggauacuggaucgagagucagaagaacggcagcuggaaacuggaaaaggccucccuaauagaggugaaaaccugcacauggccuaagucucauacuaucuggucgaaugguguacuggaaagcgauaugauuaucccaaagucccucgcaggcccgauuucacagcacaaccaucgucccggguaucacacccaaacagcgggaccuuggcaccugggcaaacuugaguuggacuuuaauuacugcgaggggacgaccgucgugaucacugaaaacuguggaacacggggcccaagucugcgaaccacuacagugucugguaaguuaauacaugaguggugcuguagaagcugcacccuccccccucugagguauaugggggaagauggauguugguacggcauggagauucgcccaaucuccgaaaaagaggagaauauggucaagucacuuguuagcgccgguucuggcaaaguggacaacuucacgauggggguacugugcuuggcuauccucuuugaagaggugaugcggggaaaguucggcaagaaacacaugauugccggggucuuccugacuuuugugcuacugcucuccggacagaucaccuggagagauauggcacauacacugauuaugauaggcaguaaugcuagcgacaggauggguauggggguuaccuaucuugccuugaucgcaacuuucaagauucagcccuuucuggccuuaggauucuuucuccgcaaacugacaucucgagaaaaccuucugcuaggcgugggccucgcuauggcgaccacacugcaauugccggaggauaucgaacagauggccaaugggauugcacugggauuaauggcucucaagcugaucacucaguucgagaccuaccagcuuuggacggcccugauauccuugacauguucaaacaccaucuuuacucucaccgucgccuggcggacagcuacucugauucuagcaggugugagucugcuuccuguuugccaaagcucguccaugcguaaaaccgacuggcucccaauggccguggcggcuaugggcguccccccucugcccuuguucaucuuuucucugaaggauacguuaaagagaaggagcuggccacucaaugaggggguaauggccgugggacugguuucaauucuugcaaguucccuguugcgcaacgacgugccuauggccggcccccucgucgcuggugggcugcuaaucgcauguuaugugauaacaggaaccucugccgaucugacuguagaaaaagcggcugacauuacaugggaggaagaggccgaacagaccggcgugagccacaaccuuaugaucacugucgacgaugacggcacaaugcggaucaaggaugacgagaccgagaauauucucacgguucuguugaaaacugcauuacugauaguguccgggaucuucccauacucaauuccggccacccuccugguguggcauacauggcagaagcagacccaaagaagcggaguccuuugggaugugccuagucccccagaaacacagaaagcugagcuggaagaggguguuuacaggaucaagcagcagggcauuuuugggaaaacucaaguaggagugggcguccagaaggaggguguguuccacaccauguggcacguuacgcgaggggccguguugacauauaacggaaagcgccuagaacccaauugggcaucugucaaaaaggaccugaucuccuacggcggcggguggcggcucagcgcucaguggcaaaaaggagaggaagugcagguaauagccgucgagccugguaagaacccaaaaaauuuucagacuaugcccggcaccuuccagacaaccacuggggaaaucggagcgauugcccuggauuucaagccuggcaccucggguucaccgaucauuaacagagaggggaaggugguuggacuuuauggcaauggcguggucacaaaaaacgggggauacgugucugguaucgcacaaacgaaugcugagccagacggccccacuccugaauuagaggaagagauguuuaagaaaaggaaccugaccauaauggaucuccauccagggaguggaaagacacguaaauauuugcccgccauuguucgcgaagcuaucaagcggagacugaggacccucauccuggcaccuacucgaguggucgccgccgagauggaggaagcucuuaagggccugccgauucgguaccagacaaccgcgacgaaauccgagcacacuggucgcgaaaucguggacuugaugugccaugcaacauucaccaugagacuacugagccccguaagggugccaaauuauaaccucauaauuauggaugaggcccacuuuaccgacccugcuucuaucgccgcacggggguacauuagcacucgaguuggaaugggcgaagccgcugcgaucuucaugacagccacccccccaggcacagcagaugcuuuuccucaguccaaugcccccauacaggacgaggagagagacauuccagaacgcucauggaacagugggaaugaguggaucacugauuucgcaggaaagacggucugguuugugccgagcaucaaagccgguaacgacauugcuaacuguuuaaggaagaauggcaaaaaggugauccaacugucucguaagaccuucgauacagaauaccagaaaacuaagcuuaacgacugggauuuugucguaaccacagacauuuccgagaugggggccaauuucaaagcggaucgggugauagacccuagaaggugccugaagcccguuauccucaccgauggaccagagcgcgugauuuuggcaggccccaugccugucacugccgcuucagccgcucagcgaagaggucggguggggaggaacccacagaaagaaaaugaccaauauaucuuuacgggccagccccugaacaaugaugaggaccaugcacacuggaccgaagccaagaugcuccuggacaacaucaauacaccugagggaauuauaccggcucuuuucgaaccagagcgcgagaagagugccgcaaucgauggcgaauaccgucuaaaaggggagagcagaaagacuuucguugaacugaugcggaggggagacuugcccgugugguuagcgcacaaagucgccuccgaggguauuaaguauaccgaucgcaaauggugcuuugacggccagcgaaacaaucagauccuggaagagaacauggauguggagauuuggacaaaggaaggggagaaaaagaagcucagaccucgguggcuggacgcuaggaccuacucugauccccuugcccugaaagaauucaaggaguuugcagcuggacgcaaaucgaucgcccucgacuugguaacugaaauaggcagagugccaagccaucuggcacacaggacacggaaugcccuagauaaccugguuaugcuccauacgucagagcacggugggcgugcuuaucgccacgcggucgaggaacuuccugagaccauggaaacucuguuauugcugggccucaugauccugcuuacaggaggcgccaugcuguuccucauuuccgggaagggaaucgguaaaaccaguauuggcuugaucugugugauagcaucuagcgggaugcuguggauggcugagauucccuuacaauggaucgccuccgccauugugcuagaguuuuucaugaugguccugcucaucccagaaccugagaagcagcgaaccccgcaggacaaucaacuugcauacguugugauaggaauccugacauuggcugccauuaucgcggcuaacgaaaugggccugcucgagacuacgaagagagaucuggguaugucaaaagaacccgggguagugucuccaaccagcuaucuugacgucgaucuccauccugccagugcauggacacuguacgccguggcuacuaccguuauuacacccauguugaggcacaccaucgagaauuccacugcaaacgugagccuggccgcgauagcuaaccaggccgucguauuaaugggccuagacaagggauggccaauuucuaaaauggaccugggcgugccucuccuugcacuggggugcuacucacagguuaaucccuugacgcugacagccgcugugcuccugcuuaucacccauuaugccaucauuggaccgggcuuacaggcaaaggcuacucgggaggcccaaaaacgcaccgcggccgguaucaugaagaacccaacagucgaugggauaaugacuauugaccuggauccugugaucuacgacuccaaguuugaaaaacagcucggacaggucauguugcuggugcuaugugcaguucagcugcuccuuaugagaaccaguugggcucugugcgaggccuugacacuggcaacgggccccauuaccacucucugggaagguagcccaggcaaguucuggaauacaaccaucgcugugucgauggccaacauauuuagggggucuuaucuggccggagcgggcuuagcuuucuccaucaugaaaagcguagggacuggaaagcggggcacagguucacaaggggagacccuuggagaaaaauggaagaagaaacugaaucagcucagucgaaaggauuuugaccuauacaaaaagucuggcauuacggagguggauagaaccgaggcaaaagaaggucugaagcgcggcgagaucacacaccaugccgucuccagggggagcgcuaaauugcagugguucguugaacggaacauggugauucccgagggacgugucaucgaccugggcugugggagaggaggcuggucauauuacugcgccggucucaagaaggugacugaaguaaggggguauaccaaaggaggcccuggccacgaggagccggugcccaugaguacauacggguggaauauuguuaagcuuaugagcggaaaagauguguuuuaccugccaccugaaaagugugacacuuugcugugcgauaucggugaguccucucccagcccuaccgucgaagagucccgcacaauacgggugcucaaaauggucgagccaugguuaaagaacaaucaguucuguauuaaggugcugaaccccuauaugccuaccguuaucgaacaccuugagcgacugcaaagaaaacauggcgggaugcuaguaaggaauccacucucacgcaacucuacucacgaaauguacuggaucaguaauggaacgggcaacauuguggcaucggucaauauggugagccggcuguugcugaacagauucacaaugacccaucguaggcccacuauagagaaggacguugaucucggugccgggacccggcacgugaacgcugaaccggagacaccuaauauggacgucaucggagagcgcauuaaacgaaucaaggaagagcacaacuccacguggcauuaugacgaugaaaauccauacaaaaccugggcguaucacggcucuuacgaggugaaggccacuggcucagcaagcuccaugauuaacgggguagugaagcuucugacaaaacccugggacguugucccuauggugacccagauggcuaugacugauacaaccccauuuggacagcaaagaguguucaaggaaaaagucgacacaaggacuccccggaguaugccggguacccgcagaguuaugggcaucacggccgagugguuauggaggacccuggggcgaaauaagaaaccucgguugugcacacgugaggaauuuacuaagaaggugagaaccaacgcagccaugggagcuguauucacagaggaaaaucagugggauucugccaaagcggcaguggaggacgaagauuuuuggaagcucgucgaccgcgagagggagcugcauaaacuaggcaagugugguagcugcguguauaacaugauggggaaacgggaaaagaaacuuggagaguucggcaaggccaagggcucaagagcuauaugguacauguggcugggggcccgcuaccucgaauuugaggcacugggauucuugaaugaggaucacugguuuuccagggaaaacaguuauagcgguguugagggcgaagggcugcauaaacucggauacauccuucgagacauuucuaagauccccggcggugcuauguaugccgaugacacugcugggugggacacccggauuacggaggaugaccugcacaaugaagagaaaaucacacagcagauggauccagagcacagacaauuagccaacgcaauauucaagcugaccuaccagaauaaaguggucaaggugcagaggccuacucccacaggaaccguaauggacauuaucucccgcaaggaucagcguggcucaggccaaguugggacuuauggauugaacaccuuuacaaauauggaagcgcagcucauccggcagauggagggugaaggcgugcugagcaaagccgaccuagagaacccacaucuucccgaaaagaaaauuacgcaguggcuggagaccaagggggucgagagacucaaaaggauggcuauaucgggagaugacugcguggugaagccuaucgaugaccgcuucgccaacgcacuguuggcuuuaaaugauaugggcaagguccgaaaagacauuccacaauggcagccgucuaaggguuggcacgauuggcagcagguucccuuuuguagucaucacuuccacgaacugaucaugaaagacgggcggaagcucgugguaccuugcagaccacaagacgagcuuauuggaagggcccgcaucucccagggcgcaggcuggagccugaaagaaacugccugucuagggaaggcguacgcucagauguggucacugauguauuuccauagacgggaucucagguuggccuccaacgcaauaugcucugccgugcccguccacugggugccuacaagccguaccacuuggaguauccaugcucaccaucaauggaugacaaccgaggacaugcugacgguuuggaaucgaguguggauugaagauaacccauggauggaggacaagacacccgucaccacuugggagaaugugccuuaccuuggaaaacgcgaagaucaguggugugguucccugaucggccucaccagcagagccacaugggcacagaacauuccgacugcuauccagcaaguacggucuuuaauugggaaugaggaauuucuggacuacaugccaucaaugaagagguuccgcaaagaggaggaaagugagggagccauaugguga

SEQ ID NO: 15342 - RNA, 9873 nt, Artificial Sequence
  derived and/or modified CDS sequence (opt3) from DENV-3__KF973485__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaaaaaggagcuucuggugacuuuuaaaaacgcacacgcuaagaagcaagaaguaguuguguugggcucccaggagggagccaugcacacagcucucaccggcgccacagaaauucagaauucagggggaacuaguauauucgcaggucaucugaaauguagguuaaagauggacaaacuggagcuaaagggcaugagcuacgccaugugcaccaacacguuuguccucaaaaaggaggugucugaaacccagcacgggacaauccugauuaaggucgaguacaaaggagaagaugugcccuguaagaucccuuucuccacugaggacggccaagguaaagcucauaacgggcggcuuauaaccgcgaauccaguugugacaaagaaagaggaacccguaaacauugaggcagaaccgccuuucggcgagucaaauaucgucaucggaauuggcgauaacgccuugaagaucaauugguauaagaaagggagcaguauuggaaagauguuugaagcuacugcccguggugcacgcagaauggccauacugggcgacaccgcuugggauuucgggucugugggaggcguucucaacucccuggguaaaauggugcaccagaucuuugggagcgccuacacggcacuuuucucgggcgucucuugggugaugaagauuggaaucggcguacuguugacauggaucgggcucaauuccaaaaacaccucaaugaguuuuagcugcauugcgauaggaaucauuacucuguauuuaggcgcugugguucaggccgacauggguugugucaucaauuggaaggggaaggagcugaaaugcggauccggcauuuucgugacaaacgaggugcauaccuggacugaacaguacaaguuucaagcagauucucccaaaaggcuagccaccgcuaucgccggugcaugggagaauggcgucugugggauacggagcacaacgcgaauggaaaaccuccuguggaagcagaucgcuaaugagcuuaacuauauuuugugggaaaauaacaucaaacugaccguuguggugggagacauuaucggcguacucgagcaggggaagcgcacucugacaccacagccuauggaguuaaaauacucauggaagaccuggggaaaggccaaaauagucacagcggaaacucaaaacaguuccuucauuaucgauggccccaauaccccagagugccccagcgugucuagagccuggaacguuugggaaguggaggacuaugguuuuggggucuucacgacaaauauuuggcugaagcuuagggaagugcacacccaguugugugaccaccggcucaugucagcugcaguuaaagaugagcgcgccgugcaugcugacaugggauacuggaucgagagucagaagaacggcagcuggaaacuggaaaaggccucccuaauagagguaaagacuugcaccuggccuaaaucucacacacuguggucgaaugguguccucgaaagcgauaugaucauuccaaagucccuggcaggcccgaucucacagcauaaccacagacccggguaccacacucaaaccgcgggaccuuggcaucuuggcaaauuggagcuggacuuuaauuauugcgaggggacaacgguggugauuaccgaaaacuguggaacuaggggcccaaguuuacguacaaccacugucucugguaagcucauccacgaguggugcugucggagcugcacacugcccccucuucgauacaugggggaagauggauguugguauggcauggagauaagaccaauuuccgaaaaagaggagaauaugguuaagucacuggugagcgccgguucuggcaagguagacaacuucaccauggggguguugugccucgcuauccuguuugaagaggucaugaggggaaaauucggcaagaaacauaugaucgccgggguguucuuuacguucguucuacugcucuccggacagauuacuuggcgcgauauggcacacacccugaucaugauuggcaguaaugcuagcgaccggauggguaugggggugacauaccuugccuugauagcaaccuuuaagauccagcccuuccuggccuuaggauuuuuccucagaaaacugacuucuagggaaaaccuucugcuaggcgucggccucgcuauggcgacaacccugcaauugccggaggauauugaacagauggccaaugggaucgcacugggauuaauggcucucaagcugauuacacaguuugagacuuaucagcuuuggaccgcccugaucuccuugacguguucaaacacaauauucacccucacuguggccuggcgcaccgcuacacugauccuagcagguguuagucugcuuccugugugccaaagcucguccaugcgaaagacugacuggcucccaauggccgucgcggcuaugggcguacccccucugcccuuguuuauuuucgggcugaaagauaccuuaaagcggcguucuuggccacucaaugagggagugauggccguuggccuggugagcauccuugcaucaagucuguugagaaacgacgucccuauggccgguccccucguggcugggggacugcuaauugcauguuacguaaucacgggcacauccgccgaucugaccguggaaaaagcggcugacauaacuugggaggaagaggccgaacagacaggcgucucucauaaccuuaugauuaccguugacgaugacgggacuaugaggaucaaggaugacgagacagagaauauccucaccgugcuguugaaaacggcauuacugauugugagcggaauauuuccauauuccaucccggccacucuccuggucuggcacaccuggcagaagcagacacaacgcucaggugugcuuugggauguuccuagccccccagaaacccagaaagcugagcuggaagagggcguauaccggauuaagcagcaggggaucuucggaaagacacaagugggcgucggugugcagaaagaggggguuuuucacacuauguggcaugugaccagaggagccgucuugacguacaacggcaagaggcuagaacccaauugggcaagugugaaaaaggaccugauuucuuauggcgggggauggcgacucuccgcucaguggaaaaagggugaggaaguacaagucaucgccguggagccuggcaagaacccaaaaaauuuccagacaaugcccgggacuuuccagaccacaaccggagaaauaggcgcgaucgcccuggauuuuaagccugguacuagcgggucgccgauuaucaaccgcgagggaaaaguugugggccuuuacggcaauggggucgugaccaagaacggagguuauguuucaggcauugcacagacaaaugcugagccagacgggcccacgccugaauuagaggaagagauguucaaaaagcggaaccugacuaucauggaucuccacccaggaucuggcaagaccagaaaauacuugcccgccauagugagggaagcuauuaagcgucgccugcggacacucauccuggcaccuaccagagucguggccgccgagauggaggaagcucuuaaaggucugccgaucagguaucaaacuacagcgaccaagagugagcauacggggcgagaaauuguagacuugaugugccacgcaacuuuuacaaugcggcuacugucccccgugcgcguuccaaauuacaaccucaucauaauggaugaggcccauuucaccgacccugcuagcauugccgcaagaggauauaucucuaccagggucggcaugggcgaagccgcugcgauuuuuaugacugccacacccccagggaccgcagaugcuuucccucagagcaaugcccccauccaggacgaggagcgggacauaccagaacgauccuggaacucaggaaaugaguggauuacagauuuugcagguaaaacugugugguucgugccgaguaucaaggccggcaacgacaucgcuaacuguuuaagaaagaaugggaaaaaggucauucagcugagccgcaaaacguuugauaccgaauaccaaaagacaaaacuuaacgacugggauuucguagugacuaccgacaucucugagaugggagccaauuuuaaggcggauaggguuauugacccucgucggugccugaagcccgugauacucacagauggcccagagagagucaucuuggcaggucccaugccugugaccguugccuccgcugcccagaggcgcgggcgagugggcagaaacccacagaaagaaaaugaccaguacauuuucacuggacaaccccugaacaaugaugaggaccacgcucacuggacggaagcaaagaugcuccuggacaacaucaauaccccugagggcaucauuccggcccuuuucgaaccagagcgggagaaaucagcugccauagauggggaauauaggcuaaagggagagagucgcaaaacauuugucgaacugaugcguagaggugacuugcccgugugguuagcacauaagguagcgagcgagggcaucaaauacacugaucggaaguggugcuucgacgggcagaggaacaaucagauucuggaagagaacauggauguggagaucuggaccaaggaaggagagaaaaagaaacuccgcccucgauggcuggacgccagaacauauuccgauccccuugcucugaaggaauuuaaagaguucgccgcaggccggaagucuauugcucucgacuugguuaccgaaaucgguagggucccaucgcaccuggcccaucgcacuagaaaugcacuagauaaccuggugaugcuccacacaagcgagcacgggggcagggccuaccggcaugcuguggaggaacuuccugagacgauggaaacccuguuauugcugggacucaugauacugcuuacuggcggggcgaugcuguuucucaucucaggaaaggguauuggcaaaacauccaucggguugauuugugucaucgccaguucuggaaugcuguggauggcagagauacccuuacaguggauugcuagcgccaucguucuagaguucuuuaugauggugcugcucauuccagaaccugagaagcaacguaccccgcaggacaaucagcuugccuauguagugaucggcauacugaccuuggcagcuaucauugccgcgaacgaaaugggucugcucgagacaacuaaacgcgaucuggggauguccaaggaacccggcgucgugucaccaacgucuuaccuugacguugaucuccacccugcuagcgccuggacccuguaugcaguggccacaacugucaucacccccauguugcgacauacaauugagaauaguaccgcuaacguaucccuggcagccaucgcgaaccaagcugugguuuuaaugggacuagacaaaggcuggccaauaagcaagauggaccugggggugccucuccuugcccugggaugcuacucucaggucaaucccuugacucugacggcagccgugcuccugcuuauuacacacuacgcuaucaucggcccggguuuacaggccaaggcaaccagagaggcucagaaaaggacugccgcggggauuaugaagaacccaaccgucgauggaaucaugacaauagaccuggauccugugauuuaugacucaaaauucgaaaagcaacucggccagguuauguugcuggugcuauguguagugcagcugcuccuuaugcggacuuccugggcccugugcgaggcauugacccuggcuacaggucccaucacgacccucugggaaggcaguccagggaaauuuuggaauacuacaauugccgucagcauggcaaacaucuuccgcggaucguaccuggcuggcgccggguuagccuuuucuauaaugaaguccguuggaaccggcaagagagguacugggagccagggagagacacuuggcgaaaaauggaagaaaaagcugaaucaacucucaaggaaagauuucgaccuauauaagaaaagugguaucaccgagguggaucggacggaggcgaaggaaggccugaagcgaggggagauuacccaucacgcugucucuagaggauccgcaaaauugcagugguuuguggaacgcaacaugguaauccccgagggcagggugauugaccugggguguggacggggcgguuggagcuacuauugcgccgggcucaagaaaguuacagaagugcguggauacacuaagggcggcccugggcacgaggagccgguccccaugucaaccuauggauggaauaucgugaaacuuaugagugguaaggaugucuucuaccugccaccugaaaagugugacacauugcugugcgauauuggcgagagcucccccucuccuacuguggaagagagcagaaccaucaggguucucaaaaugguagagccaugguuaaagaacaaucaguucuguauaaaagugcugaaccccuacaugccuacagucauugaacaucuugagcgccugcagcggaagcacgggggaaugcuagugcgaaauccacucuccagaaacucaacccaugaaauguauuggaucucuaauggcacugguaacaucguugcuagugugaauauggucucgaggcuguugcugaaccgcuuuacgaugacacaccggagacccaccauugagaaagacguggaucucggggccggaacucgucacguaaacgcagaaccggagaccccuaauauggaggugauaggcgaaaggaucaagcggauuaaggaggaacauaacagcacauggcacuacgacgacgagaauccauauaaaacgugggccuaccauggcuccuaugaaguuaaggcuaccgggucugcgucaagcaugaucaacggagucgugaaacuucugacuaagcccugggauauggugccuauggucacacaaauggccaugaccgacacuacaccauucggucagcagcgcguuuuuaaagagaagguggauacccgaacacccagauccaugccgggcacuaggcggguaauggggauuaccgcagagugguuauggcgcacgcugggaagaaauaagaaaccuagguugugcacccgagaagaguucacaaagaaagugcggacuaacgcugccaugggcgcagucuuuaccgaagagaaucaaugggacagugccaaggcugccguggaagaugaggacuucuggaaacucguugaucgugagagagaacugcacaagcuagguaaaugugggucuugcguguacaacaugaugggaaagcgcgagaagaaacuuggcgaauuuggcaaggcgaaagggagcagggcaaucugguauauguggcugggagcccgguaccucgaguucgaggcucuggguuuuuugaaugaagaccauugguucucaagagagaacuccuacaguggcgucgaaggggagggacugcacaagcucggcuauauacuucgcgauaucagcaaaauucccgguggggccauguacgcagacgauacagcuggaugggacacuaggaucaccgaagacgaucugcacaaugaggagaagauuacgcagcagauggacccagaacaucgacaguuagccgaugcuaucuuuaagcugacauaucaaaacaaagugguaaagguucagcggccuacccccacuggcacagugauggacauaauuucuagaaaagaucagaggggcuccgggcaggucggaaccuacgguuugaauacuuucaccaacauggaggcccaacucauccgccagauggaaggcgagggggugcugucaaaggcagaccuagaaaauccacaccuucccgagaaaaagaucacacaguggcuggagacgaagggaguggaacgucucaaacggauggcgauuagcggcgaugacugcgucguuaagccuauagaugacagauuugccaacgcucuguuggccuuaaacgauauggguaaagugaggaaggacaucccacaguggcaaccgucgaaaggguggcaugauuggcagcagguacccuucuguucucaccacuuccaugagcugauuaugaaggacggacgcaagcucguggucccuugccgaccacaggacgaacuuaucggccgggcaagaauuagucaaggcgcuggguggucccugaaagagaccgccugucuaggaaaggcauaugcccagauguggagccugauguacuuucacaggcgcgaucucagauuggcgucaaaugcuaucugcuccgccgugcccguucauugggugccuacuucucggacaaccuggagcauacacgcacaucaccaguggaugacuacagaagacaugcugaccgucuggaacaggguguggaucgaggauaauccauggauggaggacaaaacgcccguaacaaccugggaaaacguuccuuaucuugguaagcgugaggaucaaugguguggcagucugauugggcucacuucccgagccaccugggcucagaauaucccgacagccauucagcaggugcgcagcuuaaucggaaacgaagaguuccuggacuacaugccaucuaugaaaagauuucggaaggaggaagagucagaaggcgcaauuugguga

SEQ ID NO: 15343 - RNA, 9873 nt, Artificial Sequence
  derived and/or modified CDS sequence (opt3) from DENV-3__KF973486__SS-prME
accagccugugccucaugaugauccuucccgcagcucuggcauuccacuugacauccagagacggcgaaccuagaaugauuguggggaagaacgaacgggguaaaucuuuacuguuuaagacugccucagguauaaauauguguacgcuaaucgcgauggaucucggcgaaaugugcgacgauaccgucacauacaaauguccacauauuacugaaguugaaccggaagacaucgauugcugguguaaccugaccaguacaugggugaccuaugggacuugcaaucaggcuggagaacaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucaaaauucagggggaacaagcauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaagguaaggcucauaacgggcgucuuauaaccgcgaauccaguugugacuaagaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauaugggggaagauggauguugguacggcauggagauaaggccaauuuccgaaaaggaggagaauaugguuaaaucacuggugagcgccgguucuggcaagguagacaacuucaccauggggguguugugccucgcuauccuguuugaagaggucaugcgcggaaaguucggcaaaaagcacaugaucgccgggguguucuuuacguucguucuacugcucuccggacagauuacuuggcgggauauggcacauacccugaucaugauuggcaguaaugcuagcgacagaauggguaugggggugacauaucuugccuugauagcaaccuuuaaaauccagcccuuccuggccuuaggauuuuuccucaggaagcugacuucucgcgaaaaccuucugcuaggcgucggccucgcuauggcgacaacccugcaauugccggaggauauugaacagauggccaaugggaucgcacugggauuaauggcucucaaacugauuacacaguuugagacuuaccagcuuuggaccgcccugaucuccuugacguguucaaacacaauauucacccucacuguggccuggcgaaccgcuacacugauccuagccgguguuagucugcuuccugugugccaaagcucguccaugcggaagacugacuggcucccaauggccgucgcggcuaugggcguacccccucugcccuuguuuauuuucgggcugaaggauaccuuaaaacguagaucuuggccacucaaugagggagugauggccguuggccuggugagcauccuugcaucaagucuguugaggaacgacgucccuauggccgguccccucguggcugggggacugcuaauugcauguuauguaaucacgggcacauccgccgaucugaccguggaaaaggcggcugacauaacuugggaggaagaggccgaacagacaggcgucucucacaaccuuaugauuaccguugacgaugacgggacuaugcgcaucaaagaugacgagacagagaauauccucaccgugcuguugaagacggcauuacugauugugagcggaauauuuccauacuccaucccggccacucuccuggucuggcauaccuggcagaaacagacacaacggucaggugugcuuugggauguuccuagucccccagaaacccagaaggcugagcuggaagagggcguauacagaauuaaacagcaggggaucuucggaaagacacaagugggcgucggugugcagaaggaggggguuuuucacacuauguggcacgugaccaggggagccgucuugacguauaacggcaaacgacuagaacccaauugggcaagugugaagaaagaccugauuucuuacggcgggggauggcgccucuccgcucaguggcaaaagggugaggaaguacaggucaucgccguggagccuggcaaaaacccaaagaauuuccagacaaugcccgggacuuuccagaccacaaccggagaaauaggcgcgaucgcccuggauuuuaagccugguacuagcgggucgccgauuaucaaccgggagggaaaaguugugggccuuuauggcaauggggucgugaccaagaacggagguuacguuucaggcauugcacaaacaaaugcugagccagacgggcccacgccugaauuagaggaagagauguucaaaaagagaaaccugacuaucauggaucuccauccaggaucuggcaaaaccaggaaguauuugcccgccauagugcgugaagcuauuaagcgccggcugagaacacucauccuggcaccuaccagggucguggccgccgagauggaggaagcucuuaaaggucugccgauccgauaccagacuacagcgaccaagagugagcacacggggcgggaaauuguagacuugaugugccaugcaacuuuuacaaugcgccuacugucccccgugagaguuccaaauuauaaccucaucauaauggaugaggcccacuucaccgacccugcuagcauugccgcaaggggauacaucucuacccgggucggcaugggcgaagccgcugcgauuuuuaugacugccacacccccagggaccgcagaugcuuucccucagagcaaugcccccauccaggacgaggagcgagacauaccagaaagauccuggaacucaggaaaugaguggauuacagauuuugcagguaaaacugugugguucgugccgaguaucaaggccggcaacgacaucgcuaacuguuuacgcaaaaaugggaagaaggucauucaacugagcaggaaaacguuugauaccgaauaccagaagacaaaacuuaacgacugggauuucguagugacuaccgacaucucugagaugggagccaauuuuaaggcggaucguguuauugacccucggagaugccugaaacccgugauacucacagauggcccagagagggucaucuuggcaggucccaugccugugaccgccgcuuccgccgcucagcgccgagggagaguuggccggaacccacagaaggaaaaugaccaauauauuuucacuggacagccccugaacaaugaugaggaccaugcacacuggacggaagccaagaugcuccuggacaacaucaauaccccugagggcaucauuccggcucuuuucgaaccagagagggagaaaucagccgcaauagauggggaauaccgccuaaagggagagagucguaaaacauuuguggaacugaugagacggggugacuugcccgucugguuagcgcacaagguggccagcgagggcaucaaauauacugauaggaaguggugcuucgacgggcagcgcaacaaucagauucuggaagagaacauggauguagagaucuggaccaaagaaggagagaagaagaaacuccgaccuagauggcuggacgcucggacauacuccgauccccuugcccugaaggaauuuaaagaguucgcagcuggcaggaagucuauugcccucgacuuggugaccgaaaucggucgcguuccaucgcaucuggcacacagaacuaggaaugcccuagauaaccuggucaugcuccauacaagcgagcacgggggccgggcuuaucgucacgcgguggaggaacuuccugagacgauggaaacccuguuauugcugggacucaugauacugcuuacuggcggggccaugcuguuucucaucucaggaaaagguauuggcaagacauccaucggguugauuugugugaucgcaaguucuggaaugcuguggauggcugagauacccuuacaauggauugccagcgccaucguccuagaguucuuuaugaugguucugcucauuccagaaccugagaagcagcgcaccccgcaggacaaucaacuugcauacgugguaaucggcauacugaccuuggcugccaucauugcggcuaacgaaaugggucugcucgagacaacuaaacgagaucuggggauguccaaggaacccggcguggucucaccaacgucuuaucuugacguggaucuccauccugccagcgcauggacccuguacgccguugcuacaacugugaucacccccauguugagacacacaauugagaauaguaccgcaaacgucucccuggccgcgaucgcuaaccaggccguaguguuaaugggacuagacaaaggcuggccaauaagcaagauggaccugggggcaccucuccuugcccugggaugcuacucucagguuaaucccuugacucugacggcugccgugcuccugcuuauuacacauuaugcaaucaucggcccggguuuacaggcuaaagccaccagggaggcgcaaaagcggacugccgcagggauuaugaagaacccaaccgucgauggaaucaugacaauagaccuggauccugugauuuacgacucaaaauucgaaaagcagcucggccaggucauguugcuggugcuaugugcuguucagcugcuccuuaugcgcacuuccugggcccugugcgaggcauugacccuggcuacaggucccaucacgacccucugggaaggcaguccagggaaauuuuggaauacuacaauugccgugagcauggccaacaucuucagaggaucguaucuggcgggcgcuggguuagcauuuucuauaaugaaguccguaggaaccggcaaaagggguacugggagccaaggagagacacuuggcgaaaaguggaagaaaaagcugaaucagcucucacggaaagauuucgaccuauacaagaaaagugguaucaccgagguggaucgaacggaggccaaggaaggccugaaaagaggggagauuacccaccaugcugucucucgcggauccgccaaguugcagugguuuguugaaaggaacauggugauccccgagggccgggucauugaccugggguguggacguggcgguuggagcuauuacugcgcagggcucaagaaagugacagaaguaagaggauauacuaagggcggcccugggcacgaggagccggugcccaugucaaccuacggauggaauaucguuaaacuuaugagugguaaggauguguucuaccugccaccugaaaaaugugacacauugcugugcgauauuggcgagagcucccccucuccuacugucgaagagagcaggaccauccgcgugcucaagauggucgagccaugguuaaagaacaaucaguucuguauaaaagugcugaaccccuauaugccuacaguuauugaacaccuugagcggcugcaacgaaagcaugggggaaugcuaguaagaaauccacucuccaggaacucaacccacgaaauguacuggaucucuaauggcacugguaacaucguggccagugucaauauggugucgcgccuguugcugaaccgguuuacgaugacacauagacgucccaccauugagaaagacguugaucucggggcuggaacuaggcacgugaacgcggaaccggagaccccuaauauggacgucauaggcgagcggaucaagcgcauuaaagaagaacacaacagcacauggcauuaugacgaugaaaauccauacaagacgugggccuaucacggcuccuacgaggugaaggcaaccgggucugcuucaagcaugaucaacggaguagugaaacuucugacuaagcccugggacguugucccuauggugacacagauggccaugaccgauacuacaccauucggucagcaacgaguguuuaaagaaaaggucgacaccagaacacccagguccaugccgggcacucggcgcguuauggggauuaccgcagagugguuauggagaacgcugggaaggaauaaaaagccucgauugugcacccgggaggaguucacaaagaaagugcguacuaacgccgcuaugggcgccguauuuaccgaggaaaaucagugggauagugcgaaggcagccguggaggacgaagauuucuggaaacucgucgacagagagcgcgagcugcauaagcuagguaaaugugggucuugcguguauaacaugaugggaaagagggagaagaaacuuggcgaguuuggcaaagcuaaagggagccgggccaucugguacauguggcugggagcaagauaccucgaguucgaggcucugggauuuuugaaugaggaucacugguucucacgcgaaaacuccuauaguggcguugagggggaaggacugcauaagcucggcuacauacuuagggacaucagcaaaauucccgguggggccauguaugcugaugacacagccggaugggacacucgaaucaccgaggaugaccugcacaaugaagagaagauuacgcagcagauggauccagagcaccggcaauuagcaaacgcgaucuuuaaacugacauaccagaauaagguggucaaggugcagagaccuacccccacuggcacaguaauggacauaauuucuaggaaagaucagcgcggcuccgggcaaguuggaaccuaugguuugaacacuuucaccaauauggaagcccagcucauccgucagauggagggcgaaggggugcugucaaaggcugaccuagagaacccacaucuucccgagaaaaagaucacacaguggcuggagacgaaaggagucgagcggcucaagagaauggccauuagcggcgaugacugcguggugaagccuauagaugacagguuugcaaacgcucuguuggccuuaaaugauauggguaaaguccgcaaggacaucccacaauggcagccgucgaaaggguggcacgauuggcagcagguucccuucuguucucaucacuuccacgaacugauuaugaaggacggacgaaaacucgugguaccuugccggccacaagacgagcuuaucggcagagcaaggauuagucagggcgccggguggucccugaaggaaaccgcgugucuaggaaaggcuuacgcccagauguggagccugauguauuuucaucgcagagaucuccgguuggcaucaaacgccaucugcuccgcugugcccguccacugggugccuacuucuaggacaaccuggagcauacaugcccaccaucaauggaugacuacagaggacaugcugaccguuuggaaucguguguggaucgaagauaacccauggauggaggacaaaacgcccgucacaaccugggagaaugugccuuaccuugguaagcgagaagaucagugguguggcagucugauugggcucacuucccgcgcaaccugggcucagaacaucccgacagccauucagcaaguaaggagcuuaaucggaaaugaggaguuccuggacuacaugccaucuaugaaacgguuuaggaaggaggaggaaucagagggcgcgauuugguga

SEQ ID NO: 15344 - RNA, 9873 nt, Artificial Sequence
  derived and/or modified CDS sequence (opt3) from DENV-3__FJ898458__SS-prME
accagccugugccucaugaugauccuucccgccgcucuggcauuccacuugacauccagagacggcgagccuaggaugauuguggggaagaacgaacggggaaaaacuuuacuguuuaagacggccucugguauaaauauguguacccuaaucgcgauggaucucggcgagaugugcgacgauacagucacuuacaaauguccacauauuaccgaaguugagccggaagacaucgauugcugguguaaccugacaucaaccugggugacuuaugggacaugcaaucaggcuggagagcaccgccgagacaagcguaguguagcccuugcaccccaugugggcaugggucuggauaccagaacgcaaacuuggaugagcgccgagggggcuuggaggcaggucgaaaaaguggagaccugggcauugcggcacccuggauucacaauucucgcccuguuucuggcucauuacaucggcacuucccucacccagaagguugugauauucaucuuacugaugcuugucacaccaucuaugaccaugcgcugugugggcguagggaacagagacuuuguugaaggauugucgggugccacguggguggaugucgugcuggagcacggcgggugcgugacuacaauggcgaagaauaaacccacccuagacauugagcuccagaagacugaagcaacacaacuggccacccuuaggaaacuguguaucgagggaaagauuacgaacaucaccacagauucacggugcccuacucagggcgaagcugucuugccagaggaacaggaccagaauuauguuuguaaacacaccuacguggaucgcgguugggggaacggaugcggccucuucggcaaggggagccugguaacaugcgccaaguuucaauguuuagagcccauagagggaaaagugguccaguaugaaaaucugaaguacacugugauuaucaccguucauacaggugaccagcaccaggugggcaacgagacccaaggggucacugcagaaauuacgccucaggcuaguacaaccgaggccauccucccagaauauggaacucuuggccuggagugcuccccgcgaaccgguuuggacuucaaugagaugauccuacugacaaugaaaaacaaggcguggauggugcauagacagugguuuuucgaucucccccugccuuggaccucuggggccacuacagaaacgccaaccuggaauaggaaagagcuucugguaacuuuuaagaacgcacacgcuaaaaagcaagaaguuguggucuugggcagccaggagggagccaugcacacagcucucaccggcgccacagaaauucagaauuccgggggaacuucaauauucgcaggucaucugaagugucgguuaaaaauggacaagcuggagcuaaaaggcaugaguuacgccaugugcaccaacacguuugugcucaagaaagaggucagcgaaacccagcacgggacaauccugauuaagguggaguacaagggagaagauguucccuguaaaaucccuuucucuacugaggacggccaugguaaggcucacaacgggcgucuuauaaccgcgaauccagugguaacaaaaaaggaggaacccgucaacauugaggcagaaccgccuuucggcgaguccaauaucgugaucggaauuggcgauaacgccuugaaaaucaauugguauaagaaggggucaagcauuggaaaaauguuugaagcuacugcccgcggugcaagaaggauggccauacugggcgacaccgcuugggauuucgggaguguuggaggcgugcucaacucucuggguaagaugguccaucaaaucuuuggguccgccuacacggcacuuuucagcggcgugucguggguaaugaaaauuggaaucggcgugcuguugacauggaucgggcucaauucuaagaacaccuccaugucauuuaguugcauugcgauaggaaucauuacucuguauuuaggcgcuguuguccaggccgacauggguugugugaucaauuggaaagggaaggagcugaagugcggaagcggcauuuucgugacaaacgagguccacaccuggacugaacaguacaaauuucaggcagauucccccaagcggcuagccaccgcuaucgccggugcaugggagaauggcguuugugggauacgaucuacaacgcgcauggaaaaccuccuguggaaacaaaucgcuaaugagcuuaacuauauuuugugggaaaauaacaucaagcugaccguggugguaggagacauuaucggcguccucgagcaggggaaaagaacucugacaccacagccuauggaguuaaaguacagcuggaaaaccuggggaaaggccaagauagugacagcggaaacucagaacucaaguuucauuaucgauggccccaauaccccagagugccccuccgccagcagggcuuggaacguuugggaaguggaggacuaugguuuuggggucuucacgacaaauauuuggcugaaacuucgggaaguguacacccaauugugugaccaccgccucaugucugcagccguuaaggaugagagagcugugcaugccgacaugggauacuggaucgagucacagaaaaacggcaguuggaagcuggaaaaagcaagccuaauagagguaaagacuugcaccuggccuaagucccacacacuguggucuaaugguguccucgaaucggauaugaucauuccaaaaagccuggcgggcccgaucucccagcauaaccacaggcccggguaucacacucagaccgccggaccuuggcaucuuggcaaguuggagcuggacuuuaauuacugcgaggggacaacgguggugauuaccgaaaacuguggaacucguggcccaucauuacggacaaccacugucagugguaaacucauccacgaguggugcugucgaucuugcacacugcccccucuuagauauaugggggaagauggauguugguacggcauggagauaaggccaauuagcgaaaaggaggagaauaugguuaaaucccuggugucagcugguagcggcaagguagacaacuucaccauggggguguugugccucgccauccuguuugaagaggucaugcgcggaaaguucggcaaaaagcauaugaucgcagggguguucuuuacguucguucuacugcucucuggacaaauuacuuggcgggauauggcucacacccugaucaugauuggcuccaaugccagugacagaauggguaugggggugacauaucuugcauugauagccaccuuuaaaauccagcccuuccuggcuuuaggauuuuuccucaggaagcugacuagccgcgaaaaccuucugcuaggcgucggccucgcgauggccacaacccugcaguugccggaggauauugaacaaauggcaaaugggaucgcucugggauuaauggcccucaaacugauuacacaguuugagacuuaccagcuuuggaccgcccugaucucuuugacguguuccaacacaauauucacccucacuguggcuuggcgaaccgcaacacugauccuagccgguguuucacugcuuccugugugccagaguagcucgaugcggaagacugacuggcucccaaugaccgucgcggcuaugggcguacccccucugcccuuguuuauuuucucccugaaggauacguuaaaacguagaucuuggccacucaaugagggggugauggccguuggacuggugagcauccuugcaucaagucuguugaggaacgacgucccuauggccggcccccucguggcuggugggcugcuaauugcauguuauguaaucacaggaaccuccgccgaucugacuguggaaaaggcggcugacauaacaugggaggaagaggccgaacaaaccggcgucucucauaaccuuaugauuacuguugacgaugacggcacaaugcgcaucaaagaugacgagaccgagaauauccucacggugcuguugaagacugcauuacugauugugagcgggauauuuccauacuccaucccggccacccuccuggucuggcacacauggcagaaacagacccagcggucaggagugcuuugggauguuccuagccccccagaaacacaaaaggcugagcuggaagaggguguauacagaauuaaacagcagggcaucuucgggaagacucaggugggagucggcgugcaaaaggaggguguuuuucacaccauguggcaugugacgaggggggccgucuugacauauaacggaaaacgacuagaacccaauugggcaagugugaagaaagaccugauuucuuacggcggcggguggcgccucuccgcucaguggaagaaaggagaggaaguacaggucaucgccguggagccugguaagaacccaaagaauuuccaaacuaugcccggcaccuuccagacaaccacuggggaaauaggagcgaucgcccuggauuuuaaaccuggcaccagcgguucgccgauuaucaaccgggaggggaagguugugggacuuuauggcaauggcgucgugacaaaaaacgggggauacguuucagguauugcacagacgaaugcugagccagacggccccacuccugaauuagaggaagagauguucaagaaaagaaaccugaccaucauggaucuccacccagggucuggaaagacaaggaaguauuugcccgccauagugcgugaagcuauuaaacgccggcugagaacccucauccuggcaccuacuagggucguggccgccgagauggaggaagcucuuaagggccugccgauccgauaccagacaaccgcgacgaaaagugagcauacuggucgggaaauuguagacuugaugugccacgcaacauuuaccaugcgccuacugucccccgugagaguuccaaauuauaaccucaucauaauggaugaggcccauuucaccgacccugcuagcauugccgcaaggggguacaucucuacucgggucggaaugggcgaagccgcugcgauuuuuaugacagccacccccccaggcacagcagaugcuuucccucaaagcaaugcccccauccaggacgaggagcgagacauaccagaaagauccuggaacucagggaaugaguggauuacugauuuugcaggaaagacggugugguucgugccgaguaucaaagccgguaacgacaucgcuaacuguuuacgcaagaauggcaagaaagucauucagcugagcaggaagaccuuugauacagaauaccagaaaacuaagcuuaacgacugggauuucguagugaccacagacaucucugagaugggggccaauuuuaaagcggaucguguuauugacccucggagaugccugaagcccgugauacucaccgauggaccagagagggucaucuuggcaggccccaugccugugacugccgcuuccgccgcucaacgccgagguagaguugggcggaacccacagaaggaaaaugaccaguauauuuucacgggccagccccugaacaaugaugaggaccacgcacacuggaccgaagccaaaaugcuccuggacaacaucaauacaccugagggaaucauuccggcucuuuucgaaccagagagggagaagucagccgcaauagauggcgaauaccgccuaaaaggggagagucguaagacuuuuguggaacugaugagacggggagacuugcccgucugguuagcgcauaaaguggccagcgaggguaucaaguauaccgauaggaaauggugcuucgacggccaacgcaacaaucagauucuggaagagaacauggauguagagaucuggacaaaggaaggggagaagaaaaagcuccgaccuagauggcuggacgcucggaccuacuccgauccccuugcccugaaagaauuuaaggacuucgcagcuggaaggaaaucuauugcccucgauuuggugacugagaucggccgcguuccaucgcaccuggcacauagaacaaggaaugcccuagacaaccuggucaugcuccacacgagcgaacacggugggcgggcuuaucgucaugcgguggaggagcuuccugaaaccauggagacucuguuauugcugggccucaugauacugcuuacaggaggcgccaugcuguuucucaucucagggaagggaauugguaagaccuccaucggcuugauuugugugaucgcaaguucugggaugcuguggauggcugaaauacccuuacaguggauugccagcgccaucguccuagaguucuuuaugaugguucugcucauuccagagccugaaaaacagcgcaccccgcaagauaaucagcuugcauacgugguaaucggaauacugacauuggcugccaucauugcggcuaacgagaugggccugcucgaaacuacgaagcgagaccuggguauguccaaagagcccgggguggucucaccaaccucuuaucuugauguggaccuccacccugccagcgcauggacacuguacgccguugcuacuaccgugaucacacccauguugagacauaccauugaaaauaguacugcaaacgucucccuggccgcgaucgcuaaccaggccguaguguuaaugggccuagacaagggauggccaauaagcaaaauggaucugggcguuccucuccuugcacuggggugcuacucucaagugaaucccuugacgcugacagccgcuguccuccugcuuauuacccacuaugccaucaucggaccgggcuuacaggcaaaggcuacuagggaggcccagaagcggaccgcggccgguauuaugaaaaacccaacaguggacgggaucaugacuauagaucuggacccugucauuuacgauucaaaguucgagaaacagcucggacaagugauguugcugguucuaugugcagugcagcugcuccuuaugcgcaccuccugggcucugugcgaagccuugacacuggcaacgggccccaucaccacucucugggaggguaguccaggcaaguuuuggaauacaaccauugcuguaagcauggccaacaucuucagagggucguaucuggccggagcgggcuuagcuuuuucuauaaugaaauccguggggacuggaaagaggggcacagguagccagggggaaacccuuggagagaaguggaaaaagaaacugaaucagcucucacggaaggaauucgaccuauacaaaaagaguggcaucacggaggucgaucgaaccgaggcaaaagaaggucugaagagaggcgagauuacacaucacgccguuucucgcggguccgcuaaguugcaaugguuuguggaaaggaacauggucauccccgagggacgggugauugaccugggcugugggcguggaggcuggagcuauuacugcgccggucucaaaaagguaacugaagugagaggguauaccaaaggaggcccuggccacgaggagccgguucccaugucaacauacggguggaauaucgugaagcuuaugaguggaaaagaugucuucuaccugccaccugaaaagugugacacuuugcugugcgauauuggugagagcucccccucuccuaccguggaagagagcaggacaauccgcguccucaagaugguggagccaugguuaaaaaacaaucaguucuguauaaagguucugaaccccuauaugccuaccguaauugaacaucuugagcggcugcagcgaaaacacggcgggaugcuagugagaaauccacucuccaggaacucaacucaugaaauguacuggaucucuaauggaacgggcaacaucgucgcaagugugaauaugguuucgcgccuguugcugaaccgguuuacaaugacccacagacgucccacuauugagaaggacguggaucucggugccgggaccaggcacgucaacgcugaaccggagacaccuaauauggacgugauaggagagcggaucaaacgcauuaaggaagagcauaacagcacguggcacuaugacgaugaaaauccauacaagaccugggcguaucauggcuccuacgagguaaaagccacuggcucugcaucaagcaugaucaacggggugguuaagcuucugacaaaacccugggacgucgugccuauggugacccagauggcuaugacugauacaaccccauucggacaacagcgagucuuuaaggaaaaaguugacacaagaacucccagguccaugccggguacccggcgcgugaugggcauuacggccgagugguuauggagaacccuggggaggaauaagaagccucgauugugcacacgggaggaauucacuaaaaagguacguaccaacgcagccaugggagcuguguuuacagaggaaaaucagugggauagugccaaagcggcagucgaggacgaagauuucuggaagcucguggacagagagcgcgagcugcacaaacuaggcaagugugguucuugcguuuauaacaugauggggaaaagggaaaagaagcuuggagaguuuggcaaagccaagggcagccgggcuaucugguacauguggcugggggccagauaccucgaauucgaggcacugggauuuuugaaugaggaucauugguucucacgcgaaaacuccuauagugguguggagggcgaagggcugcacaaacucggauacauacuuagggacaucagcaagauucccggcggugcuauguaugccgaugacacugcugggugggacacccgaaucacggaggaugaccugcacaaugaagagaaaauuacacaacagauggauccagagcaucggcaguuagccaacgcaaucuuuaagcugaccuaccagaauaaggucgugaaaguacaaagaccuacucccacaggaaccguuauggacauaauuucuaggaaggaucagcgcggcuccggccagguggggacuuauggauugaacaccuucacaaauauggaagcgcagcucauccgucaaauggagggugaaggcguccugucaaaagccgaccuagagaacccacaccuucccgaaaagaaaaucacgcaguggcuggagaccaaggggguggagcggcucaagagaauggcuauuagcggagaugacugcguggucaaaccuauagaugacagguuugccaacgcacuguuggcuuuaaaugauaugggcaagguucgcaaagacaucccacaguggcagccgucgaaggguuggcaugauuggcaacaggugcccuucuguucucaccacuuccaugaacugauuaugaaagacgggcgaaagcucguagugccuugccggccacaggacgagcuuaucggaagagccaggauuagucagggcgcaggcuggucccugcgcgaaacugccugucuagggaaggcguacgcucaaauguggagccugauguauuuucacagacgggaucucagguuggccucaaacgcaaucugcuccgccguccccgugcauuggguuccuacaucucguaccacuuggagcauacacgcucaucaccaguggaugacaaccgaggacaugcugacgguguggaaucgagucuggaucgaagauaacccauggauggaggacaaaacacccgugaccacuugggagaauguaccuuaccuuggaaagcgcgaagaucaguggugugguagucugauuggccucaccuccagagccacaugggcacaaaacaucccgacugcuauucagcagguucggagcuuaaucgggaaugaggaauuccuggacuacaugccaucuaugaaaagguuucgcaaggaggaggaaucagagggagccauuugguga

SEQ ID NO: 15345 - RNA, 9873 nt, Artificial Sequence
  derived and/or modified CDS sequence (opt3) from DENV-3__KJ189256__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaugguaaggcucacaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaucaaaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccacacauggaccgaacaguacaaauuucaggcagauucucccaagcggcuagccacugcuaucgccggugcaugggagaauggcguuugugggauacgaagcaccacacgcauggaaaaccuccuguggaaacaaaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacagaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaauugugugaccaccgccucaugucagcagccguuaaggaugagagagcugugcaugccgacaugggauacuggaucgagagucagaaaaacggcagcuggaagcuggaaaaagcaucccuaauagagguaaagaccugcacuuggccuaagucucacacccuguggucgaaugguguccucgaaagcgauaugaucauuccaaaaucccuggcgggcccgaucucacagcauaaccacaggcccggguaucacacacagacugccggaccuuggcaucuuggcaaguuggagcuggacuuuaauuacugcgaggggaccacaguggugauuacggaaaacuguggaacccguggcccaaguuuacggacuacaaccgucucugguaaacucauccacgaguggugcugucgaagcugcacucugcccccucuuagauauaugggggaagauggauguugguacggcauggagauaaggccaauuuccgaaaaggaggagaauaugguuaaaucacuggugagcgcugguucuggcaagguagacaacuucacaauggggguguugugccucgccauccuguuugaagaggucaugcgcggaaaguucggcaaaaagcauaugaucgcagggguguucuuuaccuucguucuacugcucuccggacaaauuacguggcgggauauggcucacacucugaucaugauuggcaguaaugccagcgacagaauggguaugggggugaccuaucuugcauugauagccacauuuaaaauccagcccuuccuggcuuuaggauuuuuccucaggaagcugaccucucgcgaaaaccuucugcuaggcgucggccucgcgauggccacuacacugcaguugccggaggauauugaacaaauggcaaaugggaucgcucugggauuaauggcccucaaacugauuacccaguuugagacauaccagcuuuggacugcccugaucuccuugaccuguucaaacacgauauucacacucaccguggcuuggcgaacugcaacccugauccuagccgguguuagucugcuuccugugugccagagcucguccaugcggaagacagacuggcucccaauggcggucgcugccaugggcguacccccucugcccuuguuuauuuucucucugaaggauacuuuaaaacguagaagcuggccacucaaugagggggugauggcaguuggacuggugucaauccuugccaguucccuguugaggaacgacgucccuauggcuggcccccucguggcaggugggcugcuaauugccuguuauguaaucaccggaacgucugcggaucugacaguggaaaaggcugccgacauaaccugggaggaagaggcagaacaaacuggcgucagccauaaccuuaugauuacaguugacgaugacggcaccaugcgcaucaaagaugacgagacugagaauauccucacagugcuguugaagaccgccuuacugauuguguccgggauauuuccauacucaaucccggcuacgcuccuggucuggcacacuuggcagaaacagacccagcggagcggagugcuuugggauguuccuagucccccagaaacacaaaaggccgagcuggaagaggguguauacagaauuaaacagcagggcaucuucgggaagacccaggugggagucggcgugcaaaaggaggguguuuuucacacaauguggcaugugacuaggggggcagucuugaccuauaacggaaaacgacuagaacccaauugggcuucugugaagaaagaccugauuuccuacggcggcggguggcgccucagcgcccaguggcagaagggagaggaaguacaagucaucgcgguggagccugguaaaaacccaaagaauuuccagacgaugcccggcacauuccagacuaccacaggggaaauaggagccaucgcacuggauuuuaagccuggcaccucggguucaccgauuaucaaccgggaggggaaaguugugggacuuuauggcaauggcgucgugacuaagaacgggggauacguuucugguauugcucagaccaaugccgagccagacggccccacaccugaauuagaggaagagauguucaaaaagagaaaccugacgaucauggaucuccacccagggaguggaaaaacuaggaaguauuugcccgcuauagugcgugaagcaauuaagcgccggcugagaacccucauccuggccccuacaagggucguggccgcugagauggaggaagcgcuuaaaggccugccgauccgauaccaaaccacugcaacaaaguccgagcauaccggucgggaaauuguagacuugaugugccacgccacguuuacuaugcgccuacugagccccgugagaguuccaaauuauaaccucaucauaauggaugaggcucauuucacagacccugccucuauugcagccaggggguacaucagcacccgggucggaaugggcgaagcugcggccauuuuuaugaccgcaacucccccaggcacagcugaugccuucccucaguccaaugcacccauccaggacgaggagcgagacauaccagaaagaucauggaacagugggaaugaguggauuaccgauuuugccggaaaaacagugugguucgugccgagcaucaaggcugguaacgacaucgccaacuguuuacgcaaaaauggcaagaaggucauucagcugucuaggaaaacuuuugauacggaauaccaaaagaccaaacuuaacgacugggauuucguagugacaacugacaucuccgagaugggggcgaauuuuaaggcagaucguguuauugacccucggagaugccugaaacccgugauacucaccgauggaccagagagggucaucuuggccggccccaugccugugacagcugccucagcugcacagcgccgagguagaguugggcggaacccacagaaggaaaaugaccaguauauuuucaccggccaaccccugaacaaugaugaggaccacgcccacuggacugaagcuaagaugcuccuggacaacaucaauacgccugagggaaucauuccggcccuuuucgaaccagagagggagaaaagugcagcgauagauggcgaauaccgccuaaagggggagagccguaaaaccuuuguggaacugaugagacggggagacuugcccgucugguuagcccauaagguggcuuccgaggguaucaaauauacagauaggaaguggugcuucgacggccagcgcaacaaucagauucuggaagagaacauggauguagagaucuggacuaaagaaggggagaagaagaaacuccgaccuagauggcuggacgcccggaccuacucugauccccuugcacugaaggaauuuaaagacuucgcugccggaaggaagucgauugcacucgauuuggugacagagaucggccgcguuccaagccaccuggcccauagaaccaggaaugcucuagacaaccuggucaugcuccacacuucagaacacggugggcgggcguaucgucaugccguggaggagcuuccugaaacaauggagacgcuguuauugcugggccucaugauacugcuuaccggaggcgcaaugcuguuucucaucuccgggaaaggaauugguaagacuaguaucggcuugauuugugugaucgcuucuagcgggaugcuguggauggccgaaauacccuuacaguggauugccuccgcaaucguccuagaguucuuuaugaugguucugcucauuccagagccugaaaagcaacgcacaccgcaggauaaucagcuugcuuacgugguaaucggaauacugaccuuggccgcgaucauugcugccaacgagaugggccugcucgaaaccacaaaacgagaccuggguaugucaaaggagcccgggguggucucuccaacuagcuaucuugauguggaccuccacccugcaagugccuggacgcuguacgcuguugcaaccacagugaucacucccauguugagacauaccauugaaaauuccacagccaacgucagccuggcggcuaucgccaaccaagcaguaguguuaaugggccuagacaaaggauggccaauaucuaagauggaucugggcguuccucuccuugcccuggggugcuacucacaggugaaucccuugacccugacugcugccguccuccugcuuauuacgcacuaugcaaucaucggaccgggcuuacaggcuaaagccacaagggaggcgcagaagcggaccgccgcagguauuaugaagaacccaacuguggacgggaucaugaccauagaucuggacccugucauuuacgauuccaaauucgagaagcaacucggacaggugauguugcugguucuaugugcugugcagcugcuccuuaugcgcacaaguugggcccugugcgaagcauugacucuggcuaccggccccaucacaacgcucugggaggguagcccaggcaaauuuuggaauaccacuauugccguaucgauggccaacaucuucagagggucuuaucuggcgggagcuggcuuagcauuuuccauaaugaagagcguggggacaggaaaaaggggcaccgguucacagggggaaacucuuggagagaaguggaagaaaaagcugaaucaacucagucggaaagaauucgaccuauacaagaaaucuggcaucacagaggucgaucgaaccgaggccaaggaaggucugaaaagaggcgagauuacgcaucacgcuguuucccgcgggagcgccaaguugcagugguuuguggaaaggaacauggucauccccgagggacgggugauugaccugggcugugggcguggaggcuggucauauuacugcgcaggucucaagaaaguaaccgaagugagaggguauacaaagggaggcccuggccacgaggagccgguucccaugaguacuuacggguggaauaucgugaaacuuaugagcggaaaggaugucuucuaccugccaccugaaaaaugugacaccuugcugugcgauauuggugaguccucucccagcccuacaguggaagaguccaggacuauccgcguccucaagaugguggagccaugguuaaagaacaaucaguucuguauaaaaguucugaaccccuauaugccuaccguaauugaacaucuugagcggcugcagcgaaagcacggcgggaugcuagugagaaauccacucucaaggaacucuacacaugaaauguacuggaucaguaauggaaccggcaacaucgucgccucggugaauaugguuagccgccuguugcugaaccgguuuacuaugacgcacagacgucccacaauugagaaagacguggaucucggugcugggaccaggcacgucaacgcggaaccggagacuccuaauauggacgugauaggagagcggaucaagcgcauuaaagaagagcauaacuccaccuggcacuaugacgaugaaaauccauacaagacaugggccuaucauggcucuuacgagguaaaggcaacgggcucagcuagcuccaugaucaacggggugguuaaacuucugaccaagcccugggacgucgugccuauggugacucaaauggccaugacagauaccacuccauucggacagcagcgagucuuuaaagaaaagguugacacaagaacccccaggaguaugccggguacacggcgcgugaugggcauuacugcagagugguuauggagaacccuggggaggaauaaaaagccucgauugugcacgcgggaggaauucaccaagaaaguacguacaaacgccgcuaugggagccguguuuacugaggaaaaucaaugggauucugcgaaggcagccgucgaggacgaagauuucuggaaacucguggacagagagcgcgagcugcacaagcuaggcaaaugugguagcugcguuuauaacaugauggggaagagggaaaaaaagcuuggagaguuuggcaaggcuaaaggcucacgggccaucugguacauguggcugggggcaagauaccucgaauucgaggcucugggauuuuugaaugaggaucauugguucucccgcgaaaacaguuauagcgguguggagggcgaagggcugcacaagcucggauacauacuuagggacaucucuaaaauucccggcggugccauguaugcugaugacaccgccgggugggacacacgaaucacugaggaugaccugcacaaugaagagaagauuacccagcagauggauccagagcaucggcaguuagcaaacgcgaucuuuaaacugacguaccaaaauaaggucgugaagguacagagaccuacacccaccggaacuguuauggacauaauuuccaggaaagaucagcgcggcucaggccagguggggacauauggauugaacaccuucacuaauauggaagcccaacucauccgucagauggagggugaaggcguccugagcaaggcugaccuagagaacccacaccuucccgaaaaaaagaucacccaguggcuggagacaaaagggguggagcggcucaagagaauggccauuucgggagaugacugcguggucaagccuauagaugacagguuugcaaacgcucuguuggccuuaaaugauaugggcaaaguucgcaaggacaucccacaguggcaaccgucuaaagguuggcaugauuggcagcaggugcccuucuguagucaccacuuccaugaacugauuaugaaggacgggcgaaaacucguagugccuugccggccacaggacgagcuuaucggaagagcaaggauuucccaaggcgccggcuggagccugcgcgaaacggcgugucuagggaaggcuuacgcccagauguggucacugauguauuuucacagacgggaucucagguuggcauccaacgccaucugcucugcuguccccgugcauuggguuccuaccagccguacuacauggaguauacacgcccaucaccaguggaugaccacugaggacaugcugacaguguggaaucgagucuggaucgaagauaacccauggauggaggacaagacccccgugacgacaugggagaauguaccuuaccuuggaaaacgcgaagaucaauggugugguucccugauuggccucaccagcagagcaacuugggcucagaacaucccgaccgccauucagcagguucggucuuuaaucgggaaugaggaauuccuggacuacaugccaucaaugaagagguuucgcaaagaggaggaaagugagggagcgauuugguga

SEQ ID NO: 15346 - RNA, 9873 nt, Artificial Sequence
  derived and/or modified CDS sequence (opt3) from DENV-3__KJ189257__SS-prME
accagccugugccucaugaugauccuucccgccgcucuggcauuccacuugacuuccagagacggcgaaccuaggaugauuguggggaagaacgaacggggaaaaucuuuacuguuuaagacugccucagguauaaauauguguacgcuaaucgcgauggaucucggcgaaaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaugguaaggcucacaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaucaaaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccacacauggaccgaacaguacaaauuucaggcagauucucccaagcggcuagccacugcuaucgccggugcaugggagaauggcguuugugggauacgaagcaccacacgcauggaaaaccuccuguggaaacaaaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacagaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaauugugugaccaccgccucaugucagcagccguuaaggaugagagagcugugcaugccgacaugggauacuggaucgagagucagaaaaacggcagcuggaagcuggaaaaagcaucccuaauagagguaaagaccugcacuuggccuaagucucacacccuguggucgaaugguguccucgaaagcgauaugaucauuccaaaaucccuggcgggcccgaucucacagcauaaccacaggcccggguaucacacacagacugccggaccuuggcaucuuggcaaguuggagcuggacuuuaauuacugcgaggggaccacaguggugauuacggaaaacuguggaacccguggcccaaguuuacggacuacaaccgucucugguaaacucauccacgaguggugcugucgaagcugcacucugcccccucuuagauauaugggggaagauggauguugguacggcauggagauaaggccaauuuccgaaaaggaggagaauaugguuaaaucacuggugagcgcugguucuggcaagguagacaacuucacaauggggguguugugccucgccauccuguuugaagaggucaugcgcggaaaguucggcaaaaagcauaugaucgcagggguguucuuuaccuucguucuacugcucuccggacaaauuacguggcgggauauggcucacacucugaucaugauuggcaguaauaccagcgacagaauggguaugggggugacauaucuugccuugauagcaaccuuuaaaauccagcccuuccuggccuuaggauuuuuccucaggaagcugacuucucgcgaaaaccuucugcuaggcgucggccucgcuauggcgacaacccugcaguugccggaggauauugaacaaauggccaaugggaucgcacugggauuaauggcucucaaacugauuacacaguuugagacuuaccagcuuuggaccgcccugaucuccuugacguguucaaacacaauauucacccucacuguggccuggcgaaccgcuacacugauccuagccgguguuagucugcuuccugugugccagagcucguccaugcggaagacugacuggcucccaauggccgucgcggcuaugggcguacccccucugcccuuguuuauuuucucucugaaggauaccuuaaaacguagaagcuggccacucaaugagggggugauggccguuggacuggugucaauccuugcaaguucccuguugaggaacgacgucccuauggccggcccccucguggcuggugggcugcuaauugcauguuauguaaucacgggaacaucugccgaucugaccguggaaaaggcggcugacauaacuugggaggaagaggccgaacaaacaggcgucagccauaaccuuaugauuaccguugacgaugacggcacuaugcgcaucaaagaugacgagacagagaauauccucaccgugcuguugaagacggcauuacugauuguguccgggauauuuccauacucaaucccggccacucuccuggucuggcacaccuggcagaaacagacacagcggagcggagugcuuugggauguuccuagucccccagaaacccaaaaggcugagcuggaagaggguguauacagaauuaaacagcagggcaucuucgggaagacacaggugggagucggcgugcaaaaggaggguguuuuucacacuauguggcaugugaccagaggggcagucuugacguauaacggaaaacgacuagaacccaauugggcaucugugaagaaagaccugauuuccuacggcggcggguggcgccucagcgcucaguggcagaagggagaggaaguacaagucaucgccguggagccugguaaaaacccaaagaauuuccagacaaugcccggcacuuuccagaccacaaccggggaaauaggagcgaucgcccuggauuuuaagccuggcacuucggguucaccgauuaucaaccgggaggggaaaguugugggacuuuauggcaauggcgucgugaccaagaacgggggauacguuucugguauugcacagacaaaugcugagccagacggccccacgccugaauuagaggaagagauguucaaaaagagaaaccugacuaucauggaucuccacccagggaguggaaaaaccaggaaguauuugcccgccauagugcgugaagcuauuaagcgccggcugagaacacucauccuggcaccuaccagggucguggccgccgagauggaggaagcucuuaaaggccugccgauccgauaccaaacuacagcgaccaaguccgagcauacgggucgggaaauuguagacuugaugugccacgcaacuuuuacaaugcgccuacugagccccgugagaguuccaaauuauaaccucaucauaauggaugaggcccauuucaccgacccugcuucuauugccgcaaggggguacaucagcacccgggucggaaugggcgaagccgcugcgauuuuuaugacugccacacccccaggcaccgcagaugcuuucccucaguccaaugcccccauccaggacgaggagcgagacauaccagaaagaucauggaacagugggaaugaguggauuacagauuuugcaggaaaaacugugugguucgugccgagcaucaaggccgguaacgacaucgcuaacuguuuacgcaaaaauggcaagaaggucauucagcugucuaggaaaacguuugauaccgaauaccaaaagacaaaacuuaacgacugggauuucguagugacuaccgacaucuccgagaugggggccaauuuuaaggcggaucguguuauugacccucggagaugccugaaacccgugauacucacagauggaccagagagggucaucuuggcaggccccaugccugugaccgccgcuucagccgcucagcgccgagguagaguugggcggaacccacagaaggaaaaugaccaguauauuuucacuggccaaccccugaacaaugaugaggaccacgcacacuggacggaagccaagaugcuccuggacaacaucaauaccccugagggaaucauuccggcucuuuucgaaccagagagggagaaaagugccgcaauagauggcgaauaccgccuaaagggggagagccguaaaacauuuguggaacugaugagacggggagacuugcccgucugguuagcgcauaagguggccuccgaggguaucaaauauacugauaggaaguggugcuucgacggccagcgcaacaaucagauucuggaagagaacauggauguagagaucuggaccaaagaaggggagaagaagaaacuccgaccuagauggcuggacgcucggacauacucugauccccuugcccugaaggaauuuaaagacuucgcagcuggaaggaagucgauugcccucgauuuggugaccgagaucggccgcguuccaagccaccuggcacauagaacuaggaaugcccuagacaaccuggucaugcuccacacaucagaacacggugggcgggcuuaucgucaugcgguggaggagcuuccugaaacgauggagacccuguuauugcugggccucaugauacugcuuacuggaggcgccaugcuguuucucaucuccgggaaaggaauugguaagacaaguaucggcuugauuugugugaucgcaucuagcgggaugcuguggauggcugaaauacccuuacaguggauugccuccgccaucguccuagaguucuuuaugaugguucugcucauuccagagccugaaaagcaacgcaccccgcaggauaaucagcuugcauacgugguaaucggaauacugaccuuggcugccaucauugcggcuaacgagaugggccugcucgaaacaacuaaacgagaccuggguaugucaaaggagcccgggguggucucuccaacgagcuaucuugauguggaccuccacccugccagugcauggacccuguacgccguugcuacaacugugaucacccccauguugagacauacaauugaaaauuccaccgcaaacgucagccuggccgcgaucgcuaaccaagccguaguguuaaugggccuagacaaaggauggccaauaucuaagauggaucugggcguuccucuccuugcacuggggugcuacucacaggugaaucccuugacucugacggccgcugucuuccuccugauuacacacuaugccaucaucggaccgggccuucaggcaaaagcuaccagggaggcccagaagcggacugcggccgguauuaugaagaacccaaccguggacgggaucaugacaauagauuuagacccugucauuuacgauuccaaauuugagaagcaacugggacaggugaugcucuugguucugugugcagugcagcuacugcucaugcgcacaaguugggcucuuugcgaagcccugaccuuggcaacaggccccaucacgacccugugggaggguagcccaggcaaauucuggaauacuacaauugcuguaucgauggccaacaucuuuagagggucuuaucucgccggagcgggccuggcuuucuccauaaugaaaagcguggggaccggaaaaaggggcacugguucacagggggaaacauuaggagagaaguggaagaagaaacuuaaucaacugagucggaaagaauuugaccucuacaagaaaucuggcaucaccgaggucgaucgaacggaggcaaaagaaggucuaaaaagaggcgagauuacccaucacgccguuucccgcgggagcgcuaagcugcagugguucguggaaaggaacauggucauccccgagggacgggugauugacuugggcugugggcguggaggcuggucauauuacugcgccggucugaagaaaguaacagaagugagaggguauacuaagggaggcccuggccacgaggagccgguucccaugaguaccuacggguggaauaucgugaaacucaugagcggaaaggaugucuucuaccuuccaccugaaaaaugugacacacuguugugcgauauuggugaguccucucccagcccuacuguggaagaguccaggaccauccgcguccugaagaugguggagccauggcucaagaacaaucaguuuuguauaaaaguuuuaaaccccuauaugccuacaguaauugaacaucuggagcggcuucagcgaaagcacggcgggaugcuggugagaaauccacuaucaaggaacucuacccaugaaauguacuggaucaguaauggaacuggcaacaucgucgcaucggugaauaugguuagccgccuccuguugaaccgguucacgaugacacacagacgucccaccauugagaaagacguggaucugggugccgggacuaggcacgucaacgcugaaccggagaccccuaauauggacgugauaggagagcggaucaagcgcauuaaagaggaacauaacuccacauggcacuaugacgaugaaaauccauacaagacgugggcguaucauggcucuuacgagguaaaggccaccggcucagcaagcuccaugaucaacggggugguuaaacuccuuacuaagcccugggacgucgugccuauggugacacaaauggcuaugaccgauacuacaccauuuggacagcagcgagucuucaaagaaaagguugacaccagaacacccaggaguaugccggguacucggcgcgugaugggcauuaccgccgaguggcuguggagaacguuagggaggaauaaaaagccucgacugugcacccgggaggaauuuacaaagaaaguacguacuaacgcagccaugggagcuguguucaccgaggaaaaucaaugggauucugccaaggcggcagucgaggacgaagauuuuuggaaauugguggacagagagcgcgagcuccacaagcugggcaaaugugguagcugcguuuauaacaugauggggaagagggagaagaagcuaggagaguucggcaaggccaaaggcucacgggcuaucugguacauguggcuuggggccagauaccuggaauuugaggcacucggauuccugaaugaggaucauugguuuucccgcgaaaacaguuauagcgguguggagggcgaaggguugcacaagcugggauacauacucagggacaucucuaaaauucccggcggugcuauguaugccgaugacacagcugggugggacacucgaaucaccgaggaugaccuucacaaugaagagaagauuacgcagcagauggauccagagcaucggcagcuggccaacgcaaucuucaaauuaacauaccaaaauaaggucgugaagguacagagaccuacccccacuggaacaguuauggacauaauuuccaggaaagaucagcgcggcucaggccagguggggaccuauggacugaacacuuuuaccaauauggaagcgcaauugauccgucagauggagggugaaggcguccucagcaaggccgaccuggagaacccacaccuacccgagaagaagaucacacaguggcuugagacgaaagggguggagcggcugaagagaauggcuauuucgggagaugacugcguggucaagccuauagaugacagguucgccaacgcacuccuggcuuugaaugauaugggcaaaguucgcaaggacaucccacaguggcaaccgucuaaagguuggcaugauuggcaacaggugcccuucuguagucaccacuuucaugaauuaauuaugaaggacgggcgaaaacugguagugccuugccggccacaggacgagcucaucggaagggccaggauuucccaaggcgcaggcuggagccuucgcgaaaccgccugucuggggaaggcguacgcucagauguggucacuaauguauuuccacagacgggaucugaggcucgccuccaacgcaaucugcucugccguccccgugcauuggguuccuacuagccguacaaccuggaguauacacgcucaucaccaguggaugacuacagaggacauguugaccguguggaaucgagucuggaucgaagauaacccauggauggaggacaagacgcccgugacaaccugggagaauguaccuuaccugggaaaacgcgaagaucaauggugugguucccuuauuggccugacuagcagagccaccugggcacagaacaucccgacagcuauucagcagguucggucucucaucgggaaugaggaauuuuuagacuacaugccaucaaugaagagguuccgcaaagaggaggaaagugagggagccauuugguga

SEQ ID NO: 15347 - RNA, 9873 nt, Artificial Sequence
  derived and/or modified CDS sequence (opt3) from DENV-3__KJ189262__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaugguaaggcucacaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaucaaaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccacacauggaccgaacaguacaaauuucaggcagauucucccaagcggcuagccacugcuaucgccggugcaugggagaauggcguuugugggauacgaagcaccacacgcauggaaaaccuccuguggaaacaaaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacagaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaauugugugaccaccgccucaugucagcagccguuaaggaugagagagcugugcaugccgacaugggauacuggaucgagagucagaaaaacggcagcuggaagcuggaaaaagcaucccuaauagagguaaagaccugcacuuggccuaagucucacacccuguggucgaaugguguccucgaaagcgauaugaucauuccaaaaucccuggcgggcccgaucucacagcauaaccacaggcccggguaucacacacagacugccggaccuuggcaucuuggcaaguuggagcuggacuuuaauuacugcgaggggaccacaguggugauuacggaaaacuguggaacccguggcccaaguuuacggacuacaaccgucucugguaaacucauccacgaguggugcugucgaagcugcacucugcccccucuuagauauaugggggaagauggauguugguacggcauggagauaaggccaauuuccgaaaaggaggagaauaugguuaaaucacuggugagcgcugguucuggcaagguagacaacuucacaauggggguguugugccucgccauccuguuugaagaggucaugcgcggaaaguucggcaaaaagcauaugaucgcagggguguucuuuaccuucguucuacugcucuccggacaaauuacguggcgggauauggcucacacucugaucaugauuggcaguaaugccagcgacagaauggguaugggggugaccuaucuugcauugauagccacauuuaaaauccagcccuuccuggcuuuaggauuuuuccucaggaagcugaccucucgcgaaaaccuucugcuaggcgucggccucgcgauggccacuacacugcaguugccggaggauauugaacaaauggcaaaugggaucgcucugggauuaauggcccucaaacugauuacccaguuugagacauaccagcuuuggacugcccugaucuccuugaccuguucaaacacgauauucacacucaccguggcuuggcgaacugcaacccugauccuagccgguguuagucugcuuccugugugccagagcucguccaugcggaagacagacuggcucccaauggcggucgcugccaugggcguacccccucugcccuuguuuauuuucucucugaaggauacuuuaaaacguagaagcuggccacucaaugagggggugauggcaguuggacuggugucaauccuugccaguucccuguugaggaacgacgucccuauggcuggcccccucguggcaggugggcugcuaauugccuguuauguaaucaccggaacgucugcggaucugacaguggaaaaggcugccgacauaaccugggaggaagaggcagaacaaacuggcgucagccauaaccuuaugauuacaguugacgaugacggcaccaugcgcaucaaagaugacgagacugagaauauccucacagugcuguugaagaccgccuuacugauuguguccgggauauuuccauacucaaucccggcuacgcuccuggucuggcacacuuggcagaaacagacccagcggagcggagugcuuugggauguuccuagucccccagaaacacaaaaggccgagcuggaagaggguguauacagaauuaaacagcagggcaucuucgggaagacccaggugggagucggcgugcaaaaggaggguguuuuucacacaauguggcaugugacuaggggggcagucuugaccuauaacggaaaacgacuagaacccaauugggcuucugugaagaaagaccugauuuccuacggcggcggguggcgccucagcgcccaguggcagaagggagaggaaguacaagucaucgcgauagagccugguaaaaacccaaagaauuuccagacgaugcccggcacauuccagacuaccacaggggaaaucggagccauugcacuggauuuuaagccuggcaccucggguucaccgaucauuaaccgggaggggaaagugguuggacuuuauggcaauggcguggucacuaagaacgggggauacgugucugguaucgcucagaccaaugccgagccagacggccccacaccugaauuagaggaagagauguucaaaaagagaaaccugacgauaauggaucuccacccagggaguggaaaaacuaggaaguauuugcccgcuauuguucgugaagcaaucaagcgccggcugagaacccucauccuggccccuacaaggguggucgccgcugagauggaggaagcgcuuaaaggccugccgauucgauaccaaaccacugcaacaaaguccgagcauaccggucgggaaaucguggacuugaugugccacgccacguuuacuaugcgccuacugagccccguaagagugccaaauuauaaccucauaauuauggaugaggcucauuucacagacccugccucuaucgcagccaggggguacauuagcacccggguuggaaugggcgaagcugcggccaucuuuaugaccgcaacucccccaggcacagcugaugccuucccucaguccaaugcacccauacaggacgaggagcgagacauuccagaaagaucauggaacagugggaaugaguggaucaccgauuuugccggaaaaacagucugguucgugccgagcaucaaggcugguaacgacauugccaacuguuuacgcaaaaauggcaagaaggugauccagcugucuaggaaaacuuuugauacggaauaccaaaagaccaaacuuaacgacugggauuucgucguaacaacugacauuuccgagaugggggcgaauuuuaaggcagaucgugugauagacccucggagaugccugaaacccguuauccucaccgauggaccagagagggugauuuuggccggccccaugccugucacagcugccucagcugcacagcgccgagguagaguggggcggaacccacagaaggaaaaugaccaguauaucuucaccggccaaccccugaacaaugaugaggaccacgcccacuggacugaagcuaagaugcuccuggacaacaucaauacgccugagggaauuauaccggcccuuuucgaaccagagagggagaaaagugcagcgaucgauggcgaauaccgccuaaagggggagagccguaaaaccuuuguugaacugaugagacggggagacuugcccgugugguuagcccauaaggucgcuuccgaggguauuaaauauacagauaggaaguggugcuucgacggccagcgcaacaaucagauccuggaagagaacauggauguggagauuuggacuaaagaaggggagaagaagaaacuccgaccuagauggcuggacgcccggaccuacucugauccccuugcacugaaggaauuuaaagacuucgcugccggaaggaagucgaucgcacucgauuugguaacagagauaggccgcgugccaagccaccuggcccauagaaccaggaaugcucuagacaaccugguuaugcuccacacuucagaacacggugggcgggcguaucgucaugccgucgaggagcuuccugaaacaauggagacgcuguuauugcugggccucaugauccugcuuaccggaggcgcaaugcuguuucucauuuccgggaaaggaaucgguaagacuaguauuggcuugaucugugugauagcuucuagcgggaugcuguggauggccgaaauucccuuacaguggaucgccuccgcaauugugcuagaguucuuuaugaugguccugcucaucccagagccugaaaagcaacgcacaccgcaggauaaucagcuugcuuacguugugauaggaauccugaccuuggccgcgauuaucgcugccaacgagaugggccugcucgaaaccacaaaacgagaccuggguaugucaaaggagcccgggguagugucuccaacuagcuaucuugaugucgaccuccacccugcaagugccuggacgcuguacgcuguggcaaccacaguuauuacucccauguugagacauaccaucgaaaauuccacagccaacgugagccuggcggcuauagccaaccaagcagucguauuaaugggccuagacaaaggauggccaauuucuaagauggaucugggcgugccucuccuugcccuggggugcuacucacagguuaaucccuugacccugacugcugccgugcuccugcuuaucacgcacuaugcaaucauuggaccgggcuuacaggcuaaagccacaagggaggcgcagaagcggaccgccgcagguaucaugaagaacccaacugucgacgggauaaugaccauugaucuggacccugugaucuacgauuccaaauucgagaagcaacucggacaggucauguugcuggugcuaugugcuguucagcugcuccuuaugcgcacaaguugggcccugugcgaagcauugacucuggcuaccggccccauuacaacgcucugggaggguagcccaggcaaauuuuggaauaccacuaucgccgugucgauggccaacauauucagagggucuuaucuggcgggagcuggcuuagcauuuuccaucaugaagagcguagggacaggaaaaaggggcaccgguucacagggggaaacucuuggagagaaguggaagaaaaagcugaaucaacucagucggaaagaauucgaccuauacaagaaaucuggcauuacagagguggaucgaaccgaggccaaggaaggucugaaaagaggcgagaucacgcaucacgcugucucccgcgggagcgccaaguugcagugguuuguugaaaggaacauggugauucccgagggacgggucaucgaccugggcugugggcguggaggcuggucauauuacugcgcaggucucaagaaagugaccgaaguaagaggguauacaaagggaggcccuggccacgaggagccggugcccaugaguacuuacggguggaauauuguuaaacuuaugagcggaaaggauguguucuaccugccaccugaaaaaugugacaccuugcugugcgauaucggugaguccucucccagcccuacagucgaagaguccaggacuauacgcgugcucaagauggucgagccaugguuaaagaacaaucaguucuguauuaaagugcugaaccccuauaugccuaccguuaucgaacaucuugagcggcugcagcgaaagcacggcgggaugcuaguaagaaauccacucucaaggaacucuacacaugaaauguacuggaucaguaauggaaccggcaacauuguggccucggucaauauggugagccgccuguugcugaaccgguuuacuaugacgcacagacgucccacaauagagaaagacguugaucucggugcugggaccaggcacgugaacgcggaaccggagacuccuaauauggacgucaucggagagcggauuaagcgcaucaaagaagagcauaacuccaccuggcacuaugacgaugaaaauccauacaagacaugggccuaucauggcucuuacgaggugaaggcaacgggcucagcuagcuccaugauuaacgggguagugaaacuucugaccaagcccugggacguugucccuauggugacucaaauggccaugacagauaccacuccauucggacagcagcgaguguuuaaagaaaaggucgacacaagaacccccaggaguaugccggguacacggcgcguuaugggcaucacugcagagugguuauggagaacccuggggaggaauaaaaagccucgauugugcacgcgggaggaauucaccaagaaagugcguacaaacgccgcuaugggagccguauuuacugaggaaaaucaaugggauucugcgaaggcagccguggaggacgaagauuucuggaaacucgucgacagagagcgcgagcugcacaagcuaggcaaaugugguagcugcguguauaacaugauggggaagagggaaaaaaagcuuggagaguuuggcaaggcuaaaggcucacgggccauaugguacauguggcugggggcaagauaccucgaauucgaggcucugggauuuuugaaugaggaucauugguucucccgcgaaaacaguuauagcgguguugagggcgaagggcugcacaagcucggauacauccuuagggacauuucuaaaauccccggcggugccauguaugcugaugacaccgccgggugggacacacgaauuacugaggaugaccugcacaaugaagagaagaucacccagcagauggauccagagcaucggcaguuagcaaacgcgauauuuaaacugacguaccaaaauaagguggucaaggugcagagaccuacacccaccggaacuguaauggacauuaucuccaggaaagaucagcgcggcucaggccagguugggacauauggauugaacaccuucacuaauauggaagcccaacucauccgucagauggagggugaaggcgugcugagcaaggcugaccuagagaacccacaccuucccgaaaaaaagauuacccaguggcuggagacaaaaggggucgagcggcucaagagaauggccauaucgggagaugacugcguggugaagccuaucgaugacagguuugcaaacgcucuguuggccuuaaaugauaugggcaaaguccgcaaggacauuccacaguggcaaccgucuaaagguuggcaugauuggcagcagguucccuucuguagucaccacuuccaugaacugaucaugaaggacgggcgaaaacucgugguaccuugccggccacaggacgagcuuauuggaagagcaaggaucucccaaggcgccggcuggagccugcgcgaaacggcgugucuagggaaggcuuacgcccagauguggucacugauguauuuucacagacgggaucucagguuggcauccaacgccauaugcucugcugugcccguccauugggugccuaccagccguacuacauggaguauccacgcccaucaccaguggaugaccacugaggacaugcugacaguuuggaaucgaguguggauugaagauaacccauggauggaggacaagacccccgucacgacaugggagaaugugccuuaccuuggaaaacgcgaagaucaauggugugguucccugaucggccucaccagcagagcaacuugggcucagaacauuccgaccgccauccagcagguacggucuuuaauugggaaugaggaauuccuggacuacaugccaucaaugaagagguuucgcaaagaggaggaaagugagggagcgauaugguga

SEQ ID NO: 15348 - RNA, 9873 nt, Artificial Sequence
  derived and/or modified CDS sequence (opt3) from DENV-3__KJ189263__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccacccucccagaauauggaacucuuggccuggagugcucuccgcgaaccgguuuggacuucaaugagaugauccuacugacaaugaaaaacaaggcguggauggugcauagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcacacagcucucaccggcgccacagaaauccagaauucagggggaacuaguauuuucgcaggucaucugaagugucgguuaaaaauggacaagcuggagcuaaaaggcaugagcuacgccaugugcaccaacacguuugugcucaagaaagaggucucugaaacccagcacgggacagugcugauaaagguugaguacaagggagaagaugugcccuguaaaaucccuuucuccacugaggacggccaugguaaggcucacaacgggcgucuuauuaccgcgaauccaguagucacaaaaaaggaggaacccgugaacaucgaggcagaaccgccuuucggcgagucaaauauaguuauuggaaucggcgauaacgccuugaaaaucaauugguauaagaaggggagcaguauuggaaaaauguuugaagcuacugcccgcggugcaagaaggauggccauccugggcgacaccgcuugggauuucgggucugugggaggcguccucaacucccuggguaagauggugcaucaaauuuuugggagcgccuacacggcacuuuucucgggcguaucuugggugaugaaaauaggaaucggcguucuguugacauggauugggcucaauuccaagaacaccucaaugaguuuuagcugcaucgcgaucggaauuauaacucuguauuuaggcgcugucgugcaggccgacauggguugugugaucaauuggaaagggaaggagcugaagugcggauccggcauuuucgucacaaacgagguucacaccuggacugaacaguacaaauuucaggcagauucucccaagcggcuagccaccgcuaucgccggugcaugggagaauggcgugugugggauucgaagcacaacgcgcauggaaaaccuccuguggaaacaaaucgcuaaugagcuuaacuauauauugugggaaaauaacaucaagcugaccgugguagucggagacauuaucggcgugcucgagcaggggaaaagaacucugacaccacagccuauggaguuaaaguacucauggaaaaccuggggaaaggccaagauuguuacagcggaaacucagaacaguuccuucaucauagauggccccaauaccccagagugccccagcgccucuagggcuuggaacgugugggaagucgaggacuaugguuuugggguguucacgacaaauauuuggcugcggcuucgcgaaguuuacacccaauugugugaccacagacucaugucagcagccgugaaagaugagagggcuguacaugccgacaugggauacuggaucgagagucagaagaacggcagcuggaaacuggaaaaggcaucccuaauugaggucaaaacuugcaccuggccuaagucucacacacuguggucgaauggugugcucgaaagcgauaugaucauaccaaagucccuggcgggcccgaucucacagcauaaccaccgucccggguaucacacucagaccgccggaccuuggcaucuuggcaaauuggagcuggacuuuaauuacugcgaggggacaacgguggucauuaccgaaaacuguggaacucggggcccaaguuuacgaacaaccacuguuucugguaagcucauccacgaguggugcuguagaagcugcacacugcccccucuuagguauaugggggaagauggauguugguacggcauggagauucgcccaaucuccgaaaaagaggagaauauggugaagucacugguaagcgcugguucuggcaaaguggacaacuucaccaugggggucuugugccucgccauacuguuugaagaggugaugcggggaaaguucggcaagaaacauaugauugcagggguuuucuuuacguucgugcuacugcucuccggacaaaucacuuggagagauauggcucacacccugaucaugauuggcaguaaugccagcgacaggauggguaugggggucacauaucuugcauugaucgccaccuuuaagauucagcccuuccuggcuuuaggauuuuuccuccgcaaacugacuucucgagaaaaccuucugcuaggcgugggccucgcgauggccacaacccugcaguugccggaggauauagaacaaauggcaaaugggaucgcucugggauuaauggcccucaagcugauuacacaguuugagaucuaccagcuuuggacugcccugauuuccuugaccuguucaaacacgaucuucacacucaccguugcuuggcggacugcaacccugauacuagccggugugagucugcuuccugucugccagagcucguccaugcguaaaacagacuggcucccaauggcgguagcugccaugggcgugcccccucugcccuuguuuaucuucucucugaaggauacuuuaaagagaaggagcuggccacucaaugaggggguuauggcagugggacuggucucaauucuugccaguucccuguugcgcaacgacgugccuauggcuggcccccucguagcaggugggcugcuaaucgccuguuaugugauuaccggaacgucugcggaucugacagucgaaaaagcugccgacaucaccugggaggaagaggcagaacaaacuggcguuagccauaaccuuaugauaacaguggacgaugacggcaccaugcggauuaaggaugacgagacugagaauauccucacagugcuguugaaaaccgccuuacugaucgucuccgggauuuuuccauacucaauaccggcuacgcuccugguguggcacacuuggcagaagcagacccagagaagcggaguucuuugggauguaccuagucccccagaaacacaaaaagccgagcuggaagaggguguguacaggaucaagcagcagggcauuuucgggaaaacccaggucggagugggcguucaaaaggaggguguguuucacacaauguggcaugucacucgaggggcaguguugaccuauaacggaaagcgccuagaacccaauugggcuucuguaaaaaaggaccugaucuccuacggcggcggguggcggcucagcacgcaguggcagaaaggagaggaaguccaagugauugccguugagccugguaagaacccaaaaaauuuccagacaaugcccggcacuuuccagaccacaaccggggaaaucggagcgauagcccuggauuuuaagccuggcacuucggguucaccgaucauuaacagagaggggaagguggucggacuuuauggcaauggcgugguuaccaaaaacgggggauacgugucugguaucgcacagacaaaugcugagccagacggccccacgccugaauuagaggaagagauguucaagaaaaggaaccugacuauuauggaucuccacccagggaguggaaagacccguaaauauuugcccgccaucguccgcgaagcuauaaagcggagacugaggacacucauucuggcaccuacccgagugguagccgccgagauggaggaagcucuuaagggccugccgauccgguaccaaacuacagcgaccaaauccgagcauacgggucgcgaaaucguggacuugaugugccacgcaacuuuuacaaugagacuacugagccccguuagggucccaaauuauaaccucauuaucauggaugaggcccauuucaccgacccugcuucuauagccgcacggggguacauuagcacccgagugggaaugggcgaagccgcugcgaucuuuaugacugccacacccccaggcaccgcagaugcuuucccucaguccaaugcccccauucaggacgaggagagagacaucccagaacgcucauggaacagugggaaugaguggauaacagauuuugcaggaaagacugugugguucgucccgagcauuaaagccgguaacgacaucgcuaacuguuuaaggaagaauggcaaaaagguaauccagcugucucguaagacguuugauaccgaauaccaaaaaacaaagcuuaacgacugggauuucgugguuacuaccgacauuuccgagaugggggccaauuuuaaagcggaucgggugaucgacccuagaaggugccugaagcccgucauucucacagauggaccagagcgcgugauauuggcaggccccaugccuguuaccgccgcuucagccgcucagcgaagaggucggguggggaggaacccacagaaagaaaaugaccaguauaucuucacuggccaaccccugaacaaugaugaggaccacgcacacuggacggaagccaagaugcuccuggacaacauuaauaccccugagggaaucaucccggcucuuuucgaaccagagcgcgagaagagugccgcaauugauggcgaauaccgucuaaaaggggagagcagaaagacauuugucgaacugaugcggaggggagacuugcccgugugguuagcgcauaaaguagccuccgaggguauaaaguauacugaucgcaaauggugcuucgacggccagcgaaacaaucagauccuggaagagaacauggauguggagauuuggaccaaggaaggggagaaaaagaagcucagaccucgguggcuggacgcuaggacauacucugauccccuugcccugaaagaauuuaaggacuucgcagcuggacgcaaaucgaucgcccucgauuugguuaccgagauuggcagagucccaagccaccuggcacauaggacucggaaugcccuagacaaccuggugaugcuccacacaucagaacacggugggcgugcuuaucgccaugcgguggaggagcuuccugaaacgauggagacccuguuauugcugggccucaugauccugcuuacuggaggcgccaugcuguuucucauauccgggaagggaaucgguaaaacaaguauuggcuugaucugugucauugcaucuagcgggaugcuguggauggcugaaauccccuuacaguggauagccuccgccauuguucuagaguucuuuaugauggugcugcucaucccagagccugaaaagcaacgaaccccgcaggauaaucagcuugcauacguagugauuggaauccugaccuuggcugccauaaucgcggcuaacgagaugggccugcucgaaacaacuaagagagaccuggguaugucaaaagagcccggggucgugucuccaacgagcuaucuugauguugaccuccacccugccagugcauggacccuguacgccguggcuacaacugucauuacccccauguugaggcauacaaucgaaaauuccaccgcaaacguaagccuggccgcgauugcuaaccaagccgugguuuuaaugggccuagacaagggauggccaaucucuaaaauggaucugggcgugccucuccuugcacuggggugcuacucacaggucaaucccuugacucugacggccgcugugcuccugcuuauaacacacuaugccauuaucggaccgggcuuacaggcaaaggcuacccgggaggcccagaaacgcacugcggccgguaucaugaagaacccaaccgucgacgggauuaugacaaucgaucuggacccugugauauacgauuccaaguucgagaaacaacucggacagguuauguugcuggugcuaugugcaguacagcugcuccuuaugagaacuaguugggcucugugcgaagccuugacccuggcaacaggccccauuacgacccucugggaggguagcccaggcaaguuuuggaauacuacaaucgcugugucgauggccaacauuuucagggggucuuaucuggccggagcgggcuuagcuuuuuccaucaugaaaagcgucgggaccggaaagcggggcacugguucacagggggaaacacuuggagagaaauggaagaagaaacugaaucaacucagucgaaaggaauucgaccuauacaaaaagucuggcauaaccgagguugauagaacggaggcaaaagaaggucugaagcgcggcgagaucacccaucacgccguguccagggggagcgcuaaauugcagugguuugucgaacggaacauggugauucccgagggacguguaaucgaccugggcugugggagaggaggcuggucauauuacugcgccggucucaagaaggugacagaaguuaggggguauacuaaaggaggcccuggccacgaggagccggugcccaugaguaccuacggguggaauauugucaagcuuaugagcggaaaagauguguucuaccugccaccugaaaagugugacacauugcugugcgauaucggugaguccucucccagcccuacugucgaagagucccgcaccauucgggugcucaaaaugguugagccaugguuaaagaacaaucaguucuguaucaagguacugaaccccuauaugccuacagugauagaacaucuugagcgacugcagagaaaacacggcgggaugcuagucaggaauccacucucacgcaacucuacccaugaaauguacuggauuaguaauggaacuggcaacaucguggcaucgguuaauauggugagccggcuguugcugaacagauuuacgaugacacaccguaggcccaccaucgagaaggacgucgaucucggugccgggacucggcacgugaacgcugaaccggagaccccuaauauggacguaauuggagagcgcauaaaacgaaucaaggaagagcauaacuccacauggcacuaugacgaugaaaauccauacaaaacgugggcguaucauggcucuuacgaggugaaggccaccggcucagcaagcuccaugauuaacgggguugucaagcuucugacuaaacccugggacguggugccuauggucacacaaauggcuaugaccgauacuacaccauucggacagcagagaguuuuuaaggaaaaaguggacaccaggacaccccggaguaugccggguacucgcagaguaaugggcaucaccgccgagugguuauggaggacgcuggggcgaaauaagaaaccucgguugugcacccgugaggaauucacaaagaaggugagaacuaacgcagccaugggagcugucuuuaccgaggaaaaucaaugggauucugccaaagcggcaguggaggacgaagauuucuggaagcucguugaccgcgagagggagcugcacaaacuaggcaagugugguagcugcguguauaacaugauggggaaacgggaaaagaaacuuggagaguuuggcaaggccaagggcucaagagcuauuugguacauguggcugggggcccgcuaccucgaauucgaggcacugggauuuuugaaugaggaucauugguucuccagggaaaacaguuauagcggugucgagggcgaagggcugcacaaacucggauacauccuucgagacauaucuaagauccccggcggugcuauguaugccgaugacacagcugggugggacacucggauuaccgaggaugaccugcacaaugaagagaaaaucacgcagcagauggauccagagcauagacaguuagccaacgcaauuuuuaagcugacauaccaaaauaaagugguaaagguucagaggccuacccccacuggaacagugauggacaucauaucccgcaaggaucagcguggcucaggccaggucgggaccuauggauugaacacuuucaccaauauggaagcgcaacucauucggcagauggagggugaaggcgugcugagcaaagccgaccuagagaacccacaccuucccgaaaagaaaaucacacaguggcuggagacgaaggggguggagagacucaaaaggauggcuaucucgggagaugacugcgucguuaagccuauugaugaccgcuuugccaacgcacuguuggcuuuaaaugauaugggcaaggugcgaaaagacauaccacaguggcaaccgucuaaggguuggcaugauuggcagcagguacccuucuguagucaccacuuccaugaacugaucaugaaagacgggcggaagcucguggucccuugcagaccacaggacgagcuuauuggaagggcccgcaucucccaaggcgcaggcuggagccugagagaaaccgccugucuagggaaagcguacgcucagauguggucacugauguauuuucaccggagggaucuccguuuggccuccaacgcaauuugcucugccgugcccguucauugggugccuacuagccgaacaaccuggaguauccacgcucaucaccaguggaugacuacagaggacaugcugaccgucuggaaucgcguguggauagaagauaacccauggauggaggacaagacgcccguaacaaccugggagaauguuccuuaccuuggaaagagagaagaucaauggugugguucccugaucggccucacuagccgggccaccugggcacagaacauuccgacagcuauccagcaggugaggucuuuaauugggaaugaggaauuccuggacuacaugccaucaaugaaacgcuuuagaaaggaggaggaaagugagggagccaucugguga

SEQ ID NO: 15349 - RNA, 9873 nt, Artificial Sequence
  derived and/or modified CDS sequence (opt3) from DENV-3__KJ189265__SS-prME
accagccugugccucaugaugauccuucccgccgcucuggcauuccacuugacuuccagggacggcgaaccuaggaugauuguggggaagaacgaacggggaaaaucuuuacuguuuaagacugccucagguauaaauauguguacgcuaaucgcgauggaucucggcgaaaugugcgacgauaccgucacauacaaauguccacauauuacugaaguugaaccggaagacaucgauugcugguguaaccugaccaguacaugggugaccuaugggacuugcaaucaagcuggagaacaccgccgagacaagcguagcguagcccuugcaccccaugugggcaugggucuggauacaagaacccaaacguggauguccgccgaaggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaugguaaggcucacaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaucagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccacacauggaccgaacaguacaaauuucaggcagauucucccaagcggcuagccacugcuaucgccggugcaugggagaauggcguuugugggauacgaagcaccacacgcauggaaaaccuccuguggaaacaaaucgcuaaugagcuuaacuauauuuugugggaaaauaacaucaagcugacgguggugguaggagacauuaucggcguccucgagcacgggaaaagaacccugacuccacagccuauggaguuaaaguacucauggaaaacauggggaaaggccaagauagugaccgcggaaacacagaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaucgccucaugucagcagccguuaaggaugagagagcugugcacgccgacaugggauacuggaucgagagucagaagaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaaccacaggcccggguaucauacacagacugccggaccuuggcaccuuggcaaguuggagcuggacuuuaauuacugcgaggggaccacaguggugauuacggaaaacuguggaacccguggcccaaguuuacggacuacaaccgucucugguaaacucauccaugaguggugcugucgaagcugcacucugcccccucuuagauauaugggggaagauggauguugguacggcauggagauaaggccaauuuccgaaaaggaggagaauaugguuaaaucacuggugagcgcugguucuggcaagguagacaacuucacaauggggguguugugccucgccauccuguuugaagaggucaugcgcggaaaguucggcaaaaagcacaugaucgcagggguguucuuuaccuucguucuacugcucuccggacagauuacguggcgggauauggcucauacucugaucaugauuggcaguaauaccagcgacagaauggguaugggggugacauaucuugccuugauagcaaccuuuaaaauccaacccuuccuggccuuaggauuuuuccucaggaagcugacuucucgcgaaaaccuucugcuaggcgucggccucgcuauggcgacaacccugcaguugccggaggauauugaacagauggccaaugggaucgcacugggauuaauggcucucaaacugauuacacaauuugagacuuaccagcuuuggaccgcccugaucuccuugacguguucaaacacaauauucacccucacuguggccuggcgaaccgcuacacugauccuagccgguguuagucugcuuccugugugccagagcucguccaugcggaagacugacuggcucccaauggccgucgcggcuaugggcguacccccucugcccuuguuuauuuucucucugaaggauaccuuaaaacguagaagcuggccacucaaugagggggugauggccguuggacuggugucaauccuugcaaguucccuguugaggaacgacgucccuauggccggcccccucguggcuggugggcugcuaauugcauguuauguaaucacgggaacaucugccgaucugaccguggaaaaggcggcuaacauaacuugggaggaagaggccgaacagacaggcgucagccacaaucuuaugauuaccguugacgacgauggcacuaugcgcaucaaagacgaugagacagagaacauccucaccgugcuguugaagacggcauuacugauuguguccgggauauuuccauacucaaucccggccacucuccuggucuggcacaccuggcaaaaacagacacagcggagcggagugcuuugggacguuccuagucccccagaaacccagaaggcugagcuggaagaggguguauacagaauuaaacaacagggcaucuucgggaagacacaggugggagucggcgugcagaaggaggguguuuuucauacuauguggcacgugaccagaggggcagucuugacguauaauggaaaacgacuagaacccaacugggcaucugugaagaaagaucugauuuccuacggcggcggguggcgccucagcgcucaauggcagaagggagaggaaguacaggucaucgccguggagccugguaaaaauccaaagaacuuccaaacaaugcccggcacuuuccagaccacaaccggggaaauaggagcgaucgcccuggacuuuaagccuggcacuucggguucaccgauuaucaaucgggaggggaaaguugugggacuuuauggcaacggcgucgugaccaagaaugggggauacguuucugguauugcacagacaaacgcugagccagauggccccacgccugaauuagaggaagagauguucaaaaagagaaaucugacuaucauggaccuccauccagggaguggaaaaaccaggaaguauuugcccgccauagugcgugaagcuauuaagcgccggcugagaacacucauccuggcaccuaccagggucguggccgccgagauggaggaagcucuuaaaggccugccgauccgauaccagacuacagcgaccaaguccgagcacacgggucgggaaauuguagauuugaugugccaugcaacuuuuacaaugcgccuacugagccccgugagaguuccaaacuauaaucucaucauaauggacgaggcccacuucaccgauccugcuucuauugccgcaaggggguacaucagcacccgggucggaaugggcgaagccgcugcgauuuuuaugacugccacacccccaggcaccgcagacgcuuucccucaauccaacgcccccauccaggaugaggagcgagacauaccagaaagaucauggaauagugggaacgaguggauuacagacuuugcaggaaaaacugugugguucgugccgagcaucaaggccgguaacgauaucgcuaauuguuuacgcaaaaacggcaagaaggucauucagcugucuaggaaaacguuugacaccgaauaccagaagacaaaacuuaaugauugggacuucguagugacuaccgauaucuccgagaugggggccaacuuuaaggcggaccguguuauugauccucggagaugccugaaacccgugauacucacagacggaccagagagggucaucuuggcaggccccaugccugugaccgccgcuucagccgcucaacgccgagguagaguugggcggaauccacagaaggaaaacgaucaguauauuuucacuggccagccccugaauaacgacgaggaucacgcacauuggacggaagccaagaugcuccuggacaauaucaacaccccugagggaaucauuccggcucuuuucgaaccagagagggagaaaagugccgcaauagacggcgaauaccgccuaaagggggagagccguaaaacauuuguggaacugaugagacggggagauuugcccgucugguuagcgcacaagguggccuccgaggguaucaaauauacugacaggaaguggugcuucgauggccaacgcaauaaccagauucuggaagagaauauggacguagagaucuggaccaaagaaggggagaagaagaaacuccgaccuagauggcuggaugcucggacauacucugacccccuugcccugaaggaauuuaaagauuucgcagcuggaaggaagucgauugcccucgacuuggugaccgagaucggccgcguuccaagccaucuggcacacagaacuaggaacgcccuagauaaucuggucaugcuccacacaucagaacauggugggcgggcuuaucgucacgcgguggaggagcuuccugaaacgauggagacccuguuauugcugggccucaugauacugcuuacuggaggcgccaugcuguuucucaucuccgggaaaggaauugguaagacaaguaucggcuugauuugugugaucgcaucuagcgggaugcuguggauggcugaaauacccuuacaguggauugccuccgccaucguccuagaguucuuuaugaugguucugcucauuccagagccugaaaagcagcgcaccccgcaagacaaccagcuugcauacgugguaaucggaauacugaccuuggcugccaucauugcggcuaaugagaugggccugcucgaaacaacuaaacgagaucuggguaugucaaaggagcccgggguggucucuccaacgagcuaucuugacguggaucuccauccugccagugcauggacccuguacgccguugcuacaacugugaucacccccauguugagacacacaauugaaaacuccaccgcaaacgucagccuggccgcgaucgcuaaucaggccguaguguuaaugggccuagacaaaggauggccaauaucuaagauggaccugggcguuccucuccuugcacuggggugcuacucacaagugaaccccuugacucugacggccgcuguccuccugcuuauuacacauuaugccaucaucggaccgggcuuacaggcaaaagcuaccagggaggcccagaagcggacugcggccgguauuaugaagaauccaaccguggaugggaucaugacaauagaccuggauccugucauuuacgacuccaaauucgagaagcagcucggacaagugauguugcugguucuaugugcagugcagcugcuccuuaugcgcacaaguugggcucugugcgaagccuugacccuggcaacaggccccaucacgacccucugggaggguagcccaggcaaauuuuggaacacuacaauugcuguaucgauggccaauaucuucagagggucuuaucuggccggagcgggcuuagcuuuuuccauaaugaaaagcguggggaccggaaaaaggggcacugguucacagggggaaacacuuggagagaaguggaagaaaaagcugaaccagcucagucggaaagaguucgaucuauacaagaaaucuggcaucaccgaggucgaccgaacggaggcaaaggaaggucugaaaagaggcgagauuacccaccacgccguuucccgcgggagcgcuaaguugcaaugguuuguggaaaggaauauggucauccccgagggacgggugauugaucugggcugugggcguggaggcuggucauauuacugcgccggucucaagaaaguaacagaagugagaggguauacuaagggaggcccuggccaugaggagccgguucccaugaguaccuacggguggaacaucgugaaacuuaugagcggaaaggacgucuucuaccugccaccugaaaaaugugauacauugcugugcgacauuggugaguccucucccagcccuacuguggaagaguccaggaccauccgcguccucaagaugguggagccaugguuaaagaauaaccaguucuguauaaaaguucugaaucccuauaugccuacaguaauugaacaccuugagcggcugcagcgaaagcauggcgggaugcuagugagaaacccacucucaagaaauucuacccacgaaauguacuggaucaguaacggaacuggcaauaucgucgcaucggugaacaugguuagccgccuguugcugaaccgguuuacgaugacacacagacgucccaccauugagaaagauguggaccucggugccgggacuaggcaugucaaugcugaaccggagaccccuaacauggaugugauaggagagcggaucaagcgcauuaaagaagaacacaauuccacauggcauuaugacgacgaaaacccauacaagacgugggcguaucacggcucuuacgagguaaaggccaccggcucagcaagcuccaugaucaauggggugguuaaacuucugacuaagcccugggaugucgugccuauggugacacagauggcuaugaccgacacuacaccauucggacaacagcgagucuuuaaagaaaagguugauaccagaacacccaggaguaugccggguacucggcgcgugaugggcauuaccgccgagugguuauggagaacgcuggggaggaacaaaaagccucgauugugcacccgggaggaguucacaaagaaaguacguacuaaugcagccaugggagcuguguuuaccgaggaaaaccagugggacucugccaaggcggcagucgaggaugaagacuucuggaaacucguggauagagagcgcgagcugcauaagcuaggcaaaugugguagcugcguuuauaauaugauggggaagagggagaagaaacuuggagaguuuggcaaggccaaaggcucacgggcuaucugguacauguggcugggggccagauaccucgaguucgaggcacugggauuuuugaacgaggaccacugguucucccgcgaaaauaguuauagcgguguggagggcgaagggcugcacaagcucggauacauacuuagggauaucucuaaaauucccggcggugcuauguaugccgacgauacagcugggugggacacucgaaucaccgaggacgaucugcauaacgaagagaagauuacgcaacagauggacccagagcaccggcaguuagccaaugcaaucuuuaaacugacauaccagaacaaggucgugaagguacaaagaccuacccccacuggaacaguuauggauauaauuuccaggaaagaccagcgcggcucaggccagguggggaccuauggauugaauacuuucaccaacauggaagcgcagcucauccgucaaauggagggugaaggcguccugagcaaggccgaucuagagaacccacaucuucccgagaaaaagaucacacaguggcuggagacgaaagggguggagcggcucaagagaauggcuauuucgggagacgauugcguggucaagccuauagacgauagguuugccaaugcacuguuggcuuuaaacgacaugggcaaaguucgcaaggauaucccacaguggcagccgucuaaagguuggcacgacuggcaacaggugcccuucuguagucaccauuuccacgaacugauuaugaaggaugggcgaaaacucguagugccuugccggccacaggacgagcuuaucggaagggccaggauuucccagggcgcaggcuggagccugcgcgaaaccgccugucuagggaaggcguacgcucaaauguggucacugauguauuuucauagacgggaccucagguuggccuccaaugcaaucugcucugccguccccgugcacuggguuccuacuagccguacaaccuggaguauacaugcucaccaccaguggaugacuacagaggauaugcugaccguguggaaccgagucuggaucgaagacaauccauggauggaggauaagacgcccgugacaaccugggagaacguaccuuaccuuggaaaacgcgaagaccaguggugugguucccugauuggccucacuagcagagccaccugggcacaaaauaucccgacagcuauucagcagguucggucuuuaaucgggaacgaggaguuccuggauuacaugccaucaaugaagagguuucgcaaagaggaggaaagugagggagccauuugguga

SEQ ID NO: 15350 - RNA, 9873 nt, Artificial Sequence
  derived and/or modified CDS sequence (opt3) from DENV-3__KJ189266__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaugguaaggcucacaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaucaaaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccacacauggaccgaacaguacaaauuucaggcagauucucccaagcggcuagccacugcuaucgccggugcaugggagaauggcguuugugggauacgaagcaccacacgcauggaaaaccuccuguggaaacaaaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacagaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaauugugugaccaccgccucaugucagcagccguuaaggaugagagagcugugcaugccgacaugggauacuggaucgagagucagaaaaacggcagcuggaagcuggaaaaagcaucccuaauagagguaaagaccugcacuuggccuaagucucacacccuguggucgaaugguguccucgaaagcgauaugaucauuccaaaaucccuggcgggcccgaucucacagcauaaccacaggcccggguaucacacacagacugccggaccuuggcaucuuggcaaguuggagcuggacuuuaauuacugcgaggggaccacaguggugauuacggaaaacuguggaacccguggcccaaguuuacggacuacaaccgucucugguaaacucauccacgaguggugcugucgaagcugcacucugcccccucuuagauauaugggggaagauggauguugguacggcauggagauaaggccaauuuccgaaaaggaggagaauaugguuaaaucacuggugagcgcugguucuggcaagguagacaacuucacaauggggguguugugccucgccauccuguuugaagaggucaugcgcggaaaguucggcaaaaagcauaugaucgcagggguguucuuuaccuucguucuacugcucuccggacaaauuacguggcgggauauggcucacacucugaucaugauuggcaguaaugccagcgacagaauggguaugggggugaccuaucuugcauugauagccacauuuaaaauccagcccuuccuggcuuuaggauuuuuccucaggaagcugaccucucgcgaaaaccuucugcuaggcgucggccucgcgauggccacuacacugcaguugccggaggauauugaacaaauggcaaaugggaucgcucugggauuaauggcccucaaacugauuacccaguuugagacauaccagcuuuggacugcccugaucuccuugaccuguucaaacacgauauucacacucaccguggcuuggcgaacugcaacccugauccuagccgguguuagucugcuuccugugugccagagcucguccaugcggaagacagacuggcucccaauggcggucgcugccaugggcguacccccucugcccuuguuuauuuucucucugaaggauacuuuaaaacguagaagcuggccacucaaugagggggugauggcaguuggacuggugucaauccuugccaguucccuguugaggaacgacgucccuauggcuggcccccucguggcaggugggcugcuaauugccuguuauguaaucaccggaacgucugcggaucugacaguggaaaaggcugccgacauaaccugggaggaagaggcagaacaaacuggcgucagccauaaccuuaugauuacaguugacgaugacggcaccaugcgcaucaaagaugacgagacugagaauauccucacagugcuguugaagaccgccuuacugauuguguccgggauauuuccauacucaaucccggcuacgcuccuggucuggcacacuuggcagaaacagacccagcggagcggagugcuuugggauguuccuagucccccagaaacacaaaaggccgagcuggaagaggguguauacagaauuaaacagcagggcaucuucgggaagacccaggugggagucggcgugcaaaaggaggguguuuuucacacaauguggcaugugacuaggggggcagucuugaccuauaacggaaaacgacuagaacccaauugggcuucugugaagaaagaccugauuuccuacggcggcggguggcgccucagcgcccaguggcagaagggagaggaaguacaagucaucgcgauagagccugguaaaaacccaaagaauuuccaggccaugcccggcacguuccagacaacuaccggggaaaucggagcaauugcucuggauuuuaagccuggcacaucggguucaccgaucauuaaccgggaggggaaagugguuggacuuuauggcaauggcguggucaccaagaacgggggauacgugucugguaucgcccagacuaaugcugagccagacggccccaccccugaauuagaggaagagauguucaaaaagagaaaccugacaauaauggaucuccacccagggaguggaaaaacgaggaaguauuugcccgcaauuguucgugaagccaucaagcgccggcugagaacucucauccuggccccuaccaggguggucgcugcggagauggaggaagcacuuaaaggccugccgauucgauaccaaacaaccgccacuaaguccgagcauacaggucgggaaaucguggacuugaugugccacgcuaccuuuacgaugcgccuacugagccccguaagagugccaaauuauaaccucauaauuauggaugaggcccauuucacugacccugcaucuaucgccgcuaggggguacauuagcacacggguuggaaugggcgaagcggccgcaaucuuuaugaccgcuacccccccaggcacugccgaugcauucccucaguccaaugcccccauacaggacgaggagcgagacauuccagaaagaucauggaacagugggaaugaguggaucacagauuuugcuggaaaaaccgucugguucgugccgagcaucaaggccgguaacgacauugcgaacuguuuacgcaaaaauggcaagaaggugauccagcugucuaggaaaacauuugauacugaauaccaaaagacgaaacuuaacgacugggauuucgucguaaccacagacauuuccgagaugggggcaaauuuuaaggccgaucgugugauagacccucggagaugccugaaacccguuauccucacugauggaccagagagggugauuuuggcuggccccaugccugucaccgccgcuucagcagcccagcgccgagguagaguggggcggaacccacagaaggaaaaugaccaguauaucuucacaggccaaccccugaacaaugaugaggaccacgcucacuggaccgaagccaagaugcuccuggacaacaucaauacuccugagggaauuauaccggcacuuuucgaaccagagagggagaaaagugcggccaucgauggcgaauaccgccuaaagggggagagccguaaaacguuuguugaacugaugagacggggagacuugcccgugugguuagcucauaaggucgccuccgaggguauuaaauauaccgauaggaaguggugcuucgacggccagcgcaacaaucagauccuggaagagaacauggauguggagauuuggacaaaagaaggggagaagaagaaacuccgaccuagauggcuggacgcacggacuuacucugauccccuugcucugaaggaauuuaaagacuucgccgcaggaaggaagucgaucgcccucgauuugguaaccgagauaggccgcgugccaagccaccuggcucauagaacaaggaaugcgcuagacaaccugguuaugcuccacaccucagaacacggugggcgggccuaucgucaugcagucgaggagcuuccugaaacuauggagacacuguuauugcugggccucaugauccugcuuacgggaggcgcuaugcuguuucucauuuccgggaaaggaaucgguaagaccaguauuggcuugaucugugugauagccucuagcgggaugcuguggauggccgaaauucccuuacaguggaucgcauccgcuauugugcuagaguucuuuaugaugguccugcucaucccagagccugaaaagcaacgcacuccgcaggauaaucagcuugccuacguugugauaggaauccugacauuggcggcuauuaucgccgcaaacgagaugggccugcucgaaaccaccaaacgagaccuggguaugucaaaggagcccgggguagugucuccaacaagcuaucuugaugucgaccuccacccugccagugcuuggacucuguacgcaguggccacgaccguuauuacacccauguugagacauacuaucgaaaauuccaccgcgaacgugagccuggcugccauagcaaaccaagccgucguauuaaugggccuagacaaaggauggccaauuucuaagauggaucugggcgugccucuccuugcucuggggugcuacucacagguuaaucccuugacacugaccgccgcagugcuccugcuuaucacucacuaugcuaucauuggaccgggcuuacaggccaaagcgacgagggaggcccagaagcggacagcagcugguaucaugaagaacccaaccgucgacgggauaaugacuauugaucuggacccugugaucuacgauuccaaauucgagaagcaacucggacaggucauguugcuggugcuaugugccguucagcugcuccuuaugcgcaccaguugggcacugugcgaagcuuugacacuggccacuggccccauuaccacacucugggaggguagcccaggcaaauuuuggaauacgaccaucgccgugucgauggcgaacauauucagagggucuuaucuggcuggagcaggcuuagccuuuuccaucaugaagagcguagggacuggaaaaaggggcacagguucacagggggaaacccuuggagagaaguggaagaaaaagcugaaucaacucagucggaaagaauucgaccuauacaagaaaucuggcauuacugagguggaucgaacagaggcuaaggaaggucugaaaagaggcgagaucacccaucacgccgucucccgcgggagcgcaaaguugcagugguuuguugaaaggaacauggugauucccgagggacgggucaucgaccugggcugugggcguggaggcuggucauauuacugcgccggucucaagaaagugacggaaguaagaggguauaccaagggaggcccuggccacgaggagccggugcccaugaguacauacggguggaauauuguuaaacuuaugagcggaaaggauguguucuaccugccaccugaaaaaugugacacuuugcugugcgauaucggugaguccucucccagcccuaccgucgaagaguccaggacaauacgcgugcucaagauggucgagccaugguuaaagaacaaucaguucuguauuaaagugcugaaccccuauaugccuacuguuaucgaacaucuugagcggcugcagcgaaagcacggcgggaugcuaguaagaaauccacucucaaggaacucuacccaugaaauguacuggaucaguaauggaacaggcaacauuguggcuucggucaauauggugagccgccuguugcugaaccgguuuaccaugacucacagacgucccacgauagagaaagacguugaucucggugcggggacaaggcacgugaacgccgaaccggagaccccuaauauggacgucaucggagagcggauuaagcgcaucaaagaagagcauaacuccacuuggcacuaugacgaugaaaauccauacaagaccugggcauaucauggcucuuacgaggugaaggcuacaggcucagccagcuccaugauuaacgggguagugaaacuucugacgaagcccugggacguugucccuauggugacccaaauggcaaugacugauacaaccccauucggacagcagcgaguguuuaaagaaaaggucgacacuagaacacccaggaguaugccggguacccggcgcguuaugggcaucacagccgagugguuauggagaacucuggggaggaauaaaaagccucgauugugcacccgggaggaauucacgaagaaagugcguaccaacgcugccaugggagcgguauuuacagaggaaaaucaaugggauucugcaaaggccgcuguggaggacgaagauuucuggaaacucgucgacagagagcgcgagcugcacaagcuaggcaaaugugguagcugcguguauaacaugauggggaagagggaaaaaaagcuuggagaguuuggcaaggccaaaggcucacgggcaauaugguacauguggcugggggcuagauaccucgaauucgaggcccugggauuuuugaaugaggaucauugguucucccgcgaaaacaguuauagcgguguugagggcgaagggcugcacaagcucggauacauccuuagggacauuucuaaaauccccggcggugcuauguaugccgaugacacugcagggugggacacccgaauuacagaggaugaccugcacaaugaagagaagaucacucagcagauggauccagagcaucggcaguuagcgaacgccauauuuaaacugaccuaccaaaauaagguggucaaggugcagagaccuacgcccacaggaaccguaauggacauuaucuccaggaaagaucagcgcggcucaggccagguugggacuuauggauugaacacauucaccaauauggaagcucaacucauccgucagauggagggugaaggcgugcugagcaaggccgaccuagagaacccacaccuucccgaaaaaaagauuacucaguggcuggagaccaaaggggucgagcggcucaagagaauggcaauaucgggagaugacugcguggugaagccuaucgaugacagguuugcuaacgcccuguuggcauuaaaugauaugggcaaaguccgcaaggacauuccacaguggcaaccgucuaaagguuggcaugauuggcagcagguucccuucuguagucaccacuuccaugaacugaucaugaaggacgggcgaaaacucgugguaccuugccggccacaggacgagcuuauuggaagagccaggaucucccaaggcgcgggcuggagccugcgcgaaacagcuugucuagggaaggccuacgcacagauguggucacugauguauuuucacagacgggaucucagguuggccuccaacgcuauaugcucugccgugcccguccauugggugccuacgagccguaccacuuggaguauccacgcacaucaccaguggaugacaaccgaggacaugcugacuguuuggaaucgaguguggauugaagauaacccauggauggaggacaagacacccgucaccacgugggagaaugugccuuaccuuggaaaacgcgaagaucaauggugugguucccugaucggccucacaagcagagcuaccugggcccagaacauuccgacugcgauccagcagguacggucuuuaauugggaaugaggaauuccuggacuacaugccaucaaugaagagguuucgcaaagaggaggaaagugagggagcuauaugguga

SEQ ID NO: 15351 - RNA, 9873 nt, Artificial Sequence
  derived and/or modified CDS sequence (opt3) from DENV-3__KJ189268__SS-prME
accagccugugccucaugaugauccuucccgcagcucuggcauuccacuugaccuccagagacggagaaccuaggaugauuguggggaagaacgaacggggaaaaucuuuacuguuuaagacugccucagguauaaauauguguacgcuaaucgcgauggaucucggcgaaaugugcgacgauaccgucacauacaaauguccacauauuacugaaguugaaccggaagacaucgauugcugguguaaccugaccaguacaugggugaccuaugggacuugcaaucaggcuggagaacaccgccgagacaagcguagcguagcccuugcaccccaugugggcaugggucuggauacaagaacccaaacguggauguccgccgaaggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccacccucccagaauauggaacucuuggccuggagugcucuccgcgaaccgguuuggacuucaaugagaugauccuacugacaaugaaaaacaaggcguggauggugcauagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcacacagcucucaccggcgccacagaaauccaaaauucagggggaacaaguauuuucgcaggucaucugaagugucgguuaaaaauggacaagcuggagcuaaaaggcaugagcuacgccaugugcaccaacacguuugugcucaagaaagaggucucugaaacccagcacgggacaauacugaucaagguggaguacaagggagaagaugcucccuguaaaauuccuuucuccacugaggacggccaugguaaggcgcacaacgggcgucuuaucaccgcaaauccaguugugacuaagaaggaggaacccguaaacauagaggccgaaccgccuuucggcgagucaaauauugucaucggaaucggcgauaacgcuuugaaaauuaauugguauaagaaggggagcaguaucggaaaaauguuugaagccacugcacgcggugccagaaggauggcuauucugggcgacaccgccugggauuucgggucugugggaggcguucucaacucccuggguaagauggugcaucaaauauuugggagcgcauacacggcgcuuuucucgggcgucucuugggugaugaaaaucggaauuggcguacuguugacauggaucgggcucaauuccaagaacaccucaaugaguuuuagcugcaucgcuauuggaauaaucacucuguauuuaggcgccgugguucaggcagacauggguugugucauuaauuggaaagggaaggagcugaagugcggauccggcaucuucgugacaaacgaggugcacaccuggacugaacaguacaaauuucaggccgauucucccaagcggcuagcuaccgccauugccggugcuugggagaauggcgucugugggauccgaagcacaacgcgcauggaaaaccuccuguggaaacaaauagccaaugagcuuaacuauaucuugugggaaaauaacauuaagcugaccguuguggugggagacaucauuggcguacucgagcaggggaaaagaacucugacaccacagccuauggaguuaaaguacucauggaaaaccuggggaaaggcgaagaucgucacagccgaaacucagaacaguuccuucauaauugauggccccaauaccccagagugccccagcgcuucuagggcauggaacgugugggaaguugaggacuaugguuuugggguguucacgacaaauaucuggcugcggcuucgcgaagucuacacccaauugugugaccacagacucaugucagccgcugugaaagaugagagggccguucaugcagacaugggauacuggauugagagucagaagaacggcagcuggaaacuggaaaaggcgucccuaaucgaggugaaaacuugcaccuggccuaagucucacacacuguggucgaaugguguacucgaaagcgauaugauaaucccaaagucccuggccggcccgauuucacagcauaaccaccgucccggguaucacacucagaccgcuggaccuuggcaucuuggcaaauuggagcuggacuuuaauuacugcgaggggacaacggucgugaucaccgaaaacuguggaacucggggcccaaguuuacgaacaaccacugugucugguaagcucauucacgaguggugcuguagaagcugcacacugcccccucuuagguauaugggggaagauggauguugguacggcauggagauccgcccaauauccgaaaaagaggagaauauggucaagucacugguuagcgccgguucuggcaaaguggacaacuucaccauggggguauugugccucgcaauucuguuugaagaggugaugcggggaaaguucggcaagaaacauaugaucgcuggggucuucuuuacguucgugcuacugcucuccggacaaaucacuuggagagauauggcccacacccugauuaugaucggcaguaaugcaagcgacaggauggguauggggguuacauaucuugccuugauugcuaccuuuaagauacagcccuuccuggcguuaggauuuuuccuccgcaaacugacuucucgagaaaaccuucugcuaggcgugggccucgccauggcaacaacccugcaguugccggaggauaucgaacaaauggcuaaugggauugcccugggauuaauggcccucaagcugaucacacaguuugagacuuaccagcuuuggaccgcucugauuuccuugacguguucaaacacaaucuucacccucacugucgcauggcggaccgccacacugauacuagcgggugugagucugcuuccuguuugccagagcucguccaugcguaaaacugacuggcucccaauggcuguggccgcaaugggcgucccaccucugcccuuguuuaucuucucucugaaggauaccuuaaagagaaggagcuggccacucaaugaggggguaauggccgugggacugguuucaauucuugcuaguucccuguugcgcaacgacgugccuauggcaggcccccucgucgccggugggcugcuaaucgcguguuaugugauuacgggaacaucugcugaucugaccguagaaaaagccgcagacaucacuugggaggaagaggccgaacaaacaggcgugagccauaaccuuaugauaaccgucgacgaugacggcacuaugcggauuaaggaugacgagacagagaauauccucaccguucuguugaaaacggcuuuacugaucguguccgggauuuuuccauacucaauaccggccacucuccugguguggcacaccuggcagaagcagacacagagaagcggaguccuuugggaugugccuagucccccagaaacccaaaaagcagagcuggaagaggguguuuacaggaucaagcagcagggcauuuucgggaaaacacagguaggagugggcguccaaaaggaggguguguuucacacuauguggcauguuacccgaggggcuguguugacguauaacggaaagcgccuagaacccaauugggccucugucaaaaaggaccugaucuccuacggcggcggguggcggcucagcacacaguggcagaaaggagaggaagugcaaguaauugcggucgagccugguaagaaccccaagaauuuccagacuaugcccggcaccuuccagacaaccacuggggaaaucggagccauagcacuggauuuuaagccuggcaccucggguucaccgaucauuaacagagaggggaaggugguuggacuuuauggcaauggcguggucaccaagaacgggggauacgugucugguaucgcucagacgaaugccgagccagacggccccacuccugaauuagaggaagagauguucaagaaaaggaaccugaccauuauggaucuccacccagggaguggaaagacacguaaauauuugcccgcuaucguucgcgaagcaauaaagcggagacugaggacccucauucuggccccuacucgaguggucgccgcugagauggaggaagcgcuuaagggccugccgauccgguaccaaacaaccgcaacgaaauccgagcauacuggucgcgaaaucguggacuugaugugccacgccacauuuaccaugagacuacugagccccguaagggugccaaauuauaaccucauuaucauggaugaggcucauuucaccgacccugccucuauagcagcccggggguacauuagcacucgaguuggaaugggcgaagcugcggccaucuuuaugacagcaacacccccaggcacagcugaugccuucccucaguccaaugcacccauucaggacgaggagagagacaucccagaacgcucauggaacagugggaaugaguggauaacugauuuugccggaaagacggucugguucgugccgagcauuaaagcugguaacgacaucgccaacuguuuaaggaagaauggcaaaaaggugauccagcugucucguaagaccuuugauacagaauaccagaaaacuaaacuuaacgacugggauuucgucguaaccacagacauuuccgagaugggggcgaauuuuaaagcagaucgggugaucgacccuagaaggugccugaagcccguuauucucaccgauggaccagagcgcgugauauuggccggccccaugccugucacugcugccucagcugcacagcgaagaggucggguggggaggaacccacagaaagaaaaugaccaguauaucuucacgggccaaccccugaacaaugaugaggaccacgcccacuggaccgaagcuaagaugcuccuggacaacauuaauacaccugagggaaucaucccggcccuuuucgaaccagagcgcgagaagagugcagcgauugauggcgaauaccgucuaaaaggggagagcagaaagacuuuuguugaacugaugcggaggggagacuugcccgugugguuagcccauaaagucgcuuccgaggguauaaaguauaccgaucgcaaauggugcuucgacggccagcgaaacaaucagauccuggaagagaacauggauguggagauuuggacaaaggaaggggagaaaaagaagcucagaccucgguggcuggacgccaggaccuacucugauccccuugcacugaaagaauuuaaggacuucgcugccggacgcaaaucgaucgcacucgauuugguaacugagauuggcagagugccaagccaccuggcccauaggacaaagaaugcucuagacaaccugguuaugcuccacacgucagaacacggugggcgggcguaucgucaugccgucgaggagcuuccugaaaccauggagacucuguuauugcugggccucaugauccugcuuacaggaggcgcaaugcuguuucucauauccgggaaaggaaucgguaagaccaguauuggcuugaucugugugauugcuucuagcgggaugcuguggauggccgaaauccccuuacaguggauagccuccgcaauugugcuagaguucuuuaugaugguccugcucaucccagagccugaaaagcaacgcaccccgcaggauaaucagcuugcuuacguugugauuggaauccugacauuggccgcgacuauagcugccaacgagaugggccugcucgaaacgaccaaacgagaccuggguaugucaaaggagcccgggguagugucuccaacaagcuaucuugaugucgaccuccacccugcaagugccuggacucuguacgcuguggcaaccacaguuaucacccccauguugagacauacuauugaaaauuccacggccaacgugagccuggcggcuaucgccaaccaagcagucguauuaaugggccuagacaaaggauggccaauuucuaagauggaucugggcgugccucuccuugcccuggggugcuacucacagguuaaucccuugacacugaccgcugccgugcuccugcuuaucacucacuaugcaauaauuggaccgggcuuacaggcuaaagccaccagggaggcgcagaagcggacagccgcagguaucaugaagaacccaacugucgacgggaucaugaccauugaucuggacccugugaucuacgauuccaaauucgagaagcaacucggacaggucauguugcuggugcuaugugcuguucagcugcuccuuaugcgcacaaguugggcccugugcgaagcauugacgcuggcuaccggccccauaacuacacucugggaggguagcccaggcaaauuuuggaauaccacuauugccgugucgauggccaacaucuucagagggucuuaucuggcgggagcuggcuuagcauuuuccauuaugaaaagcguagggacaggaaaaaggggcaccgguucacagggggaaacgcuuggagagaaguggaagaaaaagcugaaucaacucagucggaaagaguucgaccuauacaagaaaucuggcaucaccgagguggaucgaacagaggccaaggaaggucugaaaagaggcgagauaacucaucacgcugucucccgcgggagcgccaaguugcagugguuuguugaaaggaacauggugauccccgagggacgggucauugaccugggcugugggcguggaggcuggucauauuacugcgcaggucucaagaaagugaccgaaguaagaggguauacaaagggaggcccuggccacgaggagccggugcccaugaguacuuacggguggaauaucguuaaacuuaugagcggaaaggauguguucuaccugccaccugaaaaaugugacaccuugcugugcgauauuggugaguccucucccagcccuacagucgaagaguccaggaccauccgcgugcucaagauggucgagccaugguuaaagaacaaucaguucuguauuaaagugcugaaccccuauaugccuacuguuaucgaacaucuugagcggcugcagcgaaagcacggcgggaugcuaguaagaaauccacucucaaggaacucuacgcaugaaauguacuggauaaguaauggaacaggcaacauuguggccucggucaauauggugagccgccuguugcugaaccgguuuaccaugacucacagacgucccaccaucgagaaagacguugaucucggugcugggacaaggcacgugaacgcggaaccggagacgccuaauauggacgucaucggagagcggauuaagcgcauaaaagaagaacauaacuccaccuggcacuaugacgaugaaaauccauacaagacuugggccuaucauggcucuuacgaggugaaggcaacaggcucagcuagcuccaugaucaacgggguagugaaacuucugaccaagcccugggacguugucccuauggugacucaaauggccaugacagauaccacaccauucggacagcagcgaguguuuaaagaaaaggucgacacuagaacccccaggaguaugccggguacgcggcgcguuaugggcauuaccgcagagugguuauggagaacacuggggaggaauaaaaagccucgauugugcacucgggaggaguucaccaagaaagugcguacaaacgccgcuaugggagccguauuuacugaggaaaaucaaugggauucugcgaaggcagccguggaggacgaagauuucuggaaacucgucgacagagagcgcgagcugcacaagcuaggcaaaugugguagcugcguguauaacaugauggggaagagggagaagaaacuuggagaguuuggcaaagcuaaaggcucacgggccaucugguacauguggcugggggcaagauaccucgaguucgaggcucugggauuuuugaaugaggaucauugguucucccgcgaaaacaguuauagcgguguugagggcgaagggcugcacaagcucggauacauucuuagggacaucucuaaaauacccggcggugccauguaugcugaugacaccgccgggugggacacgcgaaucacagaggaugaccugcacaaugaagagaagauuacccagcagauggauccagagcaucggcaguuagcaaacgcgaucuuuaaacugacuuaccaaaauaagguggucaaggugcagagaccuacacccaccggaacuguaauggacauuaucuccaggaaagaucagcgcggcucaggccagguugggaccuauggauugaacacauucacgaauauggaagcccaacucauacgucagauggagggugaaggcgugcugagcaaggcugaccuagagaacccacaccuucccgagaaaaagauuacccaguggcuggagacuaaaggggucgagcggcucaagagaauggccaucucgggagaugacugcguggugaagccuaucgaugacagguuugcaaacgcucuguuggccuuaaaugauaugggcaaaguccgcaaggacauuccacaguggcaaccgucuaaagguuggcaugauuggcagcagguucccuucuguagucaccacuuccaugaacugauaaugaaggacgggcgaaaacucgugguaccuugccggccacaggacgagcuuaucggcagagcaaggauuucccaaggcgccggcuggagccugcgcgaaacagcgugucuagggaaggcuuacgcccagauguggucacugauguauuuucacagacgggaucucagguuggcauccaacgccaucugcucugcugugcccguccauugggugccuaccagccguacuacauggaguauucacgcccaucaccaguggaugaccacggaggacaugcugacaguuuggaaucgaguguggaucgaagauaacccauggauggaggacaagacccccgucacuaccugggaggaugugccuuaccuuggaaaacgcgaagaccaauggugugguucccugauaggccucacaagcagagcaacuugggcucagaauaucccgaccgccauucagcagguacggucuuuaaucgggaacgaggaguuccuggauuacaugccaucaaugaagagguuucgcaaagaggaggaaagugagggagcgauuugguga

SEQ ID NO: 15352 - RNA, 9873 nt, Artificial Sequence
  derived and/or modified CDS sequence (opt3) from DENV-3__KJ189271__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccacccucccagaauauggaacucuuggccuggagugcucuccgcgaaccgguuuggacuucaaugagaugauccuacugacaaugaaaaacaaggcguggauggugcauagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcacacagcucucaccggcgccacagaaauccagaauucagggggaacuaguauuuucgcaggucaucugaagugucgguuaaaaauggacaagcuggagcuaaaaggcaugagcuacgccaugugcaccaacacguuugugcucaagaaagaggucucugaaacccagcacgggacaauacugaucaagguggaguacaagggagaagaugcucccuguaaaauuccuuucuccacugaggacggccaugguaaggcgcacaacgggcgucuuaucaccgcaaauccaguugugacaaaaaaggaggaacccguaaacauagaggccgaaccgccuuucggcgagucaaauauugucaucggaaucggcgauaacgcuuugaaaauuaauugguauaagaaggggagcaguaucggaaaaauguuugaagccacugcacgcggugccagaaggauggcuauucugggcgacaccgccugggauuucgggucugugggaggcguucucaacucccuggguaagauggugcaucaaauauuugggagcgcauacacggcgcuuuucucgggcgucucuugggugaugaaaaucggaauuggcguacuguugacauggaucgggcucaauuccaagaacaccucaaugaguuuuagcugcaucgcuauuggaauaaucacucuguauuuaggcgccgugguucaggcagacauggguugugucauuaauuggaaagggaaggagcugaagugcggauccggcaucuucgugacaaacgaggugcacaccuggacugaacaguacaaauuucaggccgauucucccaagcggcuagcuaccgccauugcaggugcuugggagaauggcgucugugggauccgaagcacaacgcgcauggaaaaccuccuguggaaacaaauagccaaugagcuuaacuauaucuugugggaaaauaacauuaagcugaccguuguggugggagacaucauuggcguacucgagcaggggaaaagaacucugacaccacagccuauggaguuaaaguacucauggaaaaccuggggaaaggcgaagaucgucacagccgaaacucagaacaguuccuucauaauugauggccccaauaccccagagugccccagcgcuucuagggcauggaacgugugggaaguugaggacuaugguuuugggguguucacgacaaauaucuggcugcggcuucgcgaagucuacacccaauugugugaccacagacucaugucagccgcugugaaagaugagagggccguucaugcagacaugggauacuggauugagagucagaagaacggcagcuggaaacuggaaaaggcgucccuaaucgaggugaaaacuugcaccuggccuaagucucacacacuguggucgaaugguguacucgaaagcgauaugauaaucccaaagucccuggccggcccgauuucacagcauaaccaccgucccggguaucacacucagaccgcuggaccuuggcaucuuggcaaauuggagcuggacuuuaauuacugcgaggggacaacggucgugaucaccgaaaacuguggaacucggggcccaaguuuacgaacaaccacugugucugguaagcucauucacgaguggugcuguagaagcugcacacugcccccucuuagguauaugggggaagauggauguugguacggcauggagauccgcccaauauccgaaaaagaggagaauauggucaagucacugguuagcgccgguucuggcaaaguggacaacuucaccauggggguauugugccucgcaauucuguuugaagaggugaugcggggaaagcuaggcaagaaacauaugaucgcuggggucuucuucacguuugugcugcuccuguccggacaaaucacuuggagagauauggcccacacccuuauuaugaucggcaguaaugcaagcgacaggauggguauggggguuacauauuuggcccugauugcuaccuucaagauacagcccuuuuuagcgcucggauucuuucugcgcaaacuuacuucucgagaaaaccugcuacucggcgugggccuggccauggcaacaaccuugcagcugccggaggauaucgaacaaauggcuaaugggauugccuuaggacucauggcccugaagcuuaucacacaguucgagacuuaccagcuguggaccgcuuugauuucccucacguguucaaacacaaucuuuacccugacugucgcauggcggaccgccacacuaauacuggcgggugugagucuucucccuguuugccagagcucguccaugcguaaaacugacuggcugccaauggcuguggccgcaaugggcguccccccuuugccccuguucaucuuuucuuuaaaggauacccucaagagaaggagcuggccacugaaugaggggguaauggccgugggacuuguuucaauucuggcuaguuccuugcuccgcaacgacgugccuauggcaggcccccuggucgccggugggcuacugaucgcguguuaugugauuacgggaacaucugcugaucuuaccguagaaaaagccgcagacaucacuugggaggaagaggccgaacaaacaggcgugagccauaaccucaugauaaccgucgacgaugacggcacuaugcggauuaaggaugacgagacagagaauauccugaccguuuuguuaaaaacggcucugcucaucguguccgggauuuucccauacucaauaccggccacucugcuuguguggcacaccuggcagaagcagacacagagaagcggaguccugugggaugugccuagucccccagaaacccaaaaagcagaguuggaagaggguguuuacaggaucaagcagcagggcauuuuugggaaaacacagguaggagugggcguccaaaaggaggguguguuccacacuauguggcauguuacccgaggggcugugcuaacguauaacggaaagcgccuggaacccaauugggccucugucaaaaaggaccucaucuccuacggcggcggguggcggcugagcacacaguggcagaaaggagaggaagugcaaguaauugcggucgagccugguaagaacccaaaaaauuuucagacuaugcccggcaccuuccagacaaccacuggggaaaucggagccauagcacuugauuucaagccuggcaccucggguucaccgaucauuaacagagaggggaaggugguuggauuauauggcaauggcguggucacaaaaaacgggggauacgugucugguaucgcucagacgaaugccgagccagacggccccacuccugaacuggaggaagagauguuuaagaaaaggaaccucaccauuauggauuugcacccagggaguggaaagacacguaaauaucugcccgcuaucguucgcgaagcaauaaagcggagacucaggacccugauucuugccccuacucgaguggucgccgcugagauggaggaagcgcugaagggcuugccgauccgguaccaaacaaccgcaacgaaauccgagcauacuggucgcgaaaucguggaccuaaugugccacgccacauucaccaugagacugcucagccccguaagggugccaaauuauaacuuaauuaucauggaugaggcucauuuuaccgacccugccucuauagcagcccggggguacauuagcacucgaguuggaaugggcgaagcugcggccaucuucaugacagcaacccccccaggcacagcugaugccuuuccucaguccaaugcacccauucaggacgaggagagagacaucccagaacgcucauggaacagugggaaugaguggauaacugauuucgccggaaagacggucugguuugugccgagcauuaaagcugguaacgacaucgccaacugucugaggaagaauggcaaaaaggugauccagcuuucucguaagaccuucgauacagaauaccaaaaaacuaagcugaacgacugggauuuugucguaaccacagacauuuccgagaugggggcgaauuucaaagcagaucgggugaucgacccuagaaggugccucaagcccguuauuuugaccgauggaccagagcgcgugauacuggccggccccaugccugucacugcugccucagcugcacagcgaagaggucggguggggaggaacccacagaaagaaaaugaccaguauaucuuuacgggccaaccccucaacaaugaugaggaccacgcccacuggaccgaagcuaagaugcugcuugacaacauuaauacaccugagggaaucaucccggcccuauucgaaccagagcgcgagaagagugcagcgauugauggcgaauaccgucugaaaggggagagcagaaagacuuucguugaauugaugcggaggggagacuuacccguguggcuggcccauaaagucgcuuccgaggguauaaaguauaccgaucgcaaauggugcuuugacggccagcgaaacaaucagauccucgaagagaacauggauguggagauuuggacaaaggaaggggagaaaaagaagcugagaccucgguggcuugacgccaggaccuacucugauccccuggcacucaaagaauucaaggacuuugcugccggacgcaaaucgaucgcauuggaucugguaacugagauuggcagagugccaagccaccuagcccauaggacacggaaugcucuggacaaccucguuaugcuucacacgucagaacacggugggcgugcguaucgccaugccgucgaggagcugccugaaaccauggagacuuuauugcugcucggccugaugauccuucugacaggaggcgcaaugcucuucuugauauccgggaagggaaucgguaaaaccaguauuggccugaucugugugauugcuucuagcgggauguuauggauggccgaaaucccccuacaguggauagccuccgcaauugugcuggaguuuuucaugaugguccuccuuaucccagagccugaaaagcaacgaaccccgcaggauaaucagcuggcuuacguugugauuggaaucuugacacuggccgcgauaaucgcugccaacgagaugggccuccuggaaacuacgaagagagaccuugguaugucaaaagagcccgggguagugucuccaaccagcuaucucgaugucgaccugcacccugcaagugccuggacauuguacgcuguggcaacuaccguuauuacacccaugcugaggcauaccaucgaaaauuccacugccaacgugagcuuagcggcuauugccaaccaagcagucguacuaaugggccuggacaagggauggccaaucucuaaaauggaucucggcgugccucuucuggccuuggggugcuacucacagguuaauccccugacgcucacagcugccgugcugcuuuuaauaacccacuaugcaauuaucggaccgggccugcaggcuaaggccacucgggaggcgcagaaacgcaccgccgcagguaucaugaagaacccaacagucgacgggauuaugacuaucgaucucgacccugugauauacgauuccaaguuugagaaacaauugggacaggucaugcugcuagugcugugugcuguucagcuccuucugaugagaaccaguugggccuugugcgaagcacugacacucgcuacgggccccauuaccacucugugggaggguagcccaggcaaguucuggaauacaaccaucgccgugucgauggccaacauuuuuagggggucuuauuuagcgggagcuggccuugcauucuccaucaugaaaagcguagggacuggaaagcggggcacagguucacagggggaaacccugggagagaaauggaagaagaaacucaaucaacuaagucgaaaggaauuugaccuguacaaaaagucuggcauaacggagguggauagaaccgaggccaaagaagguuugaagcgcggcgagaucacacaucacgcugucuccagggggagcgccaaacugcagugguucguugaacggaacauggugauucccgagggacgugucaucgaccucggcugugggagaggaggcuggucauauuacugcgcaggucuuaagaaggugacugaaguaaggggguauaccaaaggaggcccuggccacgaggagccggugcccaugaguacauacggguggaauauuguuaagcugaugagcggaaaagauguguuuuacuugccaccugaaaagugugacacucugcucugcgauaucggugaguccucucccagcccuaccgucgaagagucccgcacaauucggguguuaaaaauggucgagccauggcugaagaacaaucaguucuguaucaaggugcuuaaccccuauaugccuaccguuauagaacaucuggagcgacuacagagaaaacacggcgggaugcucguaaggaauccacugucacgcaacucuacucaugaaauguacuggauuaguaauggaacgggcaacaucguggccucggucaauauggugagccgguugcugcucaacagauucacaaugacccaccguaggcccacuaucgagaaggacguugaucuuggugcugggacccggcacgugaacgcggaaccggagacaccuaauauggacgucauuggagagcgcauaaaacgaaucaaggaagagcauaacuccacguggcacuaugacgaugaaaauccauacaaaaccugggccuaucauggcucuuacgaggugaaggcaacuggcucagcuagcuccaugauuaacgggguagugaagcuguuaacaaaacccugggacguugucccuauggugacccaaauggccaugacugauacaaccccauuuggacagcagagaguguucaaggaaaaagucgacacaaggacuccccggaguaugccggguacccgcagaguuaugggcaucacggcagaguggcuguggaggaccuuggggcgaaauaagaaaccucggcucugcacacgugaggaauuuacuaagaaggugagaaccaacgccgcuaugggagccguauucacagaggaaaaucaaugggauucugcgaaagcagccguggaggacgaagauuuuuggaagcuggucgaccgcgagagggagcuacacaaacuuggcaagugugguagcugcguguauaacaugauggggaaacgggaaaagaaacugggagaguucggcaaggcuaagggcucaagagccauuugguacauguggcucggggcacgcuaccuggaauuugaggcuuugggauuccugaaugaggaucauugguuuuccagggaaaacaguuauagcgguguugagggcgaagggcuccacaaacuuggauacauccugcgagacauaucuaagauccccggcggugccauguaugcugaugacacugccgggugggacacccggauuacggaggaugacuuacacaaugaagagaaaaucacacagcagauggauccagagcauagacagcuggcaaacgcgauuuucaaguugaccuaccaaaauaaaguggucaaggugcagaggccuacucccacaggaaccguaauggacaucauaucccgcaaggaucagcguggcucaggccagguugggacuuauggacucaacaccuuuacaaauauggaagcccaacugauucggcagauggagggugaaggcgugcuaagcaaagcugaccuugagaacccacaccugcccgaaaagaaaaucacgcaguggcucgagaccaagggggucgagagacugaaaaggauggccaucucgggagaugacugcguggugaagccuauugaugaccgcuucgcaaacgcuuuguuagcccugaaugauaugggcaagguccgaaaagacauaccacaguggcaaccgucuaaggguuggcaugauuggcagcagguucccuuuuguagucaccacuuccaugaacucaucaugaaagacgggcggaagcuugugguaccuugcagaccacaggacgagcugauuggaagggcacgcaucucccaaggcgccggcuggagccuaagagaaacugcgugucuggggaaagcuuacgcccagauguggucacucauguauuuccaccggagggauuugcgucuggcauccaacgccauuugcucugcugugcccguccauugggugccuacaagccgaaccacuuggaguauccacgcccaucaccaguggaugacaaccgaggacaugcuuacgguuuggaaucgcguguggauagaagauaacccauggauggaggacaagacacccgucaccacuugggaggaugugccuuaccugggaaagagagaagaccaauggugugguucccucaucggcuuaaccagccgggcaacaugggcucagaauauuccgacugccauccagcagguaaggucucugauugggaacgaggaauuuuuggauuacaugccaucaaugaaacgcuucagaaaggaggaggaaagugagggagcgaucugguga

SEQ ID NO: 15353 - RNA, 9873 nt, Artificial Sequence
  derived and/or modified CDS sequence (opt3) from DENV-3__KJ189272__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccauauauuacugaaguugagccggaagacaucgauugcugguguaaccugaccaguacaugggugaccuacgggacuugcaaucaggcuggagagcaucgccgagacaagcguagcguagcccuugcaccccacgugggcaugggucuggauacaagaacccaaacguggauguccgccgagggggcuuggaggcaggucgaaaaaguggagacuugggcauugcggcauccuggauucaccauucucgcccuguuucuggcucacuauaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcauggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuacguuuguaaacacacuuauguggaucgcgguugggggaacggaugcggccucuucggcaaggggagucugguaaccugcgccaaguuucaauguuuagagcccauagagggaaaagugguccaguacgaaaaucugaaguauacagugauuaucacuguucacaccggugaccagcaucaggugggcaacgagacacaaggggucaccgcagaaauuacuccucaggcuuccacgacagaggccacccucccagaauacggaacucuuggccuggagugcucuccgcgaaccgguuuggacuucaaugagaugauccuacugacaaugaaaaacaaggcguggauggugcacagacagugguuuuucgaucucccccugccuuggaccagcggggccacuacagaaacgccaaccuggaauaggaaagagcuucugguaacuuuuaagaacgcacaugcuaaaaagcaagaaguuguggucuugggcucccaggagggagccaugcacacagcucucaccggcgccacagaaauccagaauucagggggaacuaguauuuucgcaggucaccugaagugucgguuaaaaauggacaagcuggagcuaaaaggcaugagcuacgccaugugcaccaacacguuugugcucaagaaagaggucucugaaacccagcaugggacaauacugaucaagguggaguauaagggagaagaugcucccuguaaaauuccuuucuccacugaggacggccacgguaaggcgcauaacgggcgucuuaucaccgcaaauccaguugugacaaaaaaggaggaacccguaucaauagaggccgaaccgccuuucggcgagagcaacauugucaucggaaucggcgauaaugcuuugaaaauuaacugguacaagaaggggaguucuaucggaaaaauguuugaagccacugcacgcggugccagaaggauggcuauucugggcgacaccgccugggauuucggguccgugggaggcguucucaauagccuggguaagauggugcaccaaauauuugggucggcauauacggcgcuuuucucuggcgucuccugggugaugaaaaucggaauuggcguacuguugacauggaucgggcucaacucaaagaauaccaguaugagcuuuuccugcaucgcuauuggaauaaucacucuguacuuaggcgccgugguucaggcagacauggguugugucauuaacuggaaagggaaggagcugaagugcggaucuggcaucuucgugacaaaugaggugcauaccuggacugaacaguauaaauuucaggccgauagccccaagcggcuagcuaccgccauugcaggugcuugggagaacggcgucugugggauccgaucaacaacgcgcauggaaaaucuccuguggaaacaaauagccaacgagcuuaauuacaucuugugggaaaacaauauuaagcugaccguuguggugggagacaucauuggcguacucgagcaggggaaaagaacucugacaccacagccuauggaguuaaaguauaguuggaaaaccuggggaaaggcgaagaucgucacagccgaaacucagaacuccagcuucauaauugauggccccaacaccccagagugccccucugcuucaagggcauggaaugugugggaaguugaggacuacgguuuugggguguucacgacaaacaucuggcugcggcuucgcgaagucuacacccaauugugugaccacagacucaugagugccgcugugaaagaugagagggccguucacgcagacaugggauauuggauugagagccagaagaauggcuccuggaaacuggaaaaggcgucucuaaucgaggugaaaacuugcaccuggccuaagucgcauacacuguggagcaacgguguacucgaauccgauaugauaaucccaaagucacuggccggcccgauuagucagcacaaucaucgucccggguaccacacucagaccgcuggaccuuggcaccuuggcaaauuggagcuggacuuuaacuauugcgaggggacaacggucgugaucaccgaaaauuguggaacucggggcccaucuuuacgaacaaccacugugagcgguaagcucauucaugaguggugcuguagauccugcacacugcccccucuuagguacaugggggaagauggauguugguauggcauggagauccgcccaauaucagaaaaagaggagaacauggucaagagccugguuucugccgguuccggcaaaguggacaauuucaccauggggguauugugccucgcaauucuguuugaagaggugaugcggggaaaguucggcaagaaacacaugaucgcuggggucuucuuuacguucgugcuacugcucaguggacaaaucacuuggagagauauggcccauacccugauuaugaucggcagcaacgcaucugacaggauggguauggggguuacauaccuugccuugauugcuaccuuuaagauacagcccuuccuggcguuaggauuuuuccuccgcaaacugacuucccgagaaaaucuucugcuaggcgugggccucgccauggcaacaacccugcaguugccggaggauaucgaacaaauggcuaacgggauugcccugggauuaauggcccucaagcugaucacacaguuugagacuuaucagcuuuggaccgcucugauuucauugacguguaguaauacaaucuucacccucacugucgcauggcggaccgccacacugauacuagcgggugugagccugcuuccuguuugccagucguccucuaugcguaaaacugacuggcucccaauggcuguggccgcaaugggcguccccccucugcccuuguuuaucuucagccugaaggauaccuuaaagagaaggucauggccacucaacgaggggguaauggccgugggacugguuaguauucuugcuuccucucuguugcgcaaugacgugccuauggcaggcccccucgucgccggugggcugcuaaucgcguguuacgugauuacgggaacaagcgcugaucugaccguagaaaaagccgcagacaucacuugggaggaagaggccgaacaaacaggcgugucccacaaccuuaugauaaccgucgacgaugacggcacuaugcggauuaaggaugacgagacagagaacauccucaccguucuguugaaaacggcuuuacugaucgugucagggauuuuuccauacagcauaccggccacucuccugguguggcauaccuggcagaagcagacacagagaaguggaguccuuugggaugugccuucucccccagaaacccaaaaagcagagcuggaagaggguguuuauaggaucaagcagcagggcauuuucgggaaaacacagguaggagugggcguccaaaaggaggguguguuucacacuauguggcacguuacccgaggggcuguguugacguacaauggaaagcgccuagaacccaacugggccuccgucaaaaaggaccugaucagcuauggcggcggguggcggcucucgacacaguggcagaaaggagaggaagugcaaguaauugcggucgagccugguaagaauccaaaaaacuuccagacuaugcccggcaccuuccagacaaccacuggggaaaucggagccauagcacuggauuuuaagccuggcaccucagguucuccgaucauuaauagagaggggaaggugguuggacuuuacggcaacggcguggucacaaaaaaugggggauaugugagugguaucgcucagacgaacgccgagccagacggccccacuccugaauuagaggaagagauguucaagaaaaggaaucugaccauuauggaucuccauccaggguccggaaagacacguaaauacuugcccgcuaucguucgcgaagcaauaaagcggagacugaggacccucauucuggccccuacucgaguggucgccgcugagauggaggaagcgcuuaagggccugccgauccgguaucaaacaaccgcaacgaaaagcgagcacacuggucgcgaaaucguggacuugaugugccaugccacauuuaccaugagacuacugucucccguaagggugccaaacuacaaucucauuaucauggaugaggcucacuucaccgacccugccagcauagcagcccggggguacauuuccacucgaguuggaaugggcgaagcugcggccaucuuuaugacagcaacccccccaggcacagcugaugccuucccucagucaaacgcacccauucaggacgaggagagagacaucccagaacgcaguuggaauagcgggaacgaguggauaacugauuuugccggaaagacggucugguucgugccgucuauuaaagcugguaaugacaucgccaacuguuuaaggaagaacggcaaaaaggugauccagcugucccguaagaccuuugauacagaauaucaaaaaacuaagcuuaaugacugggauuucgucguaaccacagacauuucagagaugggggcgaacuuuaaagcagaucgggugaucgacccuagaaggugccugaagcccguuauucucaccgauggaccagagcgcgugauauuggccggccccaugccugucacugcugccagugcugcacagcgaagaggucggguggggaggaauccacagaaagaaaacgaccaguacaucuucacgggccaaccccugaauaacgaugaggaccaugcccacuggaccgaagcuaagaugcuccuggacaauauuaacacaccugagggaaucaucccggcccuuuucgaaccagagcgcgagaagagcgcagcgauugauggcgaauaucgucuaaaaggggaguccagaaagacuuuuguugaacugaugcggaggggagacuugcccgugugguuagcccacaaagucgcuucugaggguauaaaguacaccgaucgcaaauggugcuucgacggccagcgaaauaaccagauccuggaagagaauauggauguggagauuuggacaaaggaaggggagaaaaagaagcucagaccucgguggcuggacgccaggaccuauucggauccccuugcacugaaagaauuuaaggacuucgcugccggacgcaaaagcaucgcacucgauuugguaacugagauuggcagagugccaucacaucuggcccacaggacacggaacgcucuagacaaucugguuaugcuccauacguccgaacacggugggcgugcguaccgccacgccgucgaggagcuuccugaaaccauggagacucuguuauugcugggccucaugauccugcuuacaggaggcgcaaugcuguuucucauaagugggaagggaaucgguaaaaccucuauuggcuugaucugugugauugcuagcuccgggaugcuguggauggccgaaauccccuuacaguggauagccucagcaauugugcuagaguucuuuaugaugguccugcucaucccagagccugaaaagcaacgaaccccgcaggauaaccagcuugcuuauguugugauuggaauccugacauuggccgcgauaaucgcugccaaugagaugggccugcucgaaacuacgaagagagaccuggguaugucuaaagagcccgggguagugagcccaaccaguuaccuugaugucgaccuccauccugcauccgccuggacacuguacgcuguggcaacuaccguuauuacacccauguugaggcacaccaucgaaaacagcacugccaaugugucucuggcggcuauugccaaccaagcagucguauuaaugggccuagacaagggauggccaaucucaaaaauggaucugggcgugccucuccuugcccuggggugcuauucccagguuaaccccuugacgcugacagcugccgugcuccugcuuauaacccauuacgcaauuaucggaccgggcuuacaggcuaaggccacucgggaggcgcagaaacgcaccgccgcagguaucaugaagaauccaacagucgacgggauuaugacuaucgaucuggacccugugauauaugauaguaaguucgagaaacaacucggacaggucauguugcuggugcuaugugcuguucagcugcuccuuaugagaaccagcugggcccugugcgaagcauugacacuggcuacgggccccauuaccacucucugggaggguucgccaggcaaguuuuggaacacaaccaucgccgugucuauggccaauauuuucaggggguccuaccuggcgggagcuggcuuagcauuuagcaucaugaaaucaguagggacuggaaagcggggcacagguagucagggggaaacccuuggagagaaauggaagaagaaacugaaccaacucucucgaaaggaauucgaccuauauaaaaaguccggcauaacggagguggauagaaccgaggccaaagaaggucugaagcgcggcgagaucacacaccaugcugucagcagggggucagccaaauugcagugguuuguugaacggaauauggugauucccgagggacgugucaucgaccugggcugugggagaggaggcuggaguuacuauugcgcaggucucaagaaggugacugaaguaaggggguacaccaaaggaggcccuggccacgaggagccggugcccaugagcacauacggguggaacauuguuaagcuuauguccggaaaagauguguucuaucugccaccugaaaagugugacacuuugcugugcgauaucggugagucuagccccuccccuaccgucgaagagucacgcacaauucgggugcucaaaauggucgagccaugguuaaagaauaaccaguucuguaucaaggugcugaaucccuacaugccuaccguuauagaacaccuugagcgacugcagagaaaacauggcgggaugcuaguaaggaacccacucucucgcaauaguacucacgaaauguauuggauuucgaacggaacgggcaauaucguggccagcgucaacauggugucccggcuguugcugaauagauuuacaaugacccaucguaggcccacuaucgagaaggacguugaucucggugcugggacccggcacgugaacgcggaaccggagacaccuaacauggacgucauuggagagcgcauaaaacgaaucaaggaagagcacaauucuacguggcauuacgacgaugaaaacccauauaaaaccugggccuaccacggcucauaugaggugaaggcaacuggcagcgcuuccaguaugauuaaugggguagugaagcuucugacaaaacccugggacguugucccuauggugacccaaauggccaugacugauacaaccccauucggacagcagagaguguuuaaggaaaaagucgacacaaggacuccccggucuaugccggguacccgcagaguuaugggcaucacggcagagugguuauggaggacccuggggcgaaacaagaaaccucgguugugcacacgugaggaauucacuaagaaggugagaaccaaugccgcuaugggagccguauuuacagaggaaaaccaaugggauagcgcgaaagcagccguggaggacgaagauuucuggaagcucgucgaccgcgagagggagcugcauaaacuaggcaagugugguucaugcguguacaauaugauggggaaacgggaaaagaaacuuggagaguuuggcaaggcuaagggcuccagagccauuugguacauguggcugggggcacgcuaucucgaauucgaggcucugggauuuuugaacgaggaucacugguucaguagggaaaauagcuacucugguguugagggcgaagggcugcauaaacucggauauauccuucgagacauauccaagauccccggcggugccauguacgcugaugacacugccgggugggacacccggauuacggaggaugaccugcacaacgaagagaaaaucacacagcagauggauccagagcacagacaguuagcaaaugcgauuuuuaagcugaccuaucaaaacaaaguggucaaggugcagaggccuacucccacaggaaccguaauggacaucauaucacgcaaggaucagcguggcagcggccagguugggacuuacggauugaauaccuucacaaacauggaagcccaacucauucggcagauggagggugaaggcgugcugucgaaagcugaccuagagaauccacaucuucccgaaaagaaaaucacgcaguggcuggagaccaagggggucgagagacucaaaaggauggccaucucuggagaugacugcguggugaagccuauugaugaccgcuuugcaaacgcucuguuggccuuaaacgauaugggcaagguccgaaaagacauaccacaguggcaaccgaguaaggguuggcacgauuggcagcagguucccuucuguucccaucacuuccacgaacugaucaugaaagacgggcggaagcucgugguaccuugcagaccacaggacgagcuuauuggaagggcacgcaucagccaaggcgccggcuggucacugagagaaacugcgugucuagggaaagcuuaugcccagauguggucccugauguacuuucaucggagggaucuccguuuggcaucuaaugccauuugcagcgcugugcccguccacugggugccuacaagucgaaccacuugguccauccaugcccaccaucaguggaugacaaccgaggacaugcugacgguuuggaaccgcguguggauagaagauaauccauggauggaggacaagacacccgucaccacuugggaggaugugccuuaccuuggaaagagagaagaccaauggugugguagccugaucggccucaccucucgggcaacaugggcucagaacauuccgacugccauccagcagguaaggucauuaauugggaaugaggaauuccuggauuauaugccaaguaugaaacgcuuuagaaaggaggaggaauccgagggagcgaucugguga

SEQ ID NO: 15354 - RNA, 9873 nt, Artificial Sequence
  derived and/or modified CDS sequence (opt3) from DENV-3__KJ189273__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggugacccucccagaauauggaacucuuggccuggagugcucuccgcgaaccgguuuggacuucaaugagaugauccuacugacaaugaaaaacaaggccuggaugguacauagacagugguuuuucgaucucccccugccuuggaccagcggggcgacuacagaaacgccaaccuggaauaggaaagagcuucugguuacuuuuaagaacgcccacgcaaaaaagcaagaaguggucguguugggcucccaggagggagcuaugcacacagcccucaccggcgcuacagaaauccagaauucagggggaacuaguauuuucgccggucaucugaagugucgguuaaaaauggacaagcuggagcuaaaaggcaugagcuacgcaaugugcaccaacacguuuguccucaagaaagaggugucugaaacccagcacgggacaauacugaucaagguugaguacaagggagaagaugcccccuguaaaauuccuuucuccacugaggacggccaugguaaggcucacaacgggcgucuuaucaccgcgaauccagugguaacaaaaaaggaggaacccgucaacauagaggcagaaccgccuuucggcgagucaaauauugugaucggaaucggcgauaacgccuugaaaauuaauugguauaagaaggggagcaguaucggaaaaauguuugaagcuacugcccgcggugcaagaaggauggccauucugggcgacaccgcuugggauuucgggucuguuggaggcgugcucaacucccuggguaagaugguccaucaaauauuugggagcgccuacacggcacuuuucucgggcgugucuuggguaaugaaaaucggaauuggcgugcuguugacauggaucgggcucaauuccaagaacaccucaaugaguuuuagcugcaucgcgauuggaauaaucacucuguauuuaggcgcuguuguccaggccgacauggguugugugauuaauuggaaagggaaggagcugaagugcggauccggcaucuucgugacaaacgagguccacaccuggacugaacaguacaaauuucaggcagauucucccaagcggcuagccaccgcuauugccggugcaugggagaauggcguuugugggauccgaagcacaacgcgcauggaaaaccuccuguggaaacaaauagcuaaugagcuuaacuauaucuugugggaaaauaacauuaagcugaccguggugguaggagacaucauuggcguccucgagcaggggaaaagaacucugacaccacagccuauggaguuaaaguacucauggaaaaccuggggaaaggccaagaucgugacagcggaaacucagaacaguuccuucauaauugauggccccaauaccccagagugccccagcgccucuagggcuuggaacguuugggaaguggaggacuaugguuuuggggucuucacgacaaauaucuggcugcggcuucgcgaaguguacacccaauugugugaccacagacucaugucagcagccguuaaagaugagagggcugugcaugccgacaugggauacuggauugagagucagaagaacggcagcuggaaacuggaaaaggcaucccuaaucgagguaaaaacuugcaccuggccuaagucucacacacuguggucgaaugguguccucgaaagcgauaugauaaucccaaagucccuggcgggcccgauuucacagcauaaccaccgucccggguaucacacucagaccgccggaccuuggcaucuuggcaaauuggagcuggacuuuaauuacugcgaggggacaacgguggugaucaccgaaaacuguggaacucggggcccaaguuuacgaacaaccacugucucugguaagcucauucacgaguggugcuguagaagcugcacacugcccccucuuagguauaugggggaagauggauguugguacggcauggagauccgcccaauauccgaaaaagaggagaauaugguuaagucacuggugagcgcugguucuggcaaaguagacaacuucaccauggggguguugugccucgccauucuguuugaagaggucaugcggggaaaguucggcaagaaacauaugaucgcagggguguucuuuacguucguucuacugcucuccggacaaaucacuuggagagauauggcucacacccugauuaugaucggcaguaaugccagcgacaggauggguaugggggugacauaucuugcauugauugccaccuuuaagauacagcccuuccuggcuuuaggauuuuuccuccgcaaacugacuucucgagaaaaccuucugcuaggcgucggccucgcgauggccacaacccugcaguugccggaggauaucgaacaaauggcaaaugggauugcucugggauuaauggcccucaagcugaucacacaguuugagauuuaccagcuuuggacugcccugaucuccuugaccuguucaaacacgauauucacacucaccguggcuuggcggacugcaacccugauccuagccgguguuagucugcuuccugugugccagagcucguccaugcguaaaacagacuggcucccaauggcggucgcugccaugggcguacccccucugcccuuguuuauuuucucucugaaggauacuuuaaagagaaggagcuggccacucaaugagggggugauggcaguuggacuggugucaauccuugccaguucccuguugcgcaacgacgucccuauggcuggcccccucguggcaggugggcugcuaauugccuguuauguaaucaccggaacgucugcggaucugacaguggaaaaagcugccgacauaaccugggaggaagaggcagaacaaacuggcgucagccauaaccuuaugauuacaguugacgaugacggcaccaugcggaucaaggaugacgagacugagaauauccucacagugcuguugaaaaccgccuuacugauuguguccgggauauuuccauacucaaucccggcuacgcuccuggucuggcacacuuggcagaagcagacccagagaagcggagugcuuugggauguuccuagucccccagaaacacaaaaagccgagcuggaagaggguguauacaggauuaagcagcagggcaucuucgggaaaacccaggugggagucggcgugcaaaaggaggguguuuuucacacaauguggcaugugacucgaggggcagucuugaccuauaacggaaagcgccuagaacccaauugggcuucugugaaaaaggaccugauuuccuacggcggcggguggcggcucagcacgcaguggcagaaaggagaggaaguacaagucaucgccguggagccugguaagaacccaaaaaauuuccagacaaugcccggcacuuuccagaccacaaccggggaaauaggagcgaucgcccuggauuuuaagccuggcacuucggguucaccgauuaucaacagagaggggaagguugugggacuuuauggcaauggcgucgugaccaaaaacgggggauacguuucugguauugcacagacaaaugcugagccagacggccccacgccugaauuagaggaagagauguucaagaaaaggaaccugacuaucauggaucuccacccagggaguggaaagacccguaaauauuugcccgccauagugcgcgaagcuauuaagcggagacugaggacacucauccuggcaccuacccgagucguggccgccgagauggaggaagcucuuaagggccugccgauccgguaccaaacuacagcgaccaaauccgagcauacgggucgcgaaauuguagacuugaugugccacgcaacuuuuacaaugagacuacugagccccgugaggguuccaaauuauaaccucaucauaauggaugaggcccauuucaccgacccugcuucuauugccgcacggggguacaucagcacccgagucggaaugggcgaagccgcugcgauuuuuaugacugccacacccccaggcaccgcagaugcuuucccucaguccaaugcccccauccaggacgaggagagagacauaccagaacgcucauggaacagugggaaugaguggauuacagauuuugcaggaaagacugugugguucgugccgagcaucaaagccgguaacgacaucgcuaacuguuuaaggaagaauggcaaaaaggucauucagcugucucguaagacguuugauaccgaauaccaaaaaacaaagcuuaacgacugggauuucguagugacuaccgacaucuccgagaugggggccaauuuuaaagcggaucggguuauugacccuagaaggugccugaagcccgugauacucacagauggaccagagcgcgucaucuuggcaggccccaugccugugaccgccgcuucagccgcucagcgaagaggucggguugggaggaacccacagaaagaaaaugaccaguauauuuucacuggccaaccccugaacaaugaugaggaccacgcacacuggacggaagccaagaugcuccuggacaacaucaauaccccugagggaaucauuccggcucuuuucgaaccagagcgcgagaagagugccgcaauagauggcgaauaccgucuaaaaggggagagcagaaagacauuuguggaacugaugcggaggggagacuugcccgucugguuagcgcauaaaguggccuccgaggguaucaaguauacugaucgcaaauggugcuucgacggccagcgaaacaaucagauucuggaagagaacauggauguagagaucuggaccaaggaaggggagaaaaagaagcucagaccucgguggcuggacgcuaggacauacucugauccccuugcccugaaagaauuuaaggacuucgcagcuggacgcaaaucgauugcccucgauuuggugaccgagaucggcagaguuccaagccaccuggcacauaggacucggaaugcccuagacaaccuggucaugcuccacacaucagaacacggugggcgugcuuaucgccaugcgguggaggagcuuccugaaacgauggagacccuguuauugcugggccucaugauacugcuuacuggaggcgccaugcuguuucucaucuccgggaagggaauugguaaaacaaguaucggcuugauuugugugaucgcaucuagcgggaugcuguggauggcugaaauacccuuacaguggauugccuccgccaucguccuagaguucuuuaugaugguucugcucauuccagagccugaaaagcaacgaaccccgcaggauaaucagcuugcauacgugguaaucggaauacugaccuuggcugccaucauugcggcuaacgagaugggccugcucgaaacaacuaagagagaccuggguaugucaaaagagcccgggguggucucuccaacgagcuaucuugauguggaccuccacccugccagugcauggacccuguacgccguugcuacaacugugaucacccccauguugaggcauacaauugaaaauuccaccgcaaacgucagccuggccgcgaucgcuaaccaagccguaguguuaaugggccuagacaagggauggccaauaucuaaaauggaucugggcguuccucuccuugcacuggggugcuacucacaggugaaucccuugacucugacggccgcuguccuccugcuuauuacacacuaugccaucaucggaccgggcuuacaggcaaaggcuacccgggaggcccagaaacgcacugcggccgguauuaugaagaacccaaccguggacgggaucaugacaauagaucuggacccugucauuuacgauuccaaguucgagaaacaacucggacaggugauguugcugguucuaugugcagugcagcugcuccuuaugagaacuaguugggcucugugcgaagccuugacccuggcaacaggccccaucacgacccucugggaggguagcccaggcaaguuuuggaauacuacaauugcuguaucgauggccaacaucuucagggggucuuaucuggccggagcgggcuuagcuuuuuccauaaugaaaagcguggggaccggaaagcggggcacugguucacagggggaaacacuuggagagaaauggaagaagaaacugaaucaacucagucgaaaggaauucgaccuauacaaaaagucuggcaucaccgaggucgauagaacggaggcaaaagaaggucugaagcgcggcgagauuacccaucacgccguuuccagggggagcgcuaaauugcagugguuuguggaacggaacauggucauccccgagggacgugugauugaccugggcugugggagaggaggcuggucauauuacugcgccggucucaagaagguaacagaagugaggggguauacuaaaggaggcccuggccacgaggagccgguucccaugaguaccuacggguggaauaucgugaagcuuaugagcggaaaagaugucuucuaccugccaccugaaaagugugacacauugcugugcgauauuggugaguccucucccagcccuacuguggaagagucccgcaccauccggguccucaaaaugguggagccaugguuaaagaacaaucaguucuguauaaagguucugaaccccuauaugccuacaguaauugaacaucuugagcgacugcagagaaaacacggcgggaugcuagugaggaauccacucucacgcaacucuacccaugaaauguacuggaucaguaauggaacuggcaacaucgucgcaucggugaauaugguuagccggcuguugcugaacagauuuacgaugacacaccguaggcccaccauugagaaggacguggaucucggugccgggacucggcacgucaacgcugaaccggagaccccuaauauggacgugauaggagagcgcaucaaacgaauuaaggaagagcauaacuccacauggcacuaugacgaugaaaauccauacaaaacgugggcguaucauggcucuuacgagguaaaggccaccggcucagcaagcuccaugaucaacggggugguuaagcuucugacuaaacccugggacgucgugccuauggugacacaaauggcuaugaccgauacuacaccauucggacagcagagagucuuuaaggaaaaaguugacaccaggacaccccggaguaugccggguacucgcagagugaugggcauuaccgccgagugguuauggaggacgcuggggcgaaauaagaaaccucgguugugcacccgugaggaauucacaaagaagguaagaacuaacgcagccaugggagcuguguuuaccgaggaaaaucaaugggauucugccaaagcggcagucgaggacgaagauuucuggaagcucguggaccgcgagagggagcugcacaaacuaggcaagugugguagcugcguuuauaacaugauggggaaacgggaaaagaaacuuggagaguuuggcaaggccaagggcucaagagcuaucugguacauguggcugggggcccgcuaccucgaauucgaggcacugggauuuuugaaugaggaucauugguucuccagggaaaacaguuauagcgguguggagggcgaagggcugcacaaacucggauacauacuucgagacaucucuaagauucccggcggugcuauguaugccgaugacacagcugggugggacacucggaucaccgaggaugaccugcacaaugaagagaaaauuacgcagcagauggauccagagcauagacaguuagccaacgcaaucuuuaagcugacauaccaaaauaaagucgugaagguacagaggccuacccccacuggaacaguuauggacauaauuucccgcaaggaucagcguggcucaggccagguggggaccuauggauugaacacuuucaccaauauggaagcgcaacucauccggcagauggagggugaaggcguccugagcaaagccgaccuagagaacccacaccuucccgaaaagaaaaucacacaguggcuggagacgaaggggguggagagacucaaaaggauggcuauuucgggagaugacugcguggucaagccuauagaugaccgcuuugccaacgcacuguuggcuuuaaaugauaugggcaagguucgaaaagacaucccacaguggcaaccgucuaaggguuggcaugauuggcagcaggugcccuucuguagucaccacuuccaugaacugauuaugaaagacgggcggaagcucguagugccuugcagaccacaggacgagcuuaucggaagggcccgcauuucccaaggcgcaggcuggagccugagagaaaccgccugucuagggaaagcguacgcucagauguggucacugauguauuuucaccggagggaucuccguuuggccuccaacgcaaucugcucugccguccccgugcauuggguuccuacuagccgaacaaccuggaguauacacgcucaucaccaguggaugacuacagaggacaugcugaccguguggaaucgcgucuggaucgaagauaacccauggauggaggacaagacgcccgugacaaccugggaggauguaccuuaccuuggaaagagagaagaccaauggugugguucccugauuggccucacuagccgggccaccugggcacagaauaucccgacagcuauucagcagguuaggucuuuaaucgggaacgaggaauuccuggauuacaugccaucaaugaaacgcuuuagaaaggaggaggaaagugagggagccauuugguga

SEQ ID NO: 15355 - RNA, 9873 nt, Artificial Sequence
  derived and/or modified CDS sequence (opt3) from DENV-3__KJ189274__SS-prME
accagccugugccucaugaugauccuucccgcagcucuggcauuccacuugacuuccagagacggagaaccuaggaugauuguggggaagaacgaacggggaaaaucuuuacuguuuaagacugccucagguauaaauauguguacguuaaucgcgauggaucucggcgaaaugugcgacgauaccgucacauacaaauguccacauauuacugaaguugaaccggaagacaucgauugcugguguaaccugaccaguacaugggugaccuaugggacuugcaaucaggcuggagagcaccgccgagacaagcguagcgucgcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccacccucccagaauauggaacucuuggccuggagugcucuccgcgaaccgguuuggacuucaaugagaugauccuacugacaaugaaaaacaaggcguggauggugcauagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcacacagcucucaccggcgccacagaaauccaaaauucagggggaacaaguauuuucgcaggucaucugaagugucgguuaaaaauggacaagcuggagcuaaaaggcaugagcuacgccaugugcaccaacacguuugugcucaagaaagaggucucugaaacccagcacgggacaauacugaucaagguggaguacaagggagaagaugcucccuguaaaauuccuuucuccacugaggacggccaugguaaggcgcacaacgggcgucuuaucaccgcaaauccaguugugacuaagaaagaggaacccguaaacauagaggccgaaccgccuuucggcgagucaaauauugucaucggaaucggcgauaacgcuuugaaaauuaauugguauaagaaggggagcaguaucggaaaaauguuugaagccacugcacgcggugccagaaggauggcuauucugggcgacaccgccugggauuucgggucugugggaggcguucucaacucccuggguaagauggugcaucaaauauuugggagcgcauacacggcgcuuuucucgggcgucucuugggugaugaaaaucggaauuggcguacuguugacauggaucgggcucaauuccaagaacaccucaaugaguuuuagcugcaucgcuauuggaauaaucacucuguauuuaggcgccgugguucaggcagacauggguugugucauuaauuggaaagggaaggagcugaagugcggauccggcaucuucgugacaaacgaggugcacaccuggacugaacaguacaaauuucaggccgauucucccaagcggcuagcuaccgccauugccggugcuugggagaauggcgucugugggauccgaagcacaacgcgcauggaaaaccuccuguggaaacaaauagccaaugagcuuaacuauaucuugugggaaaauaacauuaagcugaccguuguggugggagacaucauuggcguacucgagcaggggagaaggacucugacaccacagccuauggaguuaaaauacucauggaagaccuggggaaaagcgaagaucgucacagccgaaacucagaacaguuccuucauaauugauggccccaauaccccagagugccccagcgcuucucgggcauggaacgugugggaaguugaggacuaugguuuugggguguucacgacaaauaucuggcugcgccuuagagaagucuacacccaauugugugaccacaggcucaugucagccgcugugaaggaugagcgugccguucaugcagacaugggauacuggauugagagucagaaaaacggcagcuggaagcuggaaaaagcgucccuaaucgaggugaagacuugcaccuggccuaaaucucacacacuguggucgaaugguguacucgaaagcgauaugauaaucccaaagucccuggccggcccgauuucacagcauaaccaccggcccggguaucacacucagaccgcuggaccuuggcaucuuggcaaguuggagcuggacuuuaauuacugcgaggggacaacggucgugaucaccgaaaacuguggaacucgaggcccaaguuuaagaacaaccacugugucugguaaacucauucacgaguggugcuguaggagcugcacacugcccccucuucgcuauaugggggaagauggauguugguacggcauggagauccggccaauauccgaaaaggaggagaauauggucaaaucacugguuagcgccgguucuggcaagguggacaacuucaccauggggguauugugccucgcaauucuguuugaagaggugaugagaggaaaauucggcaagaagcauaugaucgcuggggucuucuuuacguucgugcuacugcucuccggacaaaucacuuggagggauauggcccacacccugauuaugaucggcaguaaugcaagcgaccgcauggguauggggguuacauaucuugccuugauugcuaccuuuaaaauacagcccuuccuggcguuaggauuuuuccuccgaaagcugacuucucgggaaaaccuucugcuaggcgugggccucgccauggcaacaacccugcaguugccggaggauaucgaacaaauggcuaaugggauugcccugggauuaauggcccucaaacugaucacacaguuugagauuuaccagcuuuggacugcucugaucuccuugaccuguucaaacacgauauucacacucaccgucgcauggcguacugccacccugauccuagcgggugugagucugcuuccuguuugccagagcucguccaugagaaagacagacuggcucccaauggcuguggccgcaaugggcguacccccucugcccuuguuuauuuucucucugaaagauacuuuaaagaggcgcagcuggccacucaaugaggggguaauggccgugggacugguuucaauccuugcuaguucccuguugcggaacgacgugccuauggcaggcccccucgucgccggugggcugcuaauugcguguuaugugaucaccggaacgucugcugaucugacaguagaaaaggccgcagacauaaccugggaggaagaggccgaacaaacuggcgugagccauaaccuuaugauuacagucgacgaugacggcaccaugagaaucaaagaugacgagacugagaauauccucacaguucuguugaagaccgcuuuacugauuguguccgggauauuuccauacucaaucccggccacgcuccugguguggcacacuuggcagaaacagacccagaggagcggaguccuuugggaugugccuagucccccagaaacacaaaaggcagagcuggaagaggguguuuaccgaauuaaacagcagggcaucuucgggaagacccagguaggagugggcguccaaaaagaggguguguuucacacaauguggcauguuacucgcggggcuguguugaccuauaacggaaagcggcuagaacccaauugggccucugucaagaaagaccugauuuccuacggcggcggguggagacucagcacgcaguggcagaagggagaggaagugcaaguaaucgcggucgagccugguaaaaacccaaagaauuuccagacaaugcccggcacuuuccagaccacaaccggggaaauaggagccaucgcacuggauuuuaaaccuggcacuucggguucaccgauuaucaacagggaggggaaggugguuggacuuuauggcaauggcguggucaccaagaacgggggauacgugucugguauugcucagacaaaugccgagccagacggccccacgccugaauuagaggaagagauguucaaaaagcguaaccugacuaucauggaucuccacccagggaguggaaaaacccgcaaguauuugcccgcuauaguucgggaagcaauuaaaagaaggcugcgaacacucauccuggccccuacccggguggucgccgcugagauggaggaagcgcuuaagggccugccgauccgcuaccaaacuacagcaaccaaguccgagcauacggguagagaaauuguggacuugaugugccacgccacuuuuacaaugaggcuacugagccccguacgggugccaaauuauaaccucaucauaauggaugaggcucauuucaccgacccugccucuauugcagcccgaggguacaucagcaccagaguuggaaugggcgaagcugcggccauuuuuaugacugcaacacccccaggcaccgcugaugccuucccucaguccaaugcacccauccaggacgaggagcgcgacauaccagaaaggucauggaacagugggaaugaguggauuacagauuuugccggaaaaacugucugguucgugccgagcaucaaggcugguaacgacaucgccaacuguuuacguaaaaauggcaagaaagugauucagcugucucggaagacguuugauaccgaauaccaaaagacaaaacuuaacgacugggauuucgucguaacuaccgacaucuccgagaugggggcgaauuuuaaggcagauagagugauugacccuaggcgcugccugaaacccguuauacucacagauggaccagagcgagugaucuuggccggccccaugccugucaccgcugccucagcugcacagagacgggguaggguggggcgcaacccacagaaggaaaaugaccaguauauuuucacuggccaaccccugaacaaugaugaggaccacgcccacuggacggaagcuaaaaugcuccuggacaacaucaauaccccugagggaaucauuccggcccuuuucgaaccagagcgugagaagagugcagcgauagauggcgaauacagacuaaagggggagagccggaaaacauuuguugaacugaugaggcgcggagacuugcccgugugguuagcccauaaggucgcuuccgaggguaucaaauauacugaucgaaaguggugcuucgacggccagagaaacaaucagauucuggaagagaacauggauguggagaucuggaccaaagaaggggagaagaaaaagcuccggccuagguggcuggacgcccgcacauacucugauccccuugcacugaaggaauuuaaagacuucgcugccggaagaaagucgauugcacucgauuugguaaccgagaucggcagggugccaagccaccuggcccaucggacucguaaugcucuagacaaccugguuaugcuccacacaucagaacacggugggcgcgcguaucgacaugccgucgaggagcuuccugaaacgauggagacccuguuauugcugggccucaugauacugcuuacuggaggcgcaaugcuguuucucaucuccgggaaaggaauugguaagacaaguaucggcuugauuugugugaucgcuucuagcgggaugcuguggauggccgaaauacccuuacaguggauugccuccgcaaucgugcuagaguucuuuaugaugguccugcucauuccagagccugaaaaacaaagaaccccgcaggauaaucagcuugcuuacguugugaucggaauacugaccuuggccgcgaucauugcugccaacgagaugggccugcucgaaacaacuaagagggaccuggguaugucaaaggagcccgggguagugucuccaacgagcuaucuugaugucgaccuccacccugcaagugccuggacccuguacgcuguggcaacaacuguuaucacccccauguugcggcauacaauugaaaauuccaccgccaacgugagccuggcggcuaucgccaaccaagcagucguauuaaugggccuagacaaaggauggccaauaucuaagauggaucugggcgugccucuccuugcccuggggugcuacucacagguuaaucccuugacucugacggcugccgugcuccugcuuauuacacacuaugcaaucaucggaccgggcuuacaggcuaaagccacccgcgaggcgcagaagagaacugccgcagguauuaugaaaaacccaaccgucgacgggaucaugacaauagaucuggacccugugauuuacgauuccaaguucgagaagcaacucggacaggucauguugcuggugcuaugugcuguucagcugcuccuuaugaggacaaguugggcccugugcgaagcauugacccuggcuacaggccccaucacgacccucugggaggguagcccaggcaaauuuuggaauacuacaauugccgugucgauggccaacaucuuccgggggucuuaucuggcgggagcuggcuuagcauuuuccauaaugaaaagcguagggaccggaaaacgaggcacugguucacagggggaaacacuuggagagaaguggaaaaagaagcugaaucaacucaguagaaaagaguucgaccuauacaagaaaucuggcaucaccgagguggaucgcacggaggccaaggaaggucugaaaaggggcgagauuacccaucacgcugucucccgggggagcgccaaguugcagugguuuguugaacguaacauggugauccccgagggaagagucauugaccugggcugugggaggggaggcuggucauauuacugcgcaggucucaaaaaggugacagaaguacgcggguauacuaagggaggcccuggccacgaggagccggugcccaugaguaccuacggguggaauaucguuaaacuuaugagcggaaaggauguguucuaccugccaccugaaaaaugugacacauugcugugcgauauuggugaguccucucccagcccuacugucgaagagucccggaccauccgagugcucaagauggucgagccauggcugaaaaacaaucaguucuguauaaaggugcuaaaccccuauaugccuacaguuauugaacaucuugagagacugcagaggaagcacggcgggaugcuaguacgcaauccacucucacggaacucuacccaugaaauguacuggaucaguaauggaacuggcaacaucguggccucggucaauauggugagcagacuguugcugaaccguuuuacgaugacacacaggcggcccaccauugagaaagacguugaucucggugcugggacucgccacgugaacgcggaaccggagaccccuaauauggacgucauaggagagcgaaucaagagaauuagggaagaacauaacuccacauggcacuaugacgaugaaaauccauacaaaacgugggccuaucauggcucuuacgaggugaaggcaaccggcucagcuagcuccaugaucaacgggguagugaaacuucugacuaagcccugggacguugucccuauggugacacaaauggccaugaccgauacuacaccauucggacagcagcggguguuuaaggaaaaagucgacacccgcacacccagaaguaugccggguacuaggcgaguuaugggcauuaccgcagagugguuauggcggacgcuggggcguaauaagaaaccuagauugugcacccgcgaggaguucacaaagaaagugaggacuaacgccgcuaugggagccguauuuaccgaggaaaaucaaugggauucugcgaaggcagccguggaggacgaagauuucuggaagcucgucgaccgggagagagagcugcacaaacuaggcaagugugguagcugcguguauaacaugauggggaaacgcgaaaagaaacuuggagaguuuggcaaggcuaaaggcucaagggccaucugguacauguggcugggggcacgauaccucgaguucgaggcucugggauuuuugaaugaggaucauugguucucccgggaaaacaguuauagcgguguugagggcgaagggcugcacaagcucggauacauacuuagagacaucucuaagauucccggcggugccauguaugcugaugacacagccgggugggacacuaggaucaccgaggaugaccugcacaaugaagagaaaauuacgcagcagauggauccagagcaucgccaguuagcaaacgcgaucuuuaagcugacauaccaaaauaaaguggucaaggugcagcguccuacccccacuggaacaguaauggacauaauuucccggaaagaucagagaggcucaggccagguugggaccuauggauugaacacuuucaccaauauggaagcccaacucaucaggcagauggagggugaaggcgugcugagcaaggcugaccuagagaacccacaccuucccgaaaagaaaaucacacaguggcuggagacgaagggggucgagcgccucaaacgaauggccauuucgggagaugacugcguggugaagccuauagaugaccgguuugcaaacgcucuguuggccuuaaaugauaugggcaaagucagaaaggacaucccacaguggcaaccgucuaaggguuggcaugauuggcagcagguucccuucuguagucaccacuuccaugaacugauuaugaaagacgggaggaagcucgugguaccuugccgcccacaggacgagcuuaucggcagagcacggauuucccaaggcgccggcuggagccugagggaaaccgcgugucuagggaaggcuuacgcccagauguggucacugauguauuuucaccgucgagaucuccgcuuggcauccaacgccaucugcucugcugugcccguccauugggugccuacuagcagaacaaccuggaguauacacgcccaucaccaguggaugacuacagaggacaugcugaccguuuggaaucggguguggaucgaagauaacccauggauggaggacaagacgcccgucacaaccugggaggaugugccuuaccuuggaaaaagggaagaccaauggugugguucccugauuggccucacuagccgcgcaaccugggcucagaauaucccgacagccauucagcagguaagaucuuuaaucgggaacgaggaguuccuggauuacaugccaucaaugaagcgguuuaggaaggaggaggaaagugagggagcgauuugguga

SEQ ID NO: 15356 - RNA, 9873 nt, Artificial Sequence
  derived and/or modified CDS sequence (opt3) from DENV-3__KJ189275__SS-prME
accagccugugccucaugaugauccuucccgcagcucuggcauuccacuugacauccagagacggagaaccuaggaugauuguggggaagaacgaacggggaaaaucuuuacuguuuaagacugccucagguauaaauauguguacguuaaucgcgauggaucucggcgaaaugugcgacgauaccgucaccuacaaauguccacauauuacugaaguugaaccggaagacaucgauugcugguguaaccugaccaguacaugggugaccuaugggacuugcaaucaggcuggagagcaccgccgagacaagcguagcgucgcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccacccucccagaauauggaacucuuggccuggagugcucuccgcgaaccgguuuggacuucaaugagaugauccuacugacaaugaaaaacaaggcguggauggugcauagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcacacagcucucaccggcgccacagaaauccaaaauucagggggaacaaguauuuucgcaggucaucugaagugucgguuaaaaauggacaagcuggagcuaaaaggcaugagcuacgccaugugcaccaacacguuugugcucaagaaagaggucucugaaacccagcacgggacaauacugaucaagguggaguacaagggagaagaugcucccuguaaaauuccuuucuccacugaggacggccaugguaaggcgcacaacgggcgucuuaucaccgcaaauccaguugugacuaagaaagaggaacccguaaacauagaggccgaaccgccuuucggcgagucaaauauugucaucggaaucggcgauaacgcuuugaaaauuaauugguauaagaaggggagcaguaucggaaaaauguuugaagccacugcacgcggugccagaaggauggcuauucugggcgacaccgccugggauuucgggucugugggaggcguucucaacucccuggguaagauggugcaucaaauauuugggagcgcauacacggcgcuuuucucgggcgucucuugggugaugaaaaucggaauuggcguacuguugacauggaucgggcucaauuccaagaacaccucaaugaguuuuagcugcaucgcuauuggaauaaucacucuguauuuaggcgccgugguucaggcagacauggguugugucauuaauuggaaagggaaggagcugaagugcggauccggcaucuucgugacaaacgaggugcacaccuggacugaacaguacaaauuucaggccgauucucccaagcggcuagcuaccgccauugccggugcuugggagaauggcgucugugggauccgaagcacaacgcgcauggaaaaccuccuguggaaacaaauagccaaugagcuuaacuauaucuugugggaaaauaacauuaagcugaccguuguggugggagacaucauuggcguacucgagcaggggagaaggacucugacaccacagccuauggaguuaaaauacucauggaagaccuggggaaaagcgaagaucgucacagccgaaacucagaacaguuccuucauaauugauggccccaauaccccagagugccccagcgcuucucgggcauggaacgugugggaaguugaggacuaugguuuugggguguucacgacaaauaucuggcugcgccuuagagaagucuacacccaauugugugaccacaggcucaugucagccgcugugaaggaugagcgugccguucaugcagacaugggauacuggauugagagucagaaaaacggcagcuggaagcuggaaaaagcgucccuaaucgaggugaagacuugcaccuggccuaaaucucacacacuguggucgaaugguguacucgaaagcgauaugauaaucccaaagucccuggccggcccgauuucacagcauaaccaccggcccggguaucacacucagaccgcuggaccuuggcaucuuggcaaguuggagcuggacuuuaauuacugcgaggggacaacggucgugaucaccgaaaacuguggaacucgaggcccaaguuuaagaacaaccacugugucugguaaacucauucacgaguggugcuguaggagcugcacacugcccccucuucgcuauaugggggaagauggauguugguacggcauggagauccggccaauauccgaaaaggaggagaauauggucaaaucacugguuagcgccgguucuggcaagguggacaacuucaccauggggguauugugccucgcaauucuguuugaagaggugaugagaggaaaauucggcaagaagcauaugaucgcuggggucuucuuuacguucgugcuacugcucuccggacaaaucacuuggagggauauggcccacacccugauuaugaucggcaguaaugcaagcgaccgcauggguauggggguuacauaucuugccuugauugcuaccuuuaaaauacagcccuuccuggcguuaggauuuuuccuccgaaagcugacuucucgggaaaaccuucugcuaggcgugggccucgccauggcaacaacccugcaguugccggaggauaucgaacaaauggcuaaugggauugcccugggauuaauggcccucaaacugaucacacaguuugagacuuaccagcuuuggaccgcucugauuuccuugacguguucaaacacaaucuucacccucacugucgcauggcguaccgccacacugauacuagcgggugugagucugcuuccuguuugccagagcucguccaugagaaagacugacuggcucccaauggcuguggccgcaaugggcguacccccucugcccuuguuuaucuucucucugaaagauaccuuaaagaggcgcagcuggccacucaaugaggggguaauggccgugggacugguuucaauucuugcuaguucccuguugcggaacgacgugccuauggcaggcccccucgucgccggugggcugcuaaucgcguguuaugugauuacgggaacaucugcugaucugaccguagaaaaggccgcagacaucacuugggaggaagaggccgaacaaacaggcgugagccauaaccuuaugauaaccgucgacgaugacggcacuaugagaauuaaagaugacgagacagagaauauccucaccguucuguugaagacggcuuuacugaucguguccgggauuuuuccauacucaauaccggccacucuccugguguggcacaccuggcagaaacagacacagaggagcggaguccuuugggaugugccuagucccccagaaacccaaaaggcagagcuggaagaggguguuuaccgaaucaaacagcagggcauuuucgggaagacacagguaggagugggcguccaaaaagaggguguguuucacacuauguggcauguuacccgcggggcuguguugacguauaacggaaagcggcuagaacccaauugggccucugucaagaaagaccugaucuccuacggcggcggguggagacucagcacacaguggcagaagggagaggaagugcaaguaauugcggucgagccugguaaaaacccaaagaauuuccagacuaugcccggcaccuuccagacaaccacuggggaaaucggagccauagcacuggauuuuaaaccuggcaccucggguucaccgaucauuaacagggaggggaaggugguuggacuuuauggcaauggcguggucacaaagaacgggggauacgugucugguaucgcucagacgaaugccgagccagacggccccacuccugaauuagaggaagagauguucaaaaagcguaaccugaccauuauggaucuccacccagggaguggaaaaacacgcaaguauuugcccgcuaucguucgggaagcaauaaaaagaaggcugcgaacccucauucuggccccuacucggguggucgccgcugagauggaggaagcgcuuaagggccugccgauccgcuaccaaacaaccgcaacgaaguccgagcauacugguagagaaaucguggacuugaugugccacgccacauuuaccaugaggcuacugagccccguacgggugccaaauuauaaccucauuaucauggaugaggcucauuucaccgacccugccucuauagcagcccgaggguacauuagcacuagaguuggaaugggcgaagcugcggccaucuuuaugacagcaacacccccaggcacagcugaugccuucccucaguccaaugcacccauucaggacgaggagcgcgacaucccagaaaggucauggaacagugggaaugaguggauaacugauuuugccggaaaaacggucugguucgugccgagcauuaaggcugguaacgacaucgccaacuguuuacguaaaaauggcaagaaagugauccagcugucucggaagaccuuugauacagaauaccaaaagacuaaacuuaacgacugggauuucgucguaaccacagacauuuccgagaugggggcgaauuuuaaggcagauagagugaucgacccuaggcgcugccugaaacccguuauucucaccgauggaccagagcgagugauauuggccggccccaugccugucacugcugccucagcugcacagagacgggguaggguggggcgcaacccacagaaggaaaaugaccaguauaucuucacgggccaaccccugaacaaugaugaggaccacgcccacuggaccgaagcuaaaaugcuccuggacaacauuaauacaccugagggaaucaucccggcccuuuucgaaccagagcgugagaagagugcagcgauugauggcgaauacagacuaaagggggagagccggaaaacuuuuguugaacugaugaggcgcggagacuugcccgugugguuagcccauaaggucgcuuccgaggguauaaaauauaccgaucgaaaguggugcuucgacggccagagaaacaaucagauccuggaagagaacauggauguggagauuuggacaaaagaaggggagaagaaaaagcuccggccuagguggcuggacgcccgcaccuacucugauccccuugcacugaaggaauuuaaagacuucgcugccggaagaaagucgaucgcacucgauuugguaacugagauuggcagggugccaagccaccuggcccaucggacacguaaugcucuagacaaccugguuaugcuccacacgucagaacacggugggcgcgcguaucgacaugccgucgaggagcuuccugaaaccauggagacucuguuauugcugggccucaugauccugcuuacaggaggcgcaaugcuguuucucauauccgggaaaggaaucgguaagaccaguauuggcuugaucugugugauugcuucuagcgggaugcuguggauggccgaaauccccuuacaguggauagccuccgcaauugugcuagaguucuuuaugaugguccugcucaucccagagccugaaaaacaaagaaccccgcaggauaaucagcuugcuuacguugugauuggaauccugacauuggccgcgauaaucgcugccaacgagaugggccugcucgaaacuacgaagagggaccuggguaugucaaaggagcccgggguagugucuccaaccagcuaucuugaugucgaccuccacccugcaagugccuggacacuguacgcuguggcaacuaccguuauuacacccauguugcggcauaccaucgaaaauuccacugccaacgugagccuggcggcuauugccaaccaagcagucguauuaaugggccuagacaaaggauggccaaucucuaagauggaucugggcgugccucuccuugcccuggggugcuacucacagguuaaucccuugacgcugacagcugccgugcuccugcuuauaacccacuaugcaauuaucggaccgggcuuacaggcuaaagccacucgcgaggcgcagaagagaaccgccgcagguaucaugaaaaacccaacagucgacgggauuaugacuaucgaucuggacccugugauauacgauuccaaguucgagaagcaacucggacaggucauguugcuggugcuaugugcuguucagcugcuccuuaugaggaccaguugggcccugugcgaagcauugacacuggcuacgggccccauuaccacucucugggaggguagcccaggcaaauuuuggaauacaaccaucgccgugucgauggccaacauuuuccgggggucuuaucuggcgggagcuggcuuagcauuuuccaucaugaaaagcguagggacuggaaaacgaggcacagguucacagggggaaacccuuggagagaaguggaaaaagaagcugaaucaacucaguagaaaagaguucgaccuauacaagaaaucuggcauaacggagguggaucgcaccgaggccaaggaaggucugaaaaggggcgagaucacacaucacgcugucucccgggggagcgccaaguugcagugguuuguugaacguaacauggugauucccgagggaagagucaucgaccugggcugugggaggggaggcuggucauauuacugcgcaggucucaaaaaggugacugaaguacgcggguauaccaagggaggcccuggccacgaggagccggugcccaugaguacauacggguggaauauuguuaaacuuaugagcggaaaggauguguucuaccugccaccugaaaaaugugacacuuugcugugcgauaucggugaguccucucccagcccuaccgucgaagagucccggacaauucgagugcucaagauggucgagccauggcugaaaaacaaucaguucuguaucaaggugcuaaaccccuauaugccuaccguuauagaacaucuugagagacugcagaggaagcacggcgggaugcuaguacgcaauccacucucacggaacucuacucaugaaauguacuggauuaguaauggaacgggcaacaucguggccucggucaauauggugagcagacuguugcugaaccguuuuacaaugacccacaggcggcccacuaucgagaaagacguugaucucggugcugggacccgccacgugaacgcggaaccggagacaccuaauauggacgucauuggagagcgaauaaagagaaucagggaagaacauaacuccacguggcacuaugacgaugaaaauccauacaaaaccugggccuaucauggcucuuacgaggugaaggcaacuggcucagcuagcuccaugauuaacgggguagugaaacuucugacaaagcccugggacguugucccuauggugacccaaauggccaugacugauacaaccccauucggacagcagcggguguuuaaggaaaaagucgacacacgcacucccagaaguaugccggguaccaggcgaguuaugggcaucacggcagagugguuauggcggacccuggggcguaauaagaaaccuagauugugcacacgcgaggaguucacuaagaaagugaggaccaacgccgcuaugggagccguauuuacagaggaaaaucaaugggauucugcgaaggcagccguggaggacgaagauuucuggaagcucgucgaccgggagagagagcugcacaaacuaggcaagugugguagcugcguguauaacaugauggggaaacgcgaaaagaaacuuggagaguuuggcaaggcuaaaggcucaagggccauuugguacauguggcugggggcacgauaccucgaguucgaggcucugggauuuuugaaugaggaucauugguucucccgggaaaacaguuauagcgguguugagggcgaagggcugcacaagcucggauacauccuuagagacauaucuaagauccccggcggugccauguaugcugaugacacugccgggugggacaccaggauuacggaggaugaccugcacaaugaagagaaaaucacacagcagauggauccagagcaucgccaguuagcaaacgcgauuuuuaagcugaccuaccaaaauaaaguggucaaggugcagcguccuacucccacaggaaccguaauggacaucauaucccggaaagaucagagaggcucaggccagguugggacuuauggauugaacaccuucacaaauauggaagcccaacucauuaggcagauggagggugaaggcgugcugagcaaggcugaccuagagaacccacaccuucccgaaaagaaaaucacgcaguggcuggagaccaagggggucgagcgccucaaacgaauggccaucucgggagaugacugcguggugaagccuauugaugaccgguuugcaaacgcucuguuggccuuaaaugauaugggcaaagucagaaaggacauaccacaguggcaaccgucuaaggguuggcaugauuggcagcagguucccuucuguagucaccacuuccaugaacugaucaugaaagacgggaggaagcucgugguaccuugccgcccacaggacgagcuuauuggcagagcacggaucucccaaggcgccggcuggagccugagggaaacugcgugucuagggaaggcuuacgcccagauguggucacugauguauuuucaccgucgagaucuccgcuuggcauccaacgccauuugcucugcugugcccguccauugggugccuacaagcagaaccacuuggaguauccacgcccaucaccaguggaugacaaccgaggacaugcugacgguuuggaaucggguguggauagaagauaacccauggauggaggacaagacacccgucaccacuugggaggaugugccuuaccuuggaaaaagggaagaccaauggugugguucccugaucggccucaccagccgcgcaacaugggcucagaauauuccgacugccauccagcagguaagaucuuuaauugggaacgaggaguuccuggauuacaugccaucaaugaagcgguuuaggaaggaggaggaaagugagggagcgaucugguga

SEQ ID NO: 15357 - RNA, 9873 nt, Artificial Sequence
  derived and/or modified CDS sequence (opt3) from DENV-3__KJ189276__SS-prME
accagccugugccucaugaugauccuucccgcagcucuggcauuccacuugacuuccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccacccucccagaauauggaacucuuggccugcagugcucuccgcgaaccgguuuggacuucaaugagaugauccuacugacaaugaaaaacaaggcguggauggugcauagacaaugguuuuucgaucucccccugccuuggaccagcggggccacuuccgagacaccaacguggaauaggaaagaacuucugguaaccuuuaagaacgcacacgcuaaaaagcaggagguuguggucuugggcucacaggaaggagccaugcacacugcucucacaggcgccaccgagauccagaauagugggggaacaagcauuuucgcaggucaucugaagugucgguuaaaaauggacaagcuggaacuaaaaggcaugucuuacgccaugugcacuaacaccuuugugcucaagaaagaggucuccgagacgcaacacgggaccauacugaucaagguggaauacaagggagaggaugcucccuguaaaauuccuuucucaacagaagacggccaugguaaggcgcacaacgggcgucuuaucacugcaaauccaguugugaccaaaaaggaggagcccguaaacauagaagccgagccgccuuucggcgaaagcaauauugucaucggaaucggcgauaacgcuuugaaaauuaauugguauaagaaggggaguucuaucggaaaaauguuugaggccacagcacgcggugccagaaggauggcuauucugggcgacacugccugggauuucggguccgugggaggcguucucaacagccuggguaagauggugcaucagauauuugggucggcauacaccgcgcuuuucucuggcgucuccugggugaugaaaaucggaauuggcguacuguugacguggaucgggcucaauucaaagaacacaaguaugagcuuuuccugcaucgcuauuggaauaaucacccuguauuuaggcgccgugguucaggcagacauggguugugucauuaauuggaaagggaaggaacugaagugcggaucuggcaucuucgugacuaacgaggugcacacauggaccgagcaguacaaauuucaagccgauagccccaagcggcuagcuacugccauugccggugcuugggaaaauggcgucugugggauccgaucaaccacacgcauggagaaccuccuguggaaacagauagccaaugaacuuaacuauaucuugugggagaauaacauuaagcugacgguuguggugggagacaucauuggcguacucgaacaggggaaaagaacccugacuccacagccuauggaguuaaaguacaguuggaaaacauggggaaaggcgaagaucgucaccgccgagacacaaaacuccagcuucauaauugauggccccaauacuccagaaugccccucugcuucaagggcauggaacgugugggagguugaagacuaugguuuugggguguucaccacgaauaucuggcugcggcuucgcgaggucuacacacaguugugugaccacagacucaugagugccgcugugaaagaugaaagggccguucaugcagacaugggauacuggauugagagccagaagaacggcuccuggaaacuggagaaggcgucucuaaucgaagugaaaaccugcacuuggccuaagucgcacacccuguggagcaaugguguacucgaguccgauaugauaaucccaaagucacuggccggcccgauuagucagcauaaccaccgucccggguaucacacacaaacugcuggaccuuggcaucuuggcaaauuggaacuggacuuuaauuacugcgaggggaccacagucgugaucacggagaacuguggaacccggggcccaucuuuacgaacuacaaccgugagcgguaagcucauucacgaauggugcuguagauccugcacucugcccccucuuagguauaugggggaggauggauguugguacggcauggaaauccgcccaauaucagagaaagaagagaauauggucaagagccugguuucugccgguuccggcaaaguggacaacuucacaauggggguauugugccucgcaauucuguuugaggaagugaugcggggaaaguucggcaagaaacauaugaucgcuggggucuucuuuaccuucgugcuacugcucaguggacagaucacguggagagauauggcccacacucugauuaugaucggcagcaaugcaucugacaggauggguauggggguuaccuaucuugccuugauugcuacauuuaagauacagcccuuccuggcguuaggauuuuuccuccgcaaacugaccucccgagagaaccuucugcuaggcgugggccucgccauggcaacuacacugcaauugccggaagauaucgagcagauggcuaaugggauugcccugggauuaauggcccucaagcugaucacccaguuugaaacauaccagcuuuggacugcucugauuucauugaccuguaguaacacgaucuucacacucaccgucgcauggcggacugccacccugauacuagcgggugugagccugcuuccuguuugccaaucguccucuaugcguaaaacagacuggcucccaauggcuguggccgcaaugggcgucccaccucugcccuuguuuaucuucagccugaaggauacuuuaaagagaaggucauggccacucaaugaggggguaauggccgugggacugguuaguauucuugcuuccucucuguugcgcaacgacgugccuauggcaggcccccucgucgccggugggcugcuaaucgcguguuaugugauuaccggaacgagcgcugaucugacaguagagaaagccgcagacaucaccugggaagaggaagccgagcagacuggcgugucccauaaccuuaugauaacagucgacgaugacggcaccaugcggauuaaggaugacgaaacugagaauauccucacaguucuguugaaaaccgcuuuacugaucgugucagggauuuuuccauacagcauaccggccacgcuccugguguggcacacuuggcagaagcagacccaaagaaguggaguccuuugggaugugccuucucccccagagacacagaaagcagaacuggaggaagguguuuacaggaucaagcagcagggcauuuucgggaaaacccaaguaggagugggcguccagaaggaggguguguuucacacaauguggcauguuacucgaggggcuguguugaccuauaacggaaagcgccuagagcccaauugggccuccgucaaaaaggaccugaucagcuacggcggcggguggcggcucucgacgcaguggcaaaaaggagaagaggugcagguaauugcggucgaaccugguaagaaccccaagaauuuccagacaaugcccggcacuuuccagaccacaaccggggagaucggagccauagcacuggauuuuaagccuggcacuucagguucuccgaucauuaacagagaagggaaggugguuggacuuuauggcaauggcguggucaccaaaaacgggggauacgugagugguaucgcucaaacaaaugccgagccagacggccccacgccugaguuagaagaggaaauguucaagaaaaggaaccugacuauuauggaucuccacccaggguccggaaagacccguaaauauuugcccgcuaucguucgcgaggcaauaaagcggagacugaggacacucauucuggccccuacccgaguggucgccgcugaaauggaggaggcgcuuaagggccugccgauccgguaccagacuacagcaaccaaaagcgaacauacgggucgcgagaucguggacuugaugugccacgccacuuuuacaaugagacuacugucucccguaagggugccaaauuauaaccucauuaucauggaugaagcucauuucaccgacccugccagcauagcagcccggggguacauuuccacccgaguuggaaugggcgaggcugcggccaucuuuaugacugcaacacccccaggcaccgcugaugccuucccucagucaaaugcacccauucaggacgaagagagagacaucccagagcgcaguuggaacagcgggaaugaauggauaacagauuuugccggaaagacugucugguucgugccgucuauuaaagcugguaacgacaucgccaacuguuuaaggaagaauggcaaaaaggugauccaacugucccguaagacguuugauaccgaguaccagaaaacaaaacuuaacgacugggauuucgucguaacuaccgacauuucagaaaugggggcgaauuuuaaagcagaucgggugaucgacccuagaaggugccugaagcccguuauucucacagauggaccagagcgcgugauauuggccggccccaugccugucaccgcugccagugcugcacagcgaagaggucggguggggaggaacccacagaaagagaaugaccaauauaucuucacuggccagccccugaacaaugaugaagaccacgcccacuggacggaggcuaagaugcuccuggacaacauuaauaccccugaaggaaucaucccggcccuuuucgagccagaacgcgagaaaagcgcagcgauugauggcgaauaccgucuaaaaggggaauccagaaagacauuuguugagcugaugcggaggggagacuugcccgugugguuagcccauaaagucgcuucugaagguauaaaguauacugaucgcaaauggugcuucgacggccagcgaaacaaucagauccuggaggaaaacauggauguggagauuuggaccaaggagggggagaagaagaagcucagaccucgguggcuggacgccaggacauacucggauccccuugcacugaaagaguuuaaggacuucgcugccggacgcaaaagcaucgcacucgauuugguaaccgaaauuggcagagugccaucacaccuggcccauaggacucggaaugcucuagacaaccugguuaugcuccacacauccgagcacggugggcgugcguaucgccaugccgucgaagaacuuccugagacgauggaaacccuguuauugcugggccucaugauccugcuuacuggaggcgcaaugcuguuucucauaagugggaagggaaucgguaaaacaucuauuggcuugaucugugugauugcuagcuccgggaugcuguggauggccgagauccccuuacaauggauagccucagcaauugugcuagaguucuuuaugaugguccugcucaucccagagccugagaagcagcgaaccccgcaggauaaucaacuugcuuacguugugauuggaauccugaccuuggccgcgauaaucgcugccaacgaaaugggccugcucgagacaacuaagagagaccuggguaugucuaaagaacccgggguagugagcccaacgaguuaucuugaugucgaccuccacccugcauccgccuggacccuguacgcuguggcaacaacuguuauuacccccauguugaggcauacaaucgagaauagcaccgccaacgugucucuggcggcuauugccaaccaggcagucguauuaaugggccuagacaagggauggccaaucucaaaaauggaucugggcgugccucuccuugcccuggggugcuacucccagguuaaucccuugacucugacggcugccgugcuccugcuuauaacacacuaugcaauuaucggaccgggcuuacaggcuaaggccacccgggaagcgcaaaaacgcacugccgcagguaucaugaagaacccaaccgucgacgggauuaugacaaucgaucuggacccugugauauacgauaguaaguucgagaaacagcucggacaggucauguugcuggugcuaugugcuguucagcugcuccuuaugagaacuagcugggcccugugcgaggcauugacccuggcuacaggccccauuacgacccucugggaagguucgccaggcaaguuuuggaauacuacaaucgccgugucuauggccaacauuuucaggggguccuaucuggcgggagcuggcuuagcauuuagcaucaugaaaucaguagggaccggaaagcggggcacugguagucaaggggagacacuuggagaaaaauggaagaagaaacugaaucagcucucucgaaaggaguucgaccuauacaaaaaguccggcauaaccgaaguggauagaacggaggccaaagagggucugaagcgcggcgaaaucacccaucacgcugucagcagggggucagccaaauugcagugguuuguugagcggaacauggugauucccgaaggacgugucaucgaccugggcugugggagaggaggcuggaguuauuacugcgcaggucucaagaaggugacagagguaaggggguauacuaaaggaggcccuggccacgaagaaccggugcccaugagcaccuacggguggaauauuguuaaacuuauguccggaaaagauguguucuaccugccaccugagaagugugacacauugcugugcgauaucggugaaucuagccccuccccuacugucgaggaaucacgcaccauucgggugcucaaaauggucgagccaugguuaaagaacaaucaguucuguaucaaggugcugaaccccuauaugccuacaguuauagagcaucuugaacgacugcaaagaaaacacggcgggaugcuaguaaggaauccacucucucgcaacaguacccaugagauguacuggauuucgaauggaacuggcaacaucguggccagcgucaauauggugucccggcuguugcugaacagauuuacgaugacacaccguaggcccaccaucgaaaaggacguugaucucggugcugggacucggcacgugaacgcggagccggaaaccccuaauauggacgucauuggagagcgcauaaaacgaaucaaggaggaacauaacucuacauggcacuaugacgaugagaauccauacaaaacgugggccuaucauggcucauacgaagugaaggcaaccggcagcgcuuccaguaugauuaacgggguagugaaacuucugacuaaacccugggacguugucccuauggugacacagauggccaugaccgauacuacaccauucggacagcaaagaguguuuaaggagaaagucgacaccaggacaccccggucuaugccggguacucgcagaguuaugggcaucaccgcagaaugguuauggaggacgcuggggcgaaauaagaaaccucgguugugcacccgugaggaguucacaaagaaggugagaacuaacgccgcuaugggagccguauuuaccgaagagaaucaguggaacagcgcgaaagcagccguggaagaugaggacuucuggaagcucgucgaucgcgaaagggagcugcacaaacuaggcaagugugguucaugcguguauaauaugauggggaaacgggagaagaaacuuggagaauuuggcaaggcuaagggcuccagagccauuugguacauguggcugggggcacgcuaccucgaguucgaagcucugggauuuuugaacgaggaccauugguucaguagggagaauagcuauucugguguugaaggcgaggggcugcacaaacucggauacauccuucgagauauauccaagauccccggcggugccauguaugcugacgauacagccgggugggacacucggauuaccgaagacgaucugcacaacgaggagaagaucacgcagcagauggacccagagcauagaagguuagcaaaugcgauuuuuaagcugacauaccaaaacaaaguggucaaggugcagcgcccuacccccacuggaacaguaauggauaucauaucacguaaggaccagcggggcagcggccagguugggaccuauggauugaauacuuucaccaacauggaggcccaacucauuagacagauggaaggugagggcgugcugucgaaagcugaucuagaaaacccacaccuucccgagaagaaaaucacacaguggcuggaaacgaagggggucgagaggcucaaacgcauggccaucucuggagacgauugcguggugaagccuauugacgaucgauuugcaaaugcucuguuggccuuaaacgacaugggcaagguccggaaagauauaccacaguggcaaccgaguaaggguuggcaugacuggcagcagguucccuucuguucccaccacuuccaugagcugaucaugaaagaugggagaaagcucgugguaccuugcaggccacaggacgaacuuauuggacgcgcaagaaucagccaaggcgccggcuggucacugcgggagaccgcgugucuagggaaggcuuacgcccagauguggucccugauguauuuucacaggcgugaccuccgauuggcaucuaaugccauuugcagcgcugugcccguccauugggugccuacaagucgcacaaccugguccauccacgcccaucaccaguggaugacuacagaagauaugcugaccguuuggaacagaguguggauagaggacaauccauggauggaagauaagacgcccgucacaaccugggaggacgugccuuaccuuggaaagcgggaggaucaauggugugguagccugaucggccucacuucuagggcaaccugggcucagaacauuccgacagccauccagcagguacgcucauuaauugggaaugaagaguuccuggacuacaugccaaguaugaaaagauuucggaaggaagaggaguccgaaggagcgaucugguga

SEQ ID NO: 15358 - RNA, 9873 nt, Artificial Sequence
  derived and/or modified CDS sequence (opt3) from DENV-3__KJ189277__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccacccucccagaauauggaacucuuggccugcagugcucuccgcgaaccgguuuggacuucaaugagaugauccuacugacaaugaaaaacaaggcguggauggugcauagacaaugguuuuucgaucucccccugccuuggaccagcggggccacuuccgagacaccaacguggaauaggaaagaacuucugguaaccuuuaagaacgcacacgcuaaaaagcaggagguuguggucuugggcucacaggaaggagccaugcacacugcucucacaggcgccaccgagauccagaauagugggggaacaagcauuuucgcaggucaucugaagugucgguuaaaaauggacaagcuggaacuaaaaggcaugucuuacgccaugugcacuaacaccuuugugcucaagaaagaggucuccgagacgcaacacgggaccauacugaucaagguggaauacaagggagaggaugcucccuguaaaauuccuuucucaacagaagacggccaugguaaggcgcacaacgggcgucuuaucacugcaaauccaguugugaccaaaaaggaggagcccguaaacauagaagccgagccgccuuucggcgaaagcaauauugucaucggaaucggcgauaacgcuuugaaaauuaauugguauaagaaggggaguucuaucggaaaaauguuugaggccacagcacgcggugccagaaggauggcuauucugggcgacacugccugggauuucggguccgugggaggcguucucaacagccuggguaagauggugcaucagauauuugggucggcauacaccgcgcuuuucucuggcgucuccugggugaugaaaaucggaauuggcguacuguugacguggaucgggcucaauucaaagaacacaaguaugagcuuuuccugcaucgcuauuggaauaaucacccuguauuuaggcgccgugguucaggcagacauggguugugucauuaauuggaaagggaaggaacugaagugcggaucuggcaucuucgugacuaacgaggugcacacauggaccgagcaguacaaauuucaagccgauagccccaagcggcuagcuacugccauugcaggugcuugggaaaauggcgucugugggauccgaucaaccacacgcauggagaaccuccuguggaaacagauagccaaugaacuuaacuauaucuugugggagaauaacauuaagcugacgguuguggugggagacaucauuggcguacucgaacaggggaaaagaacccugacuccacagccuauggaguuaaaguacaguuggaaaacauggggaaaggcgaagaucgucaccgccgagacacaaaacuccagcuucauaauugauggccccaauacuccagaaugccccucugcuucaagggcauggaacgugugggagguugaagacuaugguuuugggguguucaccacgaauaucuggcugcggcuucgcgaggccuacacacaguugugugaccacagacucaugagugcugccgucaaagaugaaagggcagugcaugcggacaugggauacuggauugagagccagaagaacggcuccuggaaacuggagaaggccucucuaaucgaaguuaaaaccugcacuuggccuaagucgcacacccuguggagcaauggugugcucgaguccgauaugauaaucccaaagucacuggcuggcccgauuagucagcauaaccaccgucccggguaucacacacaaacugccggaccuuggcaucuuggcaaauuggaacuggacuuuaauuacugcgaggggaccacaguagucaucacggagaacuguggaacccggggcccaucuuuacgaacuacaaccgugagcgguaagcucauucacgaauggugcuguagauccugcacucugcccccucuuagguauaugggggaggauggauguugguacggcauggaaauccgcccaauaucagagaaagaagagaauauggugaagagccuggucucugcagguuccggcaaaguugacaacuucacaauggggguguugugccucgcuauucuguuugaggaaguaaugcggggaaaguucggcaagaaacauaugaucgccgggguguucuuuaccuucguccuacugcucaguggacagaucacguggagagauauggcacacacucugauuaugaucggcagcaaugccucugacaggauggguaugggggugaccuaucuugcuuugauugcgacauuuaagauacagcccuuccuggccuuaggauuuuuccuccgcaaacugaccucccgagagaaccuucugcuaggcguuggccucgcaauggcuacuacacugcaauugccggaagauaucgagcagauggccaaugggauugcccugggauuaauggcucucaagcugaucacccaguuugaaacauaccagcuuuggacugcacugauuucauugaccuguaguaacacgaucuucacacucaccguggccuggcggacugcgacccugauacuagcuggugucagccugcuuccugugugccaaucguccucuaugcguaaaacagacuggcucccaauggccguugcagccaugggcgugcccccucugcccuuguuuaucuucagccugaaggauacuuuaaagagaaggucauggccacucaaugagggggucauggcuguaggacuggugaguauucuugcauccucucuguugcgcaacgacguuccuauggccggcccccucguggcgggugggcugcuaaucgcuuguuaugucauuaccggaacgagcgccgaucugacaguggagaaagcagccgacaucaccugggaagaggaagcugagcagacuggcguaucccauaaccuuaugauaacaguggacgaugacggcaccaugcggauuaaggaugacgaaacugagaauauccucacaguccuguugaaaaccgccuuacugaucguuucagggauuuuuccauacagcauaccggcaacgcuccugguguggcacacuuggcagaagcagacccaaagaaguggagugcuuugggaugucccuucucccccagagacacagaaagcugaacuggaggaagguguguacaggaucaagcagcagggcauuuucgggaaaacccaaguuggaguaggcgugcagaaggagggugucuuucacacaauguggcaugugacucgaggggccguuuugaccuauaacggaaagcgccuagagcccaauugggcguccgugaaaaaggaccugaucagcuacggcggcggguggcggcucucgacgcaguggcaaaaaggagaagagguccaggugauugccguagaaccugguaagaacccaaaaaauuuccagacaaugcccggcacuuuccagaccacaaccggggagaucggagcaauagcucuggauuuuaagccuggcacuucagguucuccgaucauuaacagagaagggaaggucgugggacuuuauggcaauggcguugugaccaaaaacgggggauacgucagugguaucgcccaaacaaaugcugagccagacggccccacgccugaguuagaagaggaaauguucaagaaaaggaaccugacuauuauggaucuccacccaggguccggaaagacccguaaauauuugcccgcaaucgugcgcgaggccauaaagcggagacugaggacacucauucuggccccuacccgaguuguggcugcggaaauggaggaggcacuuaagggccugccgauccgguaccagacuacagccaccaaaagcgaacauacgggucgcgagaucgucgacuugaugugccacgcuacuuuuacaaugagacuacugucucccgugaggguaccaaauuauaaccucauuaucauggaugaagcccauuucaccgacccugcaagcauagccgcucggggguacauuuccacccgagugggaaugggcgaggcggccgcaaucuuuaugacugcuacacccccaggcaccgccgaugcauucccucagucaaaugcccccauucaggacgaagagagagacaucccagagcgcaguuggaacagcgggaaugaauggauaacagauuuugcuggaaagacuguuugguucgucccgucuauuaaagccgguaacgacaucgcgaacuguuuaaggaagaauggcaaaaaggugauccaacugucccguaagacguuugauaccgaguaccagaaaacaaagcuuaacgacugggauuucguggucacuaccgacauuucagaaaugggggcaaauuuuaaagccgaucggguaaucgacccuagaaggugccugaagcccgugauucucacagauggaccagagcgcguuauauuggcuggccccaugccugugaccgccgcuagugcagcccagcgaagaggucgggucgggaggaacccacagaaagagaaugaccaauauaucuucacuggccagccccugaacaaugaugaagaccacgcucacuggacggaggccaagaugcuccuggacaacauuaauaccccugaaggaaucaucccggcacuuuucgagccagaacgcgagaagagcgcggccauugauggcgaguaccgucuaaaaggggaauccagaaagacauuuguggagcugaugcggaggggagacuugcccguuugguuagcucauaaaguggccucugaagguauaaaguauacugaucgcaaauggugcuucgacggccagcgaaacaaucagauccuggaggaaaacauggaugucgagauuuggaccaaggagggggaaaaaaagaagcucagaccucgguggcuggacgcaaggacauacucggauccccuugcucugaaagaguuuaaggacuucgccgcaggacgcaaaagcaucgcccucgauuuggugaccgaaauuggcagaguaccaucacaccuggcucauaggacucggaaugcgcuagacaaccuggugaugcuccacacauccgagcacggugggcgugccuaucgccaugcaguugaagagcuuccugagacgauggaaacccuguuauugcugggccucaugauccugcuuacuggaggcgcuaugcuguuucucauaagugggaagggaaucgguaaaacaucuauuggcuugaucugugucauugccagcuccgggaugcuguggauggccgagauccccuuacaauggauagcaucagcuauugugcuagaauucuuuaugauggugcugcucaucccagagccugagaagcagcgaaccccgcaggauaaucaacuugccuacgucguuauuggaauccugaccuuggcggcuauaaucgccgcaaacgaaaugggccugcucgagacaacuaagagagaccuggguaugucuaaagaacccggggugguaagcccaacgaguuaucuugauguggaccuccacccugccuccgcuuggacccuguacgcagucgccacaacugugauuacccccauguugaggcauacaaucgagaauagcaccgcgaacguuucucuggcugccauugcaaaccaggccguggucuuaaugggccuagacaagggauggccaaucucaaaaauggaucugggcguaccucuccuugcucuggggugcuacucccaggugaaucccuugacucugacggccgcaguucuccugcuuauaacacacuaugcuauuaucggaccgggcuuacaggccaaggcgacccgggaagcccaaaaacgcacugcagcugguaucaugaagaacccaaccguggacgggauuaugacaaucgaucuggacccugucauauacgauaguaaguucgagaaacagcucggacaggugauguugcugguccuaugugccgugcagcugcuccuuaugagaacuagcugggcacugugcgaggcuuugacccuggccacaggccccauuacgacccucugggaagguucgccaggcaaguuuuggaauacuacaaucgccguuucuauggcgaacauuuucaggggguccuaucuggcuggagcaggcuuagccuuuagcaucaugaaaucaguggggaccggaaagcggggcacugguagucaaggggagacacuuggagaaaaauggaagaagaaacugaaucagcucucucgaaaggaguucgaccuauacaaaaaguccggcauaaccgaaguagauagaacggaggcuaaagagggucugaagcgcggcgaaaucacccaucacgccgugagcagggggucagcaaaauugcagugguuugucgagcggaacaugguuauucccgaaggacgugugaucgaccugggcugugggagaggaggcuggaguuauuacugcgccggucucaagaaggucacagaggugaggggguauacuaaaggaggcccuggccacgaagagccgguacccaugagcaccuacggguggaauauugugaagcuuauguccggaaaagauguuuucuaccugccaccugagaagugugacacauugcugugcgauaucggugaaucuagccccuccccuacuguggaggaaucacgcaccauucggguccucaaaaugguggagccaugguuaaagaacaaucaguucuguaucaagguccugaaccccuauaugccuacagugauagagcaucuugaacgacugcaaagaaaacacggcgggaugcuaguuaggaauccacucucucgcaacaguacccaugagauguacuggauuucgaauggaacuggcaacaucguagcuagcgugaauauggucucccggcuguugcugaacagauuuacgaugacacaccguaggcccaccaucgaaaaggacguggaucucggugcggggacucggcacguuaacgccgagccggaaaccccuaauauggacgugauuggagagcgcauaaaacgaaucaaggaggaacauaacucuacauggcacuaugacgaugagaauccauacaaaacgugggcauaucauggcucauacgaagucaaggcuaccggcagcgccuccaguaugauuaacggggugguaaagcuucugacuaaacccugggacgugguuccuauggucacacagauggcaaugaccgauacuacaccauucggacagcaaagaguguuuaaggagaaaguggacaccaggacaccccggucuaugccggguacucgcagagucaugggcaucaccgccgaaugguuauggaggacgcuggggcgaaauaagaaaccucgguugugcacccgugaggaguucacaaagaagguuagaacuaacgcugccaugggagcgguguuuaccgaagagaaucaguggaacagcgcaaaagccgcuguagaagaugaggacuucuggaagcucguggaucgcgaaagggagcugcacaaacuaggcaagugugguucaugcgucuauaauaugauggggaaacgggagaagaaacuuggagaauuuggcaaggccaagggcuccagagcaauuugguacauguggcugggggcucgcuaccucgaguucgaagcccugggauuuuugaacgaggaccauugguucaguagggagaauagcuauucugguguggaaggcgaggggcugcacaaacucggauacauccuucgagauauauccaagauccccggcggugcuauguaugccgacgauacagcagggugggacacucggauuaccgaagacgaucugcacaacgaggaaaaaaucacgcagcagauggacccagagcauagaagguuagcgaaugccauuuuuaagcugacauaccaaaacaaaguugugaagguccagcgcccuacccccacuggaacagugauggauaucauaucacguaaggaccagcggggcagcggccagguagggaccuauggauugaauacuuucaccaacauggaggcucaacucauuagacagauggaaggugagggcguucugucgaaagccgaucuagaaaacccacaccuucccgagaagaaaaucacacaguggcuggaaacgaaggggguggagaggcucaaacgcauggcaaucucuggagacgauugcgucgugaagccuauugacgaucgauuugcuaaugcccuguuggcauuaaacgacaugggcaaggugcggaaagauauaccacaguggcaaccgaguaaggguuggcaugacuggcagcagguccccuucuguucccaccacuuccaugagcugaucaugaaagaugggagaaagcucguugugccuugcaggccacaggacgaacuuauuggacgcgccagaaucagccaaggcgcgggcuggucacugcgggagaccgcuugucuagggaaagccuacgcacagauguggucccugauguauuuucacaggcgugaccuccgauuggccucuaaugcuauuugcagcgccguacccgugcauugggucccuacuagucgcacaaccugguccauccacgcacaucaccaguggaugacuacagaagauaugcugaccguguggaacagaguuuggauagaggacaauccauggauggaagauaagacgcccgugacaaccugggaggacgucccuuaccuuggaaagcgggaggaucaauggugugguagccugaucggccucacuucuagggcuaccugggcccagaacauuccgacagcgauccagcaggugcgcucauuaauugggaaugaagaguuccuggacuacaugccaaguaugaaaagauuucggaaggaagaggaguccgaaggagcuaucugguga

SEQ ID NO: 15359 - RNA, 9873 nt, Artificial Sequence
  derived and/or modified CDS sequence (opt3) from DENV-3__KJ189278__SS-prME
accagccugugccucaugaugauccuucccgccgcucuggcauuccacuugacauccagagacggcgagccuaggaugauuguggggaagaacgaacggggaaaaucuuuacuguuuaagacugccucagguacgaauauguguacccuaauagcgauggaucucggcgagaugugcgacgauacagucacuuacaaauguccacauaucaccgaaguugagccggaagacauugauugcugguguaaccugacaaguaccugggugacuuaugggacaugcaaucaggcuggagagcaccgccgagacaagcguagcguagcccuugcaccccaugugggcaugggucuggauaccagaacgcaaacuuggauguccgccgagggggcuuggaggcaggucgaaaaaguggagaccugggcauugcggcacccuggauucacaauccucgcccuguuucuggcucauuacauuggcacuucucucacccagaagguugugaucuucauauuacugaugcuugucacaccaucgaugaccaugcgcugugugggcguagggaacagagacuuuguugaaggauugucaggugccacguggguggaugucgugcuggagcacggcgggugcgugacuacaauggcgaagaauaaacccacccuagacaucgagcuccagaagacugaagcaacacaacuggccacccuuaggaaacuguguauugagggaaagaucacgaacauuaccacagauagccggugcccuacucagggcgaagcugucuugccagaggaacaggaccagaauuauguuuguaaacacaccuacguggaucgcgguugggggaacggaugcggccucuucggcaaggggagucugguaacaugcgccaaguuucaauguuuagagcccaucgagggaaaagugguccaguaugaaaaucugaaguacacugugauaauuaccguucauacaggugaccagcaccaggugggcaacgagacccaaggggucacugcagaaaucacgccucaggcuuccacaaccgaggccacucucccagaauauggaacccuuggccuggagugcucuccgcgaacagguuuggacuucaaugagaugauucuacugaccaugaaaaacaaggcguggauggugcauagacagugguuuuucgaucucccccugccuuggacuagcggggccacaacggaaaccccaacuuggaauaggaaagagcuucugguaacauuuaagaacgcacacgcuaaaaagcaagaaguuguggucuugggcucccaggagggagccaugcacaccgcucucacaggcgccacugaaauccagaauucagggggaaccaguaucuucgcaggucaucugaagugucgguuaaaaauggacaagcuggagcuaaaaggcaugagcuacgccaugugcacgaacaccuuugugcucaagaaagaggucucugaaacacagcacgggacuauucugauaaagguggaguacaagggagaagaugcucccuguaaaaucccuuucuccaccgaggacggccaugguaaggcgcacaacgggcgucuuauuacagcaaauccaguugugacuaaaaaggaggaacccguaaacaucgaggccgaaccgccuuucggcgagucaaauauagucauuggaaucggcgauaacgcuuugaaaaucaauugguauaagaaggggagcaguauuggaaaaauguuugaagccaccgcacgcggugccagaaggauggcuauccugggcgacacggccugggauuucgggucugugggaggcguucucaacucccuggguaagauggugcaucaaauuuuugggagcgcauacacagcgcuuuucucgggcgucucuugggugaugaaaauaggaaucggcguacuguugaccuggauugggcucaauuccaagaacacuucaaugaguuuuagcugcaucgcuaucggaauuauaacacuguauuuaggcgccgugguucaggcagacauggguugugucaucaauuggaaagggaaggagcugaagugcggauccggcauuuucgugaccaacgaggugcacacuuggaccgaacaguacaaauuucaggccgauucucccaagcggcuagcuacagccaucgcaggugcuugggagaauggcgucugugggauucgaagcacgacccgcauggaaaaccuccuguggaaacaaaucgccaaugagcuuaacuauauauugugggaaaauaacguuaagcugacuguggugguaggagacaucauuggcguccucgagcaggggaaaagaacacugaccccacagccuauggaguuaaaguacucauggaaaacauggggaaaggcgaagaucgugacugccgaaacccagaacaguuccuucauuaucgauggccccaauacgccagagugccccagcgcuucuagggcauggaacguuugggaaguggaggacuaugguuuuggggucuucacaaccaauauauggcugcggcuucgcgaaguguacacucaauugugugaccacagacucaugucagccgcuguuaaagaugagagggccgugcaugcagacaugggauacuggauugagagucagaagaacggcagcuggaaacuggaaaaggcgucccuaaucgagguaaaaaccugcacauggccuaagucucacacucuguggucgaaugguguccucgaaagcgauaugauuaucccaaagucccuggccggcccgauaucacagcauaaccaccgucccggguaucacacccagacagcuggaccuuggcaucuuggcaaauuggagcuggacuuuaauuacugcgaggggacgaccguggugaucacugaaaacuguggaacacggggcccaaguuuacgaaccacuacagucucugguaagcucauucacgaguggugcuguagaagcugcacccugcccccucuuagguauaugggggaagauggauguugguacggcauggagauccgcccaauuuccgaaaaagaggagaauaugguuaagucacuggugagcgccgguucuggcaaaguagacaacuucacgauggggguguugugccucgcaauccuguuugaagaggucaugcggggaaaguucggcaagaaacauaugauagcugggguguucuuuacuuucguucuacugcucuccggacaaauuaccuggagagauauggcccacacacugaucaugaucggcaguaaugcaagcgacaggauggguaugggggugaccuaucuugccuugauugcuacuuuuaagauccagcccuuccuggcguuaggauuuuuccuccgcaaacugacaucucgagaaaaccuucugcuaggcgucggccucgccauggcaaccacacugcaguugccggaggauauugaacaaauggcuaaugggauagcccugggauuaauggcccucaagcugaucacucaguuugagaccuaccagcuuuggacggcucugauuuccuugacauguucaaacaccaucuucacucucaccguggcauggcggacagccacucugauucuagcggguguuagucugcuuccugugugccagagcucguccaugcguaaaaccgacuggcucccaauggcugucgccgcaaugggcguacccccucugcccuuguuuaucuucucucugaaggauacguuaaagagaaggagcuggccacucaaugagggggugauggccguuggacuggugucaauacuugcuaguucccuguugcgcaacgacgucccuauggcaggcccccucguggccggugggcugcuaaucgcguguuauguaauuacaggaaccucugcugaucugacuguggaaaaagccgcagacaucacaugggaggaagaggccgaacaaaccggcgucagccauaaccuuaugauuacuguugacgaugacggcacaaugcggaucaaggaugacgagaccgagaauauacucacggugcuguugaaaacugcuuuacugauuguguccgggaucuuuccauacucaaucccggccacccuccuggucuggcacacauggcagaagcagacccagagaagcggagugcuuugggauguuccuagucccccagaaacacaaaaagcagagcuggaagaggguguauacaggauuaagcagcagggcauauucgggaaaacucaggugggagucggcgugcaaaaggaggguguuuuucacaccauguggcaugugacgcgaggggcugucuugacauauaacggaaagcgccuagaacccaauugggccucugugaaaaaggaccugaucuccuacggcggcggguggcggcucagcacucaguggcagaaaggagaggaaguacaagucauugcgguggagccugguaagaacccaaaaaauuuccagaccaugcccggcacauuccagaccacuaccggggaaaucggagccauugcacuggauuuuaagccuggcacaucggguucaccgaucauaaacagagaggggaagguugugggacuuuauggcaauggcgucgugacgaaaaacgggggauacguuucugguaucgcucagacuaaugccgagccagacggccccaccccugaauuagaggaagagauguucaagaaaaggaaccugacaauuauggaucuccacccagggaguggaaagacccguaaauauuugcccgcuaucgugcgcgaagcaauuaagcggagacugaggacucucauccuggccccuacacgagucguggccgcugagauggaggaagcgcuuaagggccugccgauacgguaccaaaccacggcaacuaaauccgagcauacaggucgcgaaauuguagacuugaugugccacgccaccuuuaccaugagacuacugagccccgugaggguuccaaauuauaaccucaucaucauggaugaggcucauuucacugacccugccucuauugcagcccggggguacaucagcacacgagucggaaugggcgaagcugcggccauauuuaugaccgcaacacccccaggcacugcugaugccuucccucaguccaaugcacccauucaggacgaggagagagacaucccagaacgcucauggaacagugggaaugaguggauuacggauuuugccggaaagaccgugugguucgugccgagcaucaaagcugguaacgacauagccaacuguuuaaggaagaauggcaaaaaggucauucagcugucucguaagacauuugauacugaauaccaaaaaaccaagcuuaacgacugggauuucguagugacaaccgacaucuccgagaugggggcgaauuuuaaagcagaucggguuaucgacccuagaaggugccugaagcccgugauucucacugauggaccagagcgcgucaucuuggccggccccaugccugugacggcugccucagcugcacagcgaagaggucggguugggaggaacccacagaaagaaaaugaccaguauauuuucaccggccaaccccugaacaaugaugaggaccacgcccacuggacagaagcuaagaugcuccuggacaacauaaauacuccugagggaaucauuccggcccuuuucgaaccagagcgcgagaagagugcagcgaucgauggcgaauaccgucuaaaaggggagagcagaaagaccuuuguggaacugaugcggaggggagacuugcccgucugguuagcccauaaaguggcuuccgaggguaucaaguauacagaucgcaaauggugcuucgacggccagcgaaacaaucagauucuggaagagaacauggauguagagauauggaccaaggaaggggagaaaaagaagcucagaccucgguggcuggacgccaggacuuacucugauccccuugcacugaaagaauuuaaggacuucgcugccggacgcaaaucgaucgcacucgauuuggugacagagauuggcagaguuccaagccaccuggcccauaggacgcggaaugcucuagacaaccuggucaugcuccacaccucagaacacggugggcgugcguaucgccaugccguggaggagcuuccugaaacuauggagacacuguuauugcugggccucaugauccugcuuaccggaggcgcaaugcuguuucucauuuccgggaagggaaucgguaaaaccaguauaggcuugaucugugugauugcuucuagcgggaugcuguggauggccgaaauccccuuacaguggauugccuccgcaaucguccuagaguucuuuaugaugguucugcucauaccagagccugaaaagcaacgaacaccgcaggauaaucagcuugcuuacgugguaauuggaauccugacuuuggccgcgauuaucgcugccaacgagaugggccugcucgaaacgaccaagagagaccuggguaugucaaaagagcccgggguggucucuccaacaagcuaucuugauguggaccuccacccugcaagugccuggacucuguacgcuguugcaaccacagugauaacccccauguugaggcauacuaucgaaaauuccacggccaacgucagccuggcggcuauugccaaccaagcaguaguguuaaugggccuagacaagggauggccaaucucuaaaauggaucugggcguuccucuccuugcccuggggugcuacucacaggugaaucccuugacacugaccgcugccguccuccugcuuauuacucacuaugcaaucauaggaccgggcuuacaggcuaaggccacccgggaggcgcagaaacgcacagccgcagguauuaugaagaacccaacuguggacgggaucaugaccaucgaucuggacccugucauuuacgauuccaaguucgagaaacaacucggacaggugauguugcugguucuaugugcugugcagcugcuccuuaugagaacaaguugggcccugugcgaagcauugacgcuggcuaccggccccaucacuacacucugggaggguagcccaggcaaguuuuggaauaccacuauagccguaucgauggccaacauuuucagggggucuuaucuggcgggagcuggcuuagcauuuuccaucaugaaaagcguggggacaggaaagcggggcaccgguucacagggggaaacgcuuggagagaaauggaagaagaaacugaaucaacucagucgaaaggaauucgaccuauacaaaaagucuggcauuaccgaggucgauagaacagaggccaaagaaggucugaagcgcggcgagaucacucaucacgcuguuuccagggggagcgccaaauugcagugguuuguggaacggaacauggucauacccgagggacgugugaucgaccugggcugugggagaggaggcuggucauauuacugcgcaggucucaagaagguaaccgaagugaggggguauacaaaaggaggcccuggccacgaggagccgguucccaugaguacuuacggguggaauauugugaagcuuaugagcggaaaagaugucuucuaccugccaccugaaaagugugacaccuugcugugcgauaucggugaguccucucccagcccuacaguggaagagucccgcaccauucggguccucaaaaugguggagccaugguuaaagaacaaucaguucuguaucaagguucugaaccccuauaugccuacuguaauugaacaucuugagcgacugcagagaaaacacggcgggaugcuagugaggaauccacucucacgcaacucuacgcaugaaauguacuggaucaguaauggaacaggcaacauagucgccucggugaauaugguuagccggcuguugcugaacagauuuaccaugacucaccguaggcccaccauugagaaggacguggaucucggugcugggacacggcacgucaacgcggaaccggagacgccuaauauggacgugaucggagagcgcaucaaacgaauuaaggaagagcauaacuccaccuggcacuaugacgaugaaaauccauacaaaacuugggccuaucauggcucuuacgagguaaaggcaacaggcucagcuagcuccaugauaaacggggugguuaagcuucugaccaaacccugggacgucgugccuauggugacucaaauggccaugacagauaccacaccauucggacagcagagagucuuuaaggaaaaaguugacacuaggaccccccggaguaugccggguacgcgcagagugaugggcaucaccgcagagugguuauggaggacacuggggcgaaauaagaaaccucgguugugcacucgugaggaauucaccaagaagguaagaacaaacgccgcuaugggagccguguuuacugaggaaaaucaaugggauucugcgaaagcagccgucgaggacgaagauuucuggaagcucguggaccgcgagagggagcugcacaaacuaggcaagugugguagcugcguuuauaacaugauggggaaacgggaaaagaaacuuggagaguuuggcaaggcuaagggcucaagagccauuugguacauguggcugggggcacgcuaccucgaauucgaggcucugggauuuuugaaugaggaucauugguucuccagggaaaacaguuauagcgguguggagggcgaagggcugcacaaacucggauacauccuucgagacauuucuaagauccccggcggugccauguaugcugaugacaccgccgggugggacacgcggauaacagaggaugaccugcacaaugaagagaaaaucacccagcagauggauccagagcauagacaguuagcaaacgcgauuuuuaagcugacuuaccaaaauaaagucgugaagguacagaggccuacacccaccggaacuguuauggacaucauuucccgcaaggaucagcguggcucaggccagguggggaccuauggauugaacacauucacgaauauggaagcccaacucauccggcagauggagggugaaggcguccugagcaaagcugaccuagagaacccacaccuucccgaaaagaaaauaacccaguggcuggagacuaaggggguggagagacucaaaaggauggccauuucgggagaugacugcguggucaagccuaucgaugaccgcuuugcaaacgcucuguuggccuuaaaugauaugggcaagguucgaaaagacaucccacaguggcaaccgucuaaggguuggcaugauuggcagcaggugcccuucuguagucaccacuuccaugaacugauuaugaaagacgggcggaagcucguagugccuugcagaccacaggacgagcuuauaggaagggcacgcaucucccaaggcgccggcuggagccugagagaaacagcgugucuagggaaagcuuacgcccagauguggucacugauguauuuucaccggagggaucuccguuuggcauccaacgccauuugcucugcuguccccgugcauuggguuccuaccagccgaacuacauggaguauccacgcccaucaccaguggaugaccacggaggacaugcugacaguguggaaucgcgucuggauugaagauaacccauggauggaggacaagacccccgugacuaccugggaggauguaccuuaccuuggaaagagagaagaccaauggugugguucccugaucggccucacaagccgggcaacuugggcucagaauauaccgaccgccauccagcagguuaggucuuuaauugggaacgaggaauuccuggauuacaugccaucaaugaaacgcuuuagaaaggaggaggaaagugagggagcgaucugguga

SEQ ID NO: 15360 - RNA, 9873 nt, Artificial Sequence
  derived and/or modified CDS sequence (opt3) from DENV-3__KJ189279__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggugacccucccagaauauggaacucuuggccuggagugcucuccgcgaaccgguuuggacuucaaugagaugauccuacugacaaugaaaaacaaggccuggaugguacauagacagugguuuuucgaucucccccugccuuggaccagcggggcgacuacagaaacgccaaccuggaauaggaaagagcuucugguuacuuuuaagaacgcccacgcaaaaaagcaagaaguggucguguugggcucccaggagggagcuaugcacacagcccucaccggcgcuacagaaauccagaauucagggggaacuaguauuuucgccggucaucugaagugucgguuaaaaauggacaagcuggagcuaaaaggcaugagcuacgcaaugugcaccaacacguuuguccucaagaaagaggugucugaaacccagcacgggacaauacugaucaagguugaguacaagggagaagaugcccccuguaaaauuccuuucuccacugaggacggccaugguaaggcucacaacgggcgucuuaucaccgcgaauccagugguaacaaaaaaggaggaacccgucaacauagaggcagaaccgccuuucggcgagucaaauauugugaucggaaucggcgauaacgccuugaaaauuaauugguauaagaaggggagcaguaucggaaaaauguuugaagcuacugcccgcggugcaagaaggauggccauucugggcgacaccgcuugggauuucgggucuguuggaggcgugcucaacucccuggguaagaugguccaucaaauauuugggagcgccuacacggcacuuuucucgggcgugucuuggguaaugaaaaucggaauuggcgugcuguugacauggaucgggcucaauuccaagaacaccucaaugaguuuuagcugcaucgcgauuggaauaaucacucuguauuuaggcgcuguuguccaggccgacauggguugugugauuaauuggaaagggaaggagcugaagugcggauccggcaucuucgugacaaacgagguccacaccuggacugaacaguacaaauuucaggcagauucucccaagcggcuagccaccgcuauugccggugcaugggagaauggcguuugugggauccgaagcacaacgcgcauggaaaaccuccuguggaaacaaauagcuaaugagcuuaacuauaucuugugggaaaauaacauuaagcugaccguggugguaggagacaucauuggcguccucgagcaggggaaaagaacucugacaccacagccuauggaguuaaaguacucauggaaaaccuggggaaaggccaagaucgugacagcggaaacucagaacaguuccuucauaauugauggccccaauaccccagagugccccagcgccucuagggcuuggaacguuugggaaguggaggacuaugguuuuggggucuucacgacaaauaucuggcugcggcuucgcgaaguguacacccaauugugugaccacagacucaugucagcagccauuaaagaugagagggcuguucaugccgacaugggauacuggaucgagagucagaagaacggcagcuggaaacuggaaaaggcaucccuaauagaggugaaaacuugcaccuggccuaagucucacacacuguggucgaaugguguacucgaaagcgauaugaucauuccaaagucccuggcgggcccgaucucacagcauaaccaccgucccggguaucacacucagaccgccggaccuuggcaucuuggcaaauuggagcuggacuuuaauuacugcgaggggacaacggucgugauuaccgaaaacuguggaacucggggcccaaguuuacgaacaaccacugugucugguaagcucauccacgaguggugcuguagaagcugcacacugcccccucuuagguauaugggggaagauggauguugguacggcauggagauacgcccaauuuccgaaaaagaggagaauauggucaagucacugguuagcgcugguucuggcaaaguggacaacuucaccauggggguauugugccucgccauccuguuugaagaggugaugcggggaaaguucggcaagaaacauaugaucgcaggggucuucuuuacguucgugcuacugcucuccggacaaauuacuuggagagauauggcucacacccugaucaugauuggcaguaaugccagcgacaggauggguauggggguuacauaucuugcauugauagccaccuuuaagauccagcccuuccuggcuuuaggauuuuuccuccgcaaacugacuucucgagaaaaccuucugcuaggcgugggccucgcgauggccacaacccugcaguugccggaggauauugaacaaauggcaaaugggaucgcucugggauuaauggcccucaagcugauuacacaguuugagacuuaccagcuuuggaccgcccugaucuccuugacguguucaaacacaauauucacccucacugucgcuuggcggaccgcaacacugauccuagccggugugagucugcuuccuguuugccagagcucguccaugcguaaaacugacuggcucccaauggcgguggcugccaugggcguccccccucugcccuuguuuauuuucucucugaaggauaccuuaaagagaaggagcuggccacucaaugaggggguaauggcagugggacugguuucaauccuugccaguucccuguugcgcaacgacgugccuauggcuggcccccucgucgcaggugggcugcuaauugccuguuaugugaucacgggaacaucugcggaucugaccguagaaaaagcugccgacauaacuugggaggaagaggcagaacaaacaggcgugagccauaaccuuaugauuaccgucgacgaugacggcacuaugcggaucaaggaugacgagacagagaauauccucaccguucuguugaaaacggccuuacugauuguguccgggauauuuccauacucaaucccggcuacucuccugguguggcacaccuggcagaagcagacacagagaagcggaguccuuugggaugugccuagucccccagaaacccaaaaagccgagcuggaagaggguguuuacaggauuaagcagcagggcaucuucgggaaaacacagguaggagugggcguccaaaaggaggguguguuucacacuauguggcauguuacccgaggggcaguguugacguauaacggaaagcgccuagaacccaauugggcuucugucaaaaaggaccugauuuccuacggcggcggguggcggcucagcacacaguggcagaaaggagaggaagugcaaguaaucgccgucgagccugguaagaacccaaaaaauuuccagacuaugcccggcaccuuccagacaaccacuggggaaauaggagcgaucgcccuggauuuuaagccuggcaccucggguucaccgauuaucaacagagaggggaaggugguuggacuuuauggcaauggcguggucacaaaaaacgggggauacgugucugguauugcacagacgaaugcugagccagacggccccacuccugaauuagaggaagagauguucaagaaaaggaaccugaccaucauggaucuccacccagggaguggaaagacacguaaauauuugcccgccauaguucgcgaagcuauuaagcggagacugaggacccucauccuggcaccuacucgaguggucgccgccgagauggaggaagcucuuaagggccugccgauccgguaccaaacaaccgcgacgaaauccgagcauacuggucgcgaaauuguggacuugaugugccacgcaacauuuaccaugagacuacugagccccguaagggugccaaauuauaaccucaucauaauggaugaggcccauuucaccgacccugcuucuauugccgcacggggguacaucagcacucgaguuggaaugggcgaagccgcugcgauuuuuaugacagccacccccccaggcacagcagaugcuuucccucaguccaaugcccccauccaggacgaggagagagacauaccagaacgcucauggaacagugggaaugaguggauuacugauuuugcaggaaagacggucugguucgugccgagcaucaaagccgguaacgacaucgcuaacuguuuaaggaagaauggcaaaaaggugauucagcugucucguaagaccuuugauacagaauaccaaaaaacuaagcuuaacgacugggauuucgucguaaccacagacaucuccgagaugggggccaauuuuaaagcggaucgggugauugacccuagaaggugccugaagcccguuauacucaccgauggaccagagcgcgugaucuuggcaggccccaugccugucacugccgcuucagccgcucagcgaagaggucggguggggaggaacccacagaaagaaaaugaccaguauauuuucacgggccaaccccugaacaaugaugaggaccacgcacacuggaccgaagccaagaugcuccuggacaacaucaauacaccugagggaaucauuccggcucuuuucgaaccagagcgcgagaagagugccgcaauagauggcgaauaccgucuaaaaggggagagcagaaagacuuuuguugaacugaugcggaggggagacuugcccgugugguuagcgcauaaagucgccuccgaggguaucaaguauaccgaucgcaaauggugcuucgacggccagcgaaacaaucagauucuggaagagaacauggauguggagaucuggacaaaggaaggggagaaaaagaagcucagaccucgguggcuggacgcuaggaccuacucugauccccuugcccugaaagaauuuaaggacuucgcagcuggacgcaaaucgauugcccucgauuugguaacugagaucggcagagugccaagccaccuggcacauaggacacggaaugcccuagacaaccugguuaugcuccacacgucagaacacggugggcgugcuuaucgccaugcggucgaggagcuuccugaaaccauggagacucuguuauugcugggccucaugauacugcuuacaggaggcgccaugcuguuucucaucuccgggaagggaauugguaaaaccaguaucggcuugauuugugugaucgcaucuagcgggaugcuguggauggcugaaauacccuuacaguggauugccuccgccaucgugcuagaguucuuuaugaugguccugcucauuccagagccugaaaagcaacgaaccccgcaggauaaucagcuugcauacguugugaucggaauacugacauuggcugccaucauugcggcuaacgagaugggccugcucgaaacuacgaagagagaccuggguaugucaaaagagcccgggguagugucuccaaccagcuaucuugaugucgaccuccacccugccagugcauggacacuguacgccguggcuacuaccguuaucacacccauguugaggcauaccauugaaaauuccacugcaaacgugagccuggccgcgaucgcuaaccaagccgucguauuaaugggccuagacaagggauggccaauaucuaaaauggaucugggcgugccucuccuugcacuggggugcuacucacagguuaaucccuugacgcugacagccgcugugcuccugcuuauuacccacuaugccaucaucggaccgggcuuacaggcaaaggcuacucgggaggcccagaaacgcaccgcggccgguauuaugaagaacccaacagucgacgggaucaugacuauagaucuggacccugugauuuacgauuccaaguucgagaaacaacucggacaggucauguugcuggugcuaugugcaguucagcugcuccuuaugagaaccaguugggcucugugcgaagccuugacacuggcaacgggccccaucaccacucucugggaggguagcccaggcaaguuuuggaauacaaccauugcugugucgauggccaacaucuucagggggucuuaucuggccggagcgggcuuagcuuuuuccauaaugaaaagcguagggacuggaaagcggggcacagguucacagggggaaacccuuggagagaaauggaagaagaaacugaaucaacucagucgaaaggaauucgaccuauacaaaaagucuggcaucacggagguggauagaaccgaggcaaaagaaggucugaagcgcggcgagauuacacaucacgccgucuccagggggagcgcuaaauugcagugguuuguugaacggaacauggugauccccgagggacgugucauugaccugggcugugggagaggaggcuggucauauuacugcgccggucucaagaaggugacugaaguaaggggguauaccaaaggaggcccuggccacgaggagccggugcccaugaguacauacggguggaauaucguuaagcuuaugagcggaaaagauguguucuaccugccaccugaaaagugugacacuuugcugugcgauauuggugaguccucucccagcccuaccgucgaagagucccgcacaauccgggugcucaaaauggucgagccaugguuaaagaacaaucaguucuguauaaaggugcugaaccccuauaugccuaccguuauugaacaucuugagcgacugcagagaaaacacggcgggaugcuaguaaggaauccacucucacgcaacucuacucaugaaauguacuggaucaguaauggaacgggcaacaucguggcaucggucaauauggugagccggcuguugcugaacagauuuacaaugacccaccguaggcccacuauugagaaggacguugaucucggugccgggacccggcacgugaacgcugaaccggagacaccuaauauggacgucauaggagagcgcaucaaacgaauuaaggaagagcauaacuccacguggcacuaugacgaugaaaauccauacaaaaccugggcguaucauggcucuuacgaggugaaggccacuggcucagcaagcuccaugaucaacgggguagugaagcuucugacaaaacccugggacguugucccuauggugacccaaauggcuaugacugauacaaccccauucggacagcagagaguguuuaaggaaaaagucgacacaaggacuccccggaguaugccggguacccgcagaguuaugggcauuacggccgagugguuauggaggacccuggggcgaaauaagaaaccucgguugugcacacgugaggaauucacuaagaaggugagaaccaacgcagccaugggagcuguauuuacagaggaaaaucaaugggauucugccaaagcggcaguggaggacgaagauuucuggaagcucgucgaccgcgagagggagcugcacaaacuaggcaagugugguagcugcguguauaacaugauggggaaacgggaaaagaaacuuggagaguuuggcaaggccaagggcucaagagcuaucugguacauguggcugggggcccgcuaccucgaauucgaggcacugggauuuuugaaugaggaucauugguucuccagggaaaacaguuauagcgguguugagggcgaagggcugcacaaacucggauacauacuucgagacaucucuaagauucccggcggugcuauguaugccgaugacacugcugggugggacacccggaucacggaggaugaccugcacaaugaagagaaaauuacacagcagauggauccagagcauagacaguuagccaacgcaaucuuuaagcugaccuaccaaaauaaaguggucaaggugcagaggccuacucccacaggaaccguaauggacauaauuucccgcaaggaucagcguggcucaggccagguugggacuuauggauugaacaccuucacaaauauggaagcgcaacucauccggcagauggagggugaaggcgugcugagcaaagccgaccuagagaacccacaccuucccgaaaagaaaaucacgcaguggcuggagaccaagggggucgagagacucaaaaggauggcuauuucgggagaugacugcguggugaagccuauagaugaccgcuuugccaacgcacuguuggcuuuaaaugauaugggcaagguccgaaaagacaucccacaguggcaaccgucuaaggguuggcaugauuggcagcagguucccuucuguagucaccacuuccaugaacugauuaugaaagacgggcggaagcucgugguaccuugcagaccacaggacgagcuuaucggaagggcccgcauuucccaaggcgcaggcuggagccugagagaaacugccugucuagggaaagcguacgcucagauguggucacugauguauuuucaccggagggaucuccguuuggccuccaacgcaaucugcucugccgugcccguccauugggugccuacaagccgaaccacuuggaguauacacgcucaucaccaguggaugacaaccgaggacaugcugacgguuuggaaucgcguguggaucgaagauaacccauggauggaggacaagacacccgucaccacuugggaggaugugccuuaccuuggaaagagagaagaccaauggugugguucccugauuggccucaccagccgggccacaugggcacagaauaucccgacugcuauucagcagguaaggucuuuaaucgggaacgaggaauuccuggauuacaugccaucaaugaaacgcuuuagaaaggaggaggaaagugagggagccauuugguga

SEQ ID NO: 15361 - RNA, 9873 nt, Artificial Sequence
  derived and/or modified CDS sequence (opt3) from DENV-3__KJ189280__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccacccucccagaauauggaacucuuggccuggagugcucuccgcgaaccgguuuggacuucaaugagaugauccuacugacaaugaaaaacaaggcguggauggugcauagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcacacagcucucaccggcgccacagaaauccagaauucagggggaacuaguauuuucgcaggucaucugaagugucgguuaaaaauggacaagcuggagcuaaaaggcaugagcuacgccaugugcaccaacacguuugugcucaagaaagaggucucugaaacccagcacgggacaauacugaucaagguggaguacaagggagaagaugcucccuguaaaauuccuuucuccacugaggacggccaugguaaggcgcacaacgggcgucuuaucaccgcaaauccaguugugacaaaaaaggaggaacccguaaacauagaggccgaaccgccuuucggcgagucaaauauugucaucggaaucggcgauaacgcuuugaaaauuaauugguauaagaaggggagcaguaucggaaaaauguuugaagccacugcacgcggugccagaaggauggcuauucugggcgacaccgccugggauuucgggucugugggaggcguucucaacucccuggguaagauggugcaucaaauauuugggagcgcauacacggcgcuuuucucgggcgucucuugggugaugaaaaucggaauuggcguacuguugacauggaucgggcucaauuccaagaacaccucaaugaguuuuagcugcaucgcuauuggaauaaucacucuguauuuaggcgccgugguucaggcagacauggguugugucauuaauuggaaagggaaggagcugaagugcggauccggcaucuucgugacaaacgaggugcacaccuggacugaacaguacaaauuucaggccgauucucccaagcggcuagcuaccgccauugcaggugcuugggagaauggcgucugugggauccgaagcacaacgcgcauggaaaaccuccuguggaaacaaauagccaaugagcuuaacuauaucuugugggaaaauaacauuaagcugaccguuguggugggagacaucauuggcguacucgagcaggggaaaagaacucugacaccacagccuauggaguuaaaguacucauggaaaaccuggggaaaggcgaagaucgucacagccgaaacucagaacaguuccuucauaauugauggccccaauaccccagagugccccagcgcuucuagggcauggaacgugugggaaguugaggacuaugguuuugggguguucacgacaaauaucuggcugcggcuucgcgaagucuacacccaauugugugaccacagacucaugucagccgcugugaaagaugagagggccguucaugcagacaugggauacuggauugagagucagaagaacggcagcuggaaacuggaaaaggcgucccuaaucgaggugaaaacuugcaccuggccuaagucucacacacuguggucgaaugguguacucgaaagcgauaugauaaucccaaagucccuggccggcccgauuucacagcauaaccaccgucccggguaucacacucagaccgcuggaccuuggcaucuuggcaaauuggagcuggacuuuaauuacugcgaggggacaacggucgugaucaccgaaaacuguggaacucggggcccaaguuuacgaacaaccacugugucugguaagcucauucacgaguggugcuguagaagcugcacacugcccccucuuagguauaugggggaagauggauguugguacggcauggagauccgcccaauauccgaaaaagaggagaauauggucaagucacugguuagcgccgguucuggcaaaguggacaacuucaccauggggguauugugccucgcaauucuguuugaagaggugaugcggggaaaguucggcaagaaacauaugaucgcuggggucuucuuuacguucgugcuacugcucuccggacaaaucacuuggagagauauggcccacacccugauuaugaucggcaguaaugcaagcgacaggauggguauggggguuacauaucuugccuugauugcuaccuuuaagauacagcccuuccuggcguuaggauuuuuccuccgcaaacugacuucucgagaaaaccuucugcuaggcgugggccucgccauggcaacaacccugcaguugccggaggauaucgaacaaauggcuaaugggauugcccugggauuaauggcccucaagcugaucacacaguuugagacuuaccagcuuuggaccgcucugauuuccuugacguguucaaacacaaucuucacccucacugucgcauggcggaccgccacacugauacuagcgggugugagucugcuuccuguuugccagagcucguccaugcguaaaacugacuggcucccaauggcuguggccgcaaugggcguccccccucugcccuuguuuaucuucucucugaaggauaccuuaaagagaaggagcuggccacucaaugaggggguaauggccgugggacugguuucaauucuugcuaguucccuguugcgcaacgacgugccuauggcaggcccccucgucgccggugggcugcuaaucgcguguuaugugauuacgggaacaucugcugaucugaccguagaaaaagccgcagacaucacuugggaggaagaggccgaacaaacaggcgugagccauaaccuuaugauaaccgucgacgaugacggcacuaugcggauuaaggaugacgagacagagaauauccucaccguucuguugaaaacggcuuuacugaucguguccgggauuuuuccauacucaauaccggccacucuccugguguggcacaccuggcagaagcagacacagagaagcggaguccuuugggaugugccuagucccccagaaacccaaaaagcagagcuggaagaggguguuuacaggaucaagcagcagggcauuuucgggaaaacacagguaggagugggcguccaaaaggaggguguguuucacacuauguggcauguuacccgaggggcuguguugacguauaacggaaagcgccuagaacccaauugggccucugucaaaaaggaccugaucuccuacggcggcggguggcggcucagcacacaguggcagaaaggagaggaagugcaaguaauugcggucgagccugguaagaacccaaaaaauuuccagacuaugcccggcaccuuccagacaaccacuggggaaaucggagccauagcacuggauuuuaagccuggcaccucggguucaccgaucauuaacagagaggggaaggugguuggacuuuauggcaauggcguggucacaaaaaacgggggauacgugucugguaucgcucagacgaaugccgagccagacggccccacuccugaauuagaggaagagauguucaagaaaaggaaccugaccauuauggaucuccacccagggaguggaaagacacguaaauauuugcccgcuaucguucgcgaagcaauaaagcggagacugaggacccucauucuggccccuacucgaguggucgccgcugagauggaggaagcgcuuaagggccugccgauccgguaccaaacaaccgcaacgaaauccgagcauacuggucgcgaaaucguggacuugaugugccacgccacauuuaccaugagacuacugagccccguaagggugccaaauuauaaccucauuaucauggaugaggcucauuucaccgacccugccucuauagcagcccggggguacauuagcacucgaguuggaaugggcgaagcugcggccaucuuuaugacagcaacccccccaggcacagcugaugccuucccucaguccaaugcacccauucaggacgaggagagagacaucccagaacgcucauggaacagugggaaugaguggauaacugauuuugccggaaagacggucugguucgugccgagcauuaaagcugguaacgacaucgccaacuguuuaaggaagaauggcaaaaaggugauccagcugucucguaagaccuuugauacagaauaccaaaaaacuaagcuuaacgacugggauuucgucguaaccacagacauuuccgagaugggggcgaauuuuaaagcagaucgggugaucgacccuagaaggugccugaagcccguuauucucaccgauggaccagagcgcgugauauuggccggccccaugccugucacugcugccucagcugcacagcgaagaggucggguggggaggaacccacagaaagaaaaugaccaguauaucuucacgggccaaccccugaacaaugaugaggaccacgcccacuggaccgaagcuaagaugcuccuggacaacauuaauacaccugagggaaucaucccggcccuuuucgaaccagagcgcgagaagagugcagcgauugauggcgaauaccgucuaaaaggggagagcagaaagacuuuuguugaacugaugcggaggggagacuugcccgugugguuagcccauaaagucuccucugaggguauaaaguauaccgaucgcaaauggugcuucgacggccagcgaaacaaucagauccuggaagagaacauggauguggagauuuggacaaaggaaggggagaaaaagaagcucagaccucgguggcuggacgcuaggaccuacucggauccccuugcccugaaagaauuuaaggacuucgcagcuggacgcaaaagcaucgcccucgauuugguaacugagauuggcagagugccaucacaccuggcacauaggacacggaaugcccuagacaaccugguuaugcuccacacguccgaacacggugggcgugcuuaucgccaugcggucgaggagcuuccugaaaccauggagacucuguuauugcugggccucaugauccugcuuacaggaggcgccaugcuguuucucauaagugggaagggaaucgguaaaaccucuauuggcuugaucugugugauugcaagcuccgggaugcuguggauggcugaaauccccuuacaguggauagccucagccauugugcuagaguucuuuaugaugguccugcucaucccagagccugaaaagcaacgaaccccgcaggauaaucagcuugcauacguugugauuggaauccugacauuggcugccauaaucgcggcuaacgagaugggccugcucgaaacuacgaagagagaccuggguaugucuaaagagcccgggguagugagcccaaccaguuaucuugaugucgaccuccacccugccuccgcauggacacuguacgccguggcuacuaccguuauuacacccauguugaggcauaccaucgaaaauagcacugcaaacgugucucuggccgcgauugcuaaccaagccgucguauuaaugggccuagacaagggauggccaaucucaaaaauggaucugggcgugccucuccuugcacuggggugcuacucccagguuaaucccuugacgcugacagccgcugugcuccugcuuauaacccacuaugccauuaucggaccgggcuuacaggcaaaggcuacucgggaggcccagaaacgcaccgcggccgguaucaugaagaacccaacagucgacgggauuaugacuaucgaucuggacccugugauauacgauaguaaguucgagaaacaacucggacaggucauguugcuggugcuaugugcaguucagcugcuccuuaugagaaccagcugggcucugugcgaagccuugacacuggcaacgggccccauuaccacucucugggaggguucgccaggcaaguuuuggaauacaaccaucgcugugucuauggccaacauuuucaggggguccuaucuggccggagcgggcuuagcuuuuagcaucaugaaaucaguagggacuggaaagcggggcacagguagucagggggaaacccuuggagagaaauggaagaagaaacugaaucaacucucucgaaaggaauucgaccuauacaaaaaguccggcauaacggagguggauagaaccgaggcaaaagaaggucugaagcgcggcgagaucacacaucacgccgucagcagggggucagcuaaauugcagugguuuguugaacggaacauggugauucccgagggacgugucaucgaccugggcugugggagaggaggcuggaguuauuacugcgccggucucaagaaggugacugaaguaaggggguauaccaaaggaggcccuggccacgaggagccggugcccaugagcacauacggguggaauauuguuaagcuuauguccggaaaagauguguucuaccugccaccugaaaagugugacacuuugcugugcgauaucggugagucuagccccuccccuaccgucgaagagucacgcacaauucgggugcucaaaauggucgagccaugguuaaagaacaaucaguucuguaucaaggugcugaaccccuauaugccuaccguuauagaacaucuugagcgacugcagagaaaacacggcgggaugcuaguaaggaauccacucucucgcaacaguacucaugaaauguacuggauuucgaauggaacgggcaacaucguggcaagcgucaauauggugucccggcuguugcugaacagauuuacaaugacccaccguaggcccacuaucgagaaggacguugaucucggugccgggacccggcacgugaacgcugaaccggagacaccuaauauggacgucauuggagagcgcauaaaacgaaucaaggaagagcauaacucuacguggcacuaugacgaugaaaauccauacaaaaccugggcguaucauggcucauacgaggugaaggccacuggcagcgcauccaguaugauuaacgggguagugaagcuucugacaaaacccugggacguugucccuauggugacccaaauggcuaugacugauacaaccccauucggacagcagagaguguuuaaggaaaaagucgacacaaggacuccccggucuaugccggguacccgcagaguuaugggcaucacggccgagugguuauggaggacccuggggcgaaauaagaaaccucgguugugcacacgugaggaauucacuaagaaggugagaaccaacgcagccaugggagcuguauuuacagaggaaaaucaaugggauagcgccaaagcggcaguggaggacgaagauuucuggaagcucgucgaccgcgagagggagcugcacaaacuaggcaagugugguucaugcguguauaacaugauggggaaacgggaaaagaaacuuggagaguuuggcaaggccaagggcuccagagcuauuugguacauguggcugggggcccgcuaccucgaauucgaggcacugggauuuuugaaugaggaucauugguucaguagggaaaacagcuauucugguguugagggcgaagggcugcacaaacucggauacauccuucgagacauauccaagauccccggcggugcuauguaugccgaugacacugcugggugggacacccggauuacggaggaugaccugcacaaugaagagaaaaucacacagcagauggauccagagcauagacaguuagccaacgcaauuuuuaagcugaccuaccaaaauaaaguggucaaggugcagaggccuacucccacaggaaccguaauggacaucauaucacgcaaggaucagcguggcagcggccagguugggacuuauggauugaacaccuucacaaauauggaagcgcaacucauucggcagauggagggugaaggcgugcugucgaaagccgaccuagagaacccacaccuucccgaaaagaaaaucacgcaguggcuggagaccaagggggucgagagacucaaaaggauggcuaucucuggagaugacugcguggugaagccuauugaugaccgcuuugccaacgcacuguuggcuuuaaaugauaugggcaagguccgaaaagacauaccacaguggcaaccgaguaaggguuggcaugauuggcagcagguucccuucuguucccaccacuuccaugaacugaucaugaaagacgggcggaagcucgugguaccuugcagaccacaggacgagcuuauuggaagggcccgcaucagccaaggcgcaggcuggucacugagagaaacugccugucuagggaaagcguacgcucagauguggucccugauguauuuucaccggagggaucuccguuuggccucuaacgcaauuugcagcgccgugcccguccauugggugccuacaagucgaaccacuugguccauccacgcucaucaccaguggaugacaaccgaggacaugcugacgguuuggaaucgcguguggauagaagauaacccauggauggaggacaagacacccgucaccacuugggaggaugugccuuaccuuggaaagagagaagaccaauggugugguagccugaucggccucaccucucgggccacaugggcacagaauauuccgacugcuauccagcagguaaggucauuaauugggaacgaggaauuccuggauuacaugccaaguaugaaacgcuuuagaaaggaggaggaauccgagggagccaucugguga

SEQ ID NO: 15362 - RNA, 9873 nt, Artificial Sequence
  derived and/or modified CDS sequence (opt3) from DENV-3__KJ189281__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccacccucccagaauauggaacucuuggccuggagugcucuccgcgaaccgguuuggacuucaaugagaugauccuacugacaaugaaaaacaaggcguggauggugcauagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcacacagcucucaccggcgccacagaaauccagaauucagggggaacuaguauuuucgcaggucaucugaagugucgguuaaaaauggacaagcuggagcuaaaaggcaugagcuacgccaugugcaccaacacguuugugcucaagaaagaggucucugaaacccagcacgggacaauacugaucaagguggaguacaagggagaagaugcucccuguaaaauuccuuucuccacugaggacggccaugguaaggcgcacaacgggcgucuuaucaccgcaaauccaguugugacaaaaaaggaggaacccguaaacauagaggccgaaccgccuuucggcgagucaaauauugucaucggaaucggcgauaacgcuuugaaaauuaauugguauaagaaggggagcaguaucggaaaaauguuugaagccacugcacgcggugccagaaggauggcuauucugggcgacaccgccugggauuucgggucugugggaggcguucucaacucccuggguaagauggugcaucaaauauuugggagcgcauacacggcgcuuuucucgggcgucucuugggugaugaaaaucggaauuggcguacuguugacauggaucgggcucaauuccaagaacaccucaaugaguuuuagcugcaucgcuauuggaauaaucacucuguauuuaggcgccgugguucaggcagacauggguugugucauuaauuggaaagggaaggagcugaagugcggauccggcaucuucgugacaaacgaggugcacaccuggacugaacaguacaaauuucaggccgauucucccaagcggcuagcuaccgccauugcaggugcuugggagaauggcgucugugggauccgaagcacaacgcgcauggaaaaccuccuguggaaacaaauagccaaugagcuuaacuauaucuugugggaaaauaacauuaagcugaccguuguggugggagacaucauuggcguacucgagcaggggaaaagaacucugacaccacagccuauggaguuaaaguacucauggaaaaccuggggaaaggcgaagaucgucacagccgaaacucagaacaguuccuucauaauugauggccccaauaccccagagugccccagcgcuucuagggcauggaacgugugggaaguugaggacuaugguuuugggguguucacgacaaauaucuggcugcggcuucgcgaagucuacacccaauugugugaccacagacucaugucagccgcugugaaagaugagagggccguucaugcagacaugggauacuggauugagagucagaagaacggcagcuggaaacuggaaaaggcgucccuaaucgaggugaaaacuugcaccuggccuaagucucacacacuguggucgaaugguguacucgaaagcgauaugauaaucccaaagucccuggccggcccgauuucacagcauaaccaccgucccggguaucacacucagaccgcuggaccuuggcaucuuggcaaauuggagcuggacuuuaauuacugcgaggggacaacggucgugaucaccgaaaacuguggaacucggggcccaaguuuacgaacaaccacugugucugguaagcucauucacgaguggugcuguagaagcugcacacugcccccucuuagguauaugggggaagauggauguugguacggcauggagauccgcccaauauccgaaaaagaggagaauauggucaagucacugguuagcgccgguucuggcaaaguggacaacuucaccauggggguauugugccucgcaauucuguuugaagaggugaugcggggaaaguucggcaagaaacauaugaucgcuggggucuucuuuacguucgugcuacugcucuccggacaaaucacuuggagagauauggcccacacccugauuaugaucggcaguaaugcaagcgacaggauggguauggggguuacauaucuugccuugauugcuaccuuuaagauacagcccuuccugguguuaggauuuuuccuccgcaaacugacuucucgagaaaaccuucugcuaggcgucggccucgcgauggccacaacccugcaguugccggaggauaucgaacaaauggcaaaugggauugcucugggauuaauggcccucaagcugaucacacaguuugagacuuaccagcuuuggaccgcccugauuuccuugacguguucaaacacaaucuucacccucacuguggcuuggcggaccgcaacacugauacuagccgguguuagucugcuuccugugugccagagcucguccaugcguaaaacugacuggcucccaauggcggucgcugccaugggcguacccccucugcccuuguuuaucuucucucugaaggauaccuuaaagagaaggagcuggccacucaaugagggggugauggcaguuggacuggugucaauucuugccaguucccuguugcgcaacgacgucccuauggcuggcccccucguggcaggugggcugcuaaucgccuguuauguaauuacgggaacaucugcggaucugaccguggaaaaagcugccgacaucacuugggaggaagaggcagaacaaacaggcgucagccauaaccuuaugauaaccguugacgaugacggcacuaugcggauuaaggaugacgagacagagaauauccucaccgugcuguugaaaacggccuuacugaucguguccgggauuuuuccauacucaauaccggcuacucuccuggucuggcacaccuggcagaagcagacacagagaagcggagugcuuugggauguuccuagucccccagaaacccaaaaagccgagcuggaagaggguguauacaggaucaagcagcagggcauuuucgggaaaacacaggugggagucggcgugcaaaaggaggguguuuuucacacuauguggcaugugacccgaggggcagucuugacguauaacggaaagcgccuagaacccaauugggcuucugugaaaaaggaccugaucuccuacggcggcggguggcggcucagcacacaguggcagaaaggagaggaaguacaagucauugccguggagccugguaagaacccaaaaaauuuccagacuaugcccggcaccuuccagacaaccacuggggaaaucggagcgauagcccuggauuuuaagccuggcaccucggguucaccgaucauuaacagagaggggaagguugugggacuuuauggcaauggcgucgugacaaaaaacgggggauacguuucugguaucgcacagacgaaugcugagccagacggccccacuccugaauuagaggaagagauguucaagaaaaggaaccugaccauuauggaucuccacccagggaguggaaagacacguaaauauuugcccgccaucgugcgcgaagcuauaaagcggagacugaggacccucauucuggcaccuacucgagucguggccgccgagauggaggaagcucuuaagggccugccgauccgguaccaaacaaccgcgacgaaauccgagcauacuggucgcgaaaucguagacuugaugugccacgcaacauuuaccaugagacuacugagccccgugaggguuccaaauuauaaccucauuaucauggaugaggcccauuucaccgacccugcuucuauagccgcacggggguacauuagcacucgagucggaaugggcgaagccgcugcgaucuuuaugacagccacccccccaggcacagcagaugcuuucccucaguccaaugcccccauucaggacgaggagagagacaucccagaacgcucauggaacagugggaaugaguggauaacugauuuugcaggaaagacggugugguucgugccgagcauuaaagccgguaacgacaucgcuaacuguuuaaggaagaauggcaaaaaggucauccagcugucucguaagaccuuugauacagaauaccaaaaaacuaagcuuaacgacugggauuucguagugaccacagacauuuccgagaugggggccaauuuuaaagcggaucggguuaucgacccuagaaggugccugaagcccgugauucucaccgauggaccagagcgcgucauauuggcaggccccaugccugugacugccgcuucagccgcucagcgaagaggucggguugggaggaacccacagaaagaaaaugaccaguauaucuucacgggccaaccccugaacaaugaugaggaccacgcacacuggaccgaagccaagaugcuccuggacaacauuaauacaccugagggaaucaucccggcucuuuucgaaccagagcgcgagaagagugccgcaauugauggcgaauaccgucuaaaaggggagagcagaaagacuuuuguggaacugaugcggaggggagacuugcccgucugguuagcgcauaaaguggccuccgaggguauaaaguauaccgaucgcaaauggugcuucgacggccagcgaaacaaucagauccuggaagagaacauggauguagagauuuggacaaaggaaggggagaaaaagaagcucagaccucgguggcuggacgcuaggaccuacucugauccccuugcccugaaagaauuuaaggacuucgcagcuggacgcaaaucgaucgcccucgauuuggugacugagauuggcagaguuccaagccaccuggcacauaggacacggaaugcccuagacaaccuggucaugcuccacacgucagaacacggugggcgugcuuaucgccaugcgguggaggagcuuccugaaaccauggagacucuguuauugcugggccucaugauccugcuuacaggaggcgccaugcuguuucucauauccgggaagggaaucgguaaaaccaguauuggcuugaucugugugauugcaucuagcgggaugcuguggauggcugaaauccccuuacaguggauagccuccgccauuguccuagaguucuuuaugaugguucugcucaucccagagccugaaaagcaacgaaccccgcaggauaaucagcuugcauacgugguaauuggaauccugacauuggcugccauaaucgcggcuaacgagaugggccugcucgaaacuacgaagagagaccuggguaugucaaaagagcccgggguggucucuccaaccagcuaucuugauguggaccuccacccugccagugcauggacacuguacgccguugcuacuaccgugauuacacccauguugaggcauaccaucgaaaauuccacugcaaacgucagccuggccgcgauugcuaaccaagccguaguguuaaugggccuagacaagggauggccaaucucuaaaauggaucugggcguuccucuccuugcacuggggugcuacucacaggugaaucccuugacgcugacagccgcuguccuccugcuuauaacccacuaugccauuaucggaccgggcuuacaggcaaaggcuacucgggaggcccagaaacgcaccgcggccgguaucaugaagaacccaacaguggacgggauuaugacuaucgaucuggacccugucauauacgauuccaaguucgagaaacaacucggacaggugauguugcugguucuaugugcagugcagcugcuccuuaugagaaccaguugggcucugugcgaagccuugacacuggcaacgggccccauuaccacucucugggaggguagcccaggcaaguuuuggaauacaaccaucgcuguaucgauggccaacauuuucagggggucuuaucuggccggagcgggcuuagcuuuuuccaucaugaaaagcguggggacuggaaagcggggcacagguucacagggggaaacccuuggagagaaauggaagaagaaacugaaucaacucagucgaaaggaauucgaccuauacaaaaagucuggcauaacggaggucgauagaaccgaggcaaaagaaggucugaagcgcggcgagaucacacaucacgccguuuccagggggagcgcuaaauugcagugguuuguggaacggaacauggucauucccgagggacgugugaucgaccugggcugugggagaggaggcuggucauauuacugcgccggucucaagaagguaacugaagugaggggguauaccaaaggaggcccuggccacgaggagccgguucccaugaguacauacggguggaauauugugaagcuuaugagcggaaaagaugucuucuaccugccaccugaaaagugugacacuuugcugugcgauaucggugaguccucucccagcccuaccguggaagagucccgcacaauucggguccucaaaaugguggagccaugguuaaagaacaaucaguucuguaucaagguucugaaccccuauaugccuaccguaauagaacaucuugagcgacugcagagaaaacacggcgggaugcuagugaggaauccacucucacgcaacucuacucaugaaauguacuggauuaguaauggaacgggcaacaucgucgcaucggugaauaugguuagccggcuguugcugaacagauuuacaaugacccaccguaggcccacuaucgagaaggacguggaucucggugccgggacccggcacgucaacgcugaaccggagacaccuaauauggacgugauuggagagcgcauaaaacgaaucaaggaagagcauaacuccacguggcacuaugacgaugaaaauccauacaaaaccugggcguaucauggcucuuacgagguaaaggccacuggcucagcaagcuccaugauuaacggggugguuaagcuucugacaaaacccugggacgucgugccuauggugacccaaauggcuaugacugauacaaccccauucggacagcagagagucuuuaaggaaaaaguugacacaaggacuccccggaguaugccggguacccgcagagugaugggcaucacggccgagugguuauggaggacccuggggcgaaauaagaaaccucgguugugcacacgugaggaauucacuaagaagguaagaaccaacgcagccaugggagcuguguuuacagaggaaaaucaaugggauucugccaaagcggcagucgaggacgaagauuucuggaagcucguggaccgcgagagggagcugcacaaacuaggcaagugugguagcugcguuuauaacaugauggggaaacgggaaaagaaacuuggagaguuuggcaaggccaagggcucaagagcuauuugguacauguggcugggggcccgcuaccucgaauucgaggcacugggauuuuugaaugaggaucauugguucuccagggaaaacaguuauagcgguguggagggcgaagggcugcacaaacucggauacauccuucgagacauaucuaagauccccggcggugcuauguaugccgaugacacugcugggugggacacccggauuacggaggaugaccugcacaaugaagagaaaaucacacagcagauggauccagagcauagacaguuagccaacgcaauuuuuaagcugaccuaccaaaauaaagucgugaagguacagaggccuacucccacaggaaccguuauggacaucauaucccgcaaggaucagcguggcucaggccagguggggacuuauggauugaacaccuucacaaauauggaagcgcaacucauucggcagauggagggugaaggcguccugagcaaagccgaccuagagaacccacaccuucccgaaaagaaaaucacgcaguggcuggagaccaaggggguggagagacucaaaaggauggcuaucucgggagaugacugcguggucaagccuauugaugaccgcuuugccaacgcacuguuggcuuuaaaugauaugggcaagguucgaaaagacauaccacaguggcaaccgucuaaggguuggcaugauuggcagcaggugcccuucuguagucaccacuuccaugaacugaucaugaaagacgggcggaagcucguagugccuugcagaccacaggacgagcuuauuggaagggcccgcaucucccaaggcgcaggcuggagccugagagaaacugccugucuagggaaagcguacgcucagauguggucacugauguauuuucaccggagggaucuccguuuggccuccaacgcaauuugcucugccguccccgugcauuggguuccuacaagccgaaccacuuggaguauccacgcucaucaccaguggaugacaaccgaggacaugcugacgguguggaaucgcgucuggauagaagauaacccauggauggaggacaagacacccgugaccacuugggaggauguaccuuaccuuggaaagagagaagaccaauggugugguucccugaucggccucaccagccgggccacaugggcacagaauauuccgacugcuauccagcagguuaggucuuuaauugggaacgaggaauuccuggauuacaugccaucaaugaaacgcuuuagaaaggaggaggaaagugagggagccaucugguga

SEQ ID NO: 15363 - RNA, 9873 nt, Artificial Sequence
  derived and/or modified CDS sequence (opt3) from DENV-3__KJ189282__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccacccucccagaauauggaacucuuggccuggagugcucuccgcgaaccgguuuggacuucaaugagaugauccuacugacaaugaaaaacaaggcguggauggugcauagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcacacagcucucaccggcgccacagaaauccagaauucagggggaacuaguauuuucgcaggucaucugaagugucgguuaaaaauggacaagcuggagcuaaaaggcaugagcuacgccaugugcaccaacacguuugugcucaagaaagaggucucugaaacccagcacgggacaauacugaucaagguggaguacaagggagaagaugcucccuguaaaauuccuuucuccacugaggacggccaugguaaggcgcacaacgggcgucuuaucaccgcaaauccaguugugacaaaaaaggaggaacccguaaacauagaggccgaaccgccuuucggcgagucaaauauugucaucggaaucggcgauaacgcuuugaaaauuaauugguauaagaaggggagcaguaucggaaaaauguuugaagccacugcacgcggugccagaaggauggcuauucugggcgacaccgccugggauuucgggucugugggaggcguucucaacucccuggguaagauggugcaucaaauauuugggagcgcauacacggcgcuuuucucgggcgucucuugggugaugaaaaucggaauuggcguacuguugacauggaucgggcucaauuccaagaacaccucaaugaguuuuagcugcaucgcuauuggaauaaucacucuguauuuaggcgccgugguucaggcagacauggguugugucauuaauuggaaagggaaggagcugaagugcggauccggcaucuucgugacaaacgaggugcacaccuggacugaacaguacaaauuucaggccgauucucccaagcggcuagcuaccgccauugcaggugcuugggagaauggcgucugugggauccgaagcacaacgcgcauggaaaaccuccuguggaaacaaauagccaaugagcuuaacuauaucuugugggaaaauaacauuaagcugaccguuguggugggagacaucauuggcauccucgagcaggggaaaagaacucugacaccacagccuauggaguuaaaguacucauggaaaaccuggggaaaggcgaagauaguaacagccgaaacucagaacaguuccuucauuaucgauggccccaauaccccagagugccccagcgcuucuagggcauggaacgucugggaaguggaggacuaugguuuugggguuuucacgacaaauauuuggcugcggcuucgcgaagccuacacccaauugugugaccacagacucaugucagcugccgugaaagaugagagggcaguccaugcggacaugggauacuggaucgagagucagaagaacggcagcuggaaacuggaaaaggccucccuaauagaggugaaaacuugcaccuggccuaagucucacacacuguggucgaaugguguucucgaaagcgauaugaucauuccaaagucccuggcuggcccgaucucacagcauaaccaccgucccggguaucacacucagaccgccggaccuuggcaucuuggcaaauuggagcuggacuuuaauuacugcgaggggacaacggugguaauuaccgaaaacuguggaacucggggcccaaguuuacgaacaaccacugucucugguaagcucauccacgaguggugcuguagaagcugcacacugcccccucuuagguauaugggggaagauggauguugguacggcauggagauacgcccaauuuccgaaaaagaggagaauauggugaagucacuggugagcgcagguucuggcaaagucgacaacuucaccauggggguuuugugccucgcuauccuguuugaagaggugaugcggggaaaguucggcaagaaacauaugaucgccgggguauucuuuacguucgugcuacugcucuccggacaaauuacuuggagagauauggcacacacccugaucaugauuggcaguaaugccagcgacaggauggguaugggggucacauaucuugcuuugauagcgaccuuuaagauccagcccuuccuggccuuaggauuuuuccuccgcaaacugacuucucgagaaaaccuucugcuaggcgugggccucgcaauggcuacaacccugcaguugccggaggauauugaacaaauggccaaugggaucgcccugggauuaauggcucucaagcugauuacacaguuugagacuuaccagcuuuggaccgcacugaucuccuugacguguucaaacacaauauucacccucacuguugccuggcggaccgcgacacugauccuagcuggugugagucugcuuccugucugccagagcucguccaugcguaaaacugacuggcucccaauggccguggcagccaugggcguucccccucugcccuuguuuauuuucucucugaaggauaccuuaaagagaaggagcuggccacucaaugagggggugauggcugucggacugguaucaauccuugcaaguucccuguugcgcaacgacgugccuauggccggcccccucguugcgggugggcugcuaauugcuuguuaugugaucacgggaacaucugccgaucugaccgucgaaaaagcagccgacauaacuugggaggaagaggcugaacaaacaggcgugagccauaaccuuaugauuaccguagacgaugacggcacuaugcggaucaaggaugacgagacagagaauauccucaccgugcuguugaaaacggccuuacugauugucuccgggauauuuccauacucaaucccggcaacucuccugguuuggcacaccuggcagaagcagacacagagaagcggagugcuuugggaugugccuagucccccagaaacccaaaaagcugagcuggaagagggugucuacaggauuaagcagcagggcaucuucgggaaaacacaggugggaguuggcguacaaaaggaggguguguuucacacuauguggcaugucacccgaggggccguguugacguauaacggaaagcgccuagaacccaauugggcgucuguuaaaaaggaccugauuuccuacggcggcggguggcggcucagcacacaguggcagaaaggagaggaagugcaagucaucgccguggagccugguaagaacccaaaaaauuuccagacuaugcccggcaccuuccagacaaccacuggggaaauaggagcaaucgcucuggauuuuaagccuggcaccucggguucaccgauuaucaacagagaggggaagguagucggacuuuauggcaauggcgugguuacaaaaaacgggggauacgugucugguauugcccagacgaaugcugagccagacggccccacuccugaauuagaggaagagauguucaagaaaaggaaccugaccaucauggaucuccacccagggaguggaaagacacguaaauauuugcccgcaauaguccgcgaagccauuaagcggagacugaggacccucauccuggccccuacucgagugguugcugcggagauggaggaagcacuuaagggccugccgauccgguaccaaacaaccgccacgaaauccgagcauacuggucgcgaaauuguggacuugaugugccacgcuacauuuaccaugagacuacugagccccgucagggugccaaauuauaaccucaucauaauggaugaggcccauuucaccgacccugcaucuauugccgcucggggguacaucagcacucgaguaggaaugggcgaagcggccgcaauuuuuaugacagcuacccccccaggcacagccgaugcauucccucaguccaaugcccccauccaggacgaggagagagacauaccagaacgcucauggaacagugggaaugaguggauuacugauuuugcuggaaagacggugugguucguuccgagcaucaaagccgguaacgacaucgcgaacuguuuaaggaagaauggcaaaaaggucauucagcugucucguaagaccuuugauacagaauaccaaaaaacuaagcuuaacgacugggauuucguggugaccacagacaucuccgagaugggggcaaauuuuaaagccgaucgggucauugacccuagaaggugccugaagcccguaauacucaccgauggaccagagcgcgugaucuuggcuggccccaugccuguuacugccgcuucagcagcccagcgaagaggucggguggggaggaacccacagaaagaaaaugaccaguauauuuucacgggccaaccccugaacaaugaugaggaccacgcucacuggaccgaagccaagaugcuccuggacaacaucaauacaccugagggaaucauuccggcacuuuucgaaccagagcgcgagaagagugcggccauagauggcgaauaccgucuaaaaggggagagcagaaagacuuuugucgaacugaugcggaggggagacuugcccgugugguuagcucauaaaguugccuccgaggguaucaaguauaccgaucgcaaauggugcuucgacggccagcgaaacaaucagauucuggaagagaacauggauguggagaucuggacaaaggaaggggagaaaaagaagcucagaccucgguggcuggacgcaaggaccuacucugauccccuugcucugaaagaauuuaaggacuucgccgcaggacgcaaaucgauugcccucgauuuggucacugagaucggcagagugccaagccaccuggcucauaggacacggaaugcgcuagacaaccugguaaugcuccacacgucagaacacggugggcgugccuaucgccaugcaguggaggagcuuccugaaaccauggagacucuguuauugcugggccucaugauacugcuuacaggaggcgcuaugcuguuucucaucuccgggaagggaauugguaaaaccaguaucggcuugauuuguguuaucgccucuagcgggaugcuguggauggccgaaauacccuuacaguggauugcauccgcuaucguccuagaguucuuuaugauggugcugcucauuccagagccugaaaagcaacgaaccccgcaggauaaucagcuugccuacguggucaucggaauacugacauuggcggcuaucauugccgcaaacgagaugggccugcucgaaacuacgaagagagaccuggguaugucaaaagagcccgggguugugucuccaaccagcuaucuugauguagaccuccacccugccagugcuuggacacuguacgcaguggccacuaccgucaucacacccauguugaggcauaccauugaaaauuccacugcgaacgugagccuggcugccaucgcaaaccaagccguuguguuaaugggccuagacaagggauggccaauaucuaaaauggaucugggcgucccucuccuugcucuggggugcuacucacagguaaaucccuugacgcugacagccgcagugcuccugcuuauuacccacuaugcuaucaucggaccgggcuuacaggccaaggcgacucgggaggcccagaaacgcaccgcagcugguauuaugaagaacccaacaguugacgggaucaugacuauagaucuggacccugugauuuacgauuccaaguucgagaaacaacucggacaggucauguugcuggugcuaugugccguccagcugcuccuuaugagaaccaguugggcacugugcgaagcuuugacacuggccacgggccccaucaccacucucugggaggguagcccaggcaaguuuuggaauacaaccauugccgugucgauggcgaacaucuucagggggucuuaucuggcuggagcaggcuuagccuuuuccauaaugaaaagcguugggacuggaaagcggggcacagguucacagggggaaacccuuggagagaaauggaagaagaaacugaaucaacucagucgaaaggaauucgaccuauacaaaaagucuggcaucacggagguggauagaaccgaggcuaaagaaggucugaagcgcggcgagauuacacaucacgccguauccagggggagcgcaaaauugcagugguuuguggaacggaacauggucauccccgagggacguguuauugaccugggcugugggagaggaggcuggucauauuacugcgccggucucaagaaggugacugaagucaggggguauaccaaaggaggcccuggccacgaggagccggugcccaugaguacauacggguggaauaucguaaagcuuaugagcggaaaagauguguucuaccugccaccugaaaagugugacacuuugcugugcgauauuggugaguccucucccagcccuaccguugaagagucccgcacaauccgggugcucaaaauggucgagccaugguuaaagaacaaucaguucuguauaaaggugcugaaccccuauaugccuaccgucauugaacaucuugagcgacugcagagaaaacacggcgggaugcuagugaggaauccacucucacgcaacucuacucaugaaauguacuggaucaguaauggaacgggcaacaucguugcuucgguaaauauggugagccggcuguugcugaacagauuuacaaugacccaccguaggcccacuauugagaaggacgucgaucucggugcggggacccggcacgugaacgccgaaccggagacaccuaauauggacguuauaggagagcgcaucaaacgaauuaaggaagagcauaacuccacguggcacuaugacgaugaaaauccauacaaaaccugggcauaucauggcucuuacgaggugaaggcuacuggcucagccagcuccaugaucaacggggucgugaagcuucugacaaaacccugggacguagugccuaugguuacccaaauggcaaugacugauacaaccccauucggacagcagagagucuuuaaggaaaaaguggacacaaggacuccccggaguauggccgguacccgcagagugaugggcauuacggcugagugguuauggaggacccuggggcgaaauaagaaaccgcgguugugcacacgugaggaauucacuaagaaggucagaaccaacgccgcgaugggagcaguuuuuacagaggaaaaucaaugggauucugccaaagcugccguggaggacgaagauuucuggaagcucguagaccgcgagagggagcugcacaaacuaggcaagugugguagcugcguguauaacaugauggggaaacgggaaaagaaacuuggagaguuuggcaaggcaaagggcucaagagcuaucugguacauguggcugggggcccgcuaccucgaauucgaggcucugggauuuuugaaugaggaucauugguucuccagggaaaacaguuauagcggugucgagggcgaagggcugcacaaacucggauacauacuucgagacaucucuaagauuccuggcggugccauguaugcagaugacacugcggggugggacacccggaucacggaggaugaccugcacaaugaagagaaaauuacacagcagauggaucccgagcauagacaguuagccaacgcuaucuuuaagcugaccuaccaaaauaaagugguuaaggugcagaggccaacuccuacaggaaccgucauggacauaauuucccgcaaggaucagcguggcucaggccagguggggacuuauggauugaacaccuucacaaauauggaagcccaacucauccggcagauggagggugaaggcguacugagcaaagcagaccuagagaacccccaccuuccagaaaagaaaaucacgcaguggcuggagaccaaggggguugagagacucaaaaggauggcuauuucgggagaugacugcguggucaagcccauagaugaccgcuuugccaacgcacuguuggccuuaaaugauaugggcaaggugcgaaaagacaucccucaguggcaaccaucuaaggguuggcaugauuggcagcaggugccguucuguagucaccacuuccaugaacugauuaugaaagacgggcggaagcucgucguucccugcagaccucaggacgagcuuaucggaagggcgcgcauuucccaaggcgcuggcuggagccugagagaaacugccugucuagggaaagcauacgcccagauguggucacugauguauuuucaccggagggaucuccguuuggcuuccaacgccaucugcucugcagugccaguacauugggugcccacaagccgaaccacuuggaguauacacgcucaucaccaguggaugacaaccgaggacaugcugacggucuggaaucgcguguggaucgaagauaacccuuggauggaggacaagacaccaguuaccacuugggaggaugugcccuaccuuggaaagagagaagaccaauggugugguucccugauuggccucaccagccgggccacaugggcgcagaauaucccuacugcuauucagcaggucaggucuuuaaucgggaacgaggaauuccuggauuacaugccgucaaugaaacgcuuuagaaaggaggaggaaagugagggagccauuugguga

SEQ ID NO: 15364 - RNA, 9873 nt, Artificial Sequence
  derived and/or modified CDS sequence (opt3) from DENV-3__KJ189283__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccacccucccagaauauggaacucuuggccuggagugcucuccgcgaaccgguuuggacuucaaugagaugauccuacugacaaugaaaaacaaggcguggauggugcauagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcacacagcucucaccggcgccacagaaauccagaauucagggggaacuaguauuuucgcaggucaucugaagugucgguuaaaaauggacaagcuggagcuaaaaggcaugagcuacgccaugugcaccaacacguuugugcucaagaaagaggucucugaaacccagcacgggacaauacugaucaagguggaguacaagggagaagaugcucccuguaaaauuccuuucuccacugaggacggccaugguaaggcgcacaacgggcgucuuaucaccgcaaauccaguugugacaaaaaaggaggaacccguaaacauagaggccgaaccgccuuucggcgagucaaauauugucaucggaaucggcgauaacgcuuugaaaauuaauugguauaagaaggggagcaguaucggaaaaauguuugaagccacugcacgcggugccagaaggauggcuauucugggcgacaccgccugggauuucgggucugugggaggcguucucaacucccuggguaagauggugcaucaaauauuugggagcgcauacacggcgcuuuucucgggcgucucuugggugaugaaaaucggaauuggcguacuguugacauggaucgggcucaauuccaagaacaccucaaugaguuuuagcugcaucgcuauuggaauaaucacucuguauuuaggcgccgugguucaggcagacauggguugugucauuaauuggaaagggaaggagcugaagugcggauccggcaucuucgugacaaacgaggugcacaccuggacugaacaguacaaauuucaggccgauucucccaagcggcuagcuaccgccauugcaggugcuugggagaauggcgucugugggauccgaagcacaacgcgcauggaaaaccuccuguggaaacaaauagccaaugagcuuaacuauaucuugugggaaaauaacauuaagcugaccguuguggugggagacaucauuggcguacucgagcaggggaaaagaacucugacaccacagccuauggaguuaaaguacucauggaaaaccuggggaaaggcgaagaucgucacagccgaaacucagaacaguuccuucauaauugauggccccaauaccccagagugccccagcgcuucuagggcauggaacgugugggaaguugaggacuaugguuuugggguguucacgacaaauaucuggcugcggcuucgcgaagucuacacccaauugugugaccacagacucaugucagccgcugugaaagaugagagggccguucaugcagacaugggauacuggauugagagucagaagaacggcagcuggaaacuggaaaaggcgucccuaaucgaggugaaaacuugcaccuggccuaagucucacacacuguggucgaaugguguacucgaaagcgauaugauaaucccaaagucccuggccggcccgauuucacagcauaaccaccgucccggguaucacacucagaccgcuggaccuuggcaucuuggcaaauuggagcuggacuuuaauuacugcgaggggacaacggucgugaucaccgaaaacuguggaacucggggcccaaguuuacgaacaaccacugugucugguaagcucauucacgaguggugcuguagaagcugcacacugcccccucuuagguauaugggggaagauggauguugguacggcauggagauccgcccaauauccgaaaaagaggagaauauggucaagucacugguuagcgccgguucuggcaaaguggacaacuucaccauggggguauugugccucgcaauucuguuugaagaggugaugcggggaaaguucggcaagaaacauaugaucgcuggggucuucuuuacguucgugcuacugcucuccggacaaaucacuuggagagauauggcccacacccugauuaugaucggcaguaaugcaagcgacaggauggguauggggguuacauaucuugccuugauugcuaccuuuaagauacagcccuuccuggcguuaggauuuuuccuccgcaaacugacuucucgagaaaaccuucugcuaggcgugggccucgccauggcaacaacccugcaguugccggaggauaucgaacaaauggcuaaugggauugcccugggauuaauggcccucaagcugaucacacaguuugagacuuaccagcuuuggaccgcucugauuuccuugacguguucaaaaacaaucuucacccucacugucgcauggcggaccgccacacugauacuagcgggugugagucugcuuccuguuugccagagcucguccaugcguaagacugacuggcucccaauggcuguggccgcaaugggcguccccccucugcccuuguuuaucuucucucugaaggauaccuuaaaaagaaggagcuggccacucaacgaggggguaauggccgugggacugguuucaauucuugcuaguucccuguugcgcaaugacgugccuauggcaggcccccucgucgccggugggcugcuaaucgcguguuaugugauuacgggaacaucugcugaucugaccguagaaaaggccgcagacaucacuugggaggaagaggccgaacaaacaggcgugagccauaaccuuaugauaaccgucgacgaugacggcacuaugcggauuaaagaugacgagacagagaacauccucaccguucuguugaagacggcuuuacugaucguguccgggauuuuuccauacucaauaccggccacucuccugguguggcacaccuggcagaaacagacacagagaagcggaguccuuugggaugugccuagucccccagaaacccaaaaggcagagcuggaagaggguguuuacaggaucaaacagcagggcauuuucgggaagacacagguaggagugggcguccaaaaggaggguguguuucacacuauguggcauguuacccgaggggcuguguugacguauaauggaaaacgccuagaacccaacugggccucugucaagaaagaccugaucuccuacggcggcggguggcggcucagcacacaguggcagaagggagaggaagugcaaguaauugcggucgagccugguaaaaauccaaagaacuuccagacuaugcccggcaccuuccagacaaccacuggggaaaucggagccauagcacuggauuuuaagccuggcaccucggguucaccgaucauuaauagagaggggaaagugguuggacuuuauggcaacggcguggucacaaagaaugggggauacgugucugguaucgcucagacgaacgccgagccagacggccccacuccugaauuagaggaagagauguucaaaaagaggaaucugaccauuauggaucuccacccagggaguggaaaaacacguaaguauuugcccgcuaucguucgcgaagcaauaaagcggagacugaggacccucauucuggccccuacucgaguggucgccgcugagauggaggaagcgcuuaaaggccugccgauccgguaccaaacaaccgcaacgaaguccgagcauacuggucgcgaaaucguggacuugaugugccacgccacauuuaccaugagacuacugagccccguaagggugccaaacuauaaucucauuaucauggaugaggcucauuucaccgacccugccucuauagcagcccggggguacauuagcacucgaguuggaaugggcgaagcugcggccaucuuuaugacagcaacccccccaggcacagcugaugccuucccucaguccaacgcacccauucaggacgaggagagagacaucccagaacgcucauggaauagugggaacgaguggauaacugauuuugccggaaaaacggucugguucgugccgagcauuaaggcugguaaugacaucgccaacuguuuaaggaaaaacggcaagaaggugauccagcugucucguaaaaccuuugauacagaauaccaaaagacuaaacuuaaugacugggauuucgucguaaccacagacauuuccgagaugggggcgaacuuuaaggcagaucgggugaucgacccuagaaggugccugaaacccguuauucucaccgauggaccagagcgcgugauauuggccggccccaugccugucacugcugccucagcugcacagcgaagaggucggguggggaggaauccacagaaggaaaacgaccaguauaucuucacgggccaaccccugaauaacgaugaggaccacgcccacuggaccgaagcuaagaugcuccuggacaauauuaacacaccugagggaaucaucccggcccuuuucgaaccagagcgcgagaaaagugcagcgauugauggcgaauaccgucuaaagggggagagcagaaaaacuuuuguugaacugaugcggaggggagacuugcccgugugguuagcccauaaggucgcuuccgaggguauaaaauauaccgaucgcaaguggugcuucgacggccagcgaaauaaccagauccuggaagagaauauggauguggagauuuggacaaaagaaggggagaagaagaaacucagaccucgguggcuggacgccaggaccuacucugauccccuugcacugaaggaauuuaaagacuucgcugccggacgcaagucgaucgcacucgauuugguaacugagauuggcagagugccaagccaccuggcccauaggacacggaacgcucuagacaaucugguuaugcuccacacgucagaacacggugggcgugcguaucgccaugccgucgaggagcuuccugaaaccauggagacucuguuauugcugggccucaugauccugcuuacaggaggcgcaaugcuguuucucauauccgggaaaggaaucgguaagaccaguauuggcuugaucugugugauugcuucuagcgggaugcuguggauggccgaaauccccuuacaguggauagccuccgcaauugugcuagaguucuuuaugaugguccugcucaucccagagccugaaaagcaacgaaccccgcaggauaaccagcuugcuuacguugugauuggaauccugacauuggccgcgauaaucgcugccaaugagaugggccugcucgaaacuacgaaaagagaccuggguaugucaaaggagcccgggguagugucuccaaccagcuaucuugaugucgaccuccacccugcaagugccuggacacuguacgcuguggcaacuaccguuauuacacccauguugaggcauaccaucgaaaacuccacugccaaugugagccuggcggcuauugccaaccaagcagucguauuaaugggccuagacaaaggauggccaaucucuaagauggaucugggcgugccucuccuugcccuggggugcuacucacagguuaaccccuugacgcugacagcugccgugcuccugcuuauaacccacuaugcaauuaucggaccgggcuuacaggcuaaagccacucgggaggcgcagaagcgcaccgccgcagguaucaugaagaauccaacagucgacgggauuaugacuaucgaucuggacccugugauauacgauuccaaauucgagaagcaacucggacaggucauguugcuggugcuaugugcuguucagcugcuccuuaugagaaccaguugggcccugugcgaagcauugacacuggcuacgggccccauuaccacucucugggaggguagcccaggcaaauuuuggaacacaaccaucgccgugucgauggccaauauuuucagggggucuuaucuggcgggagcuggcuuagcauuuuccaucaugaagagcguagggacuggaaaacggggcacagguucacagggggaaacccuuggagagaaguggaagaaaaagcugaaccaacucagucgaaaagaauucgaccuauacaagaaaucuggcauaacggagguggauagaaccgaggccaaggaaggucugaaacgcggcgagaucacacaucacgcugucuccagggggagcgccaaguugcagugguuuguugaacggaauauggugauucccgagggacgugucaucgaccugggcugugggagaggaggcuggucauauuacugcgcaggucucaagaaagugacugaaguaaggggguauaccaagggaggcccuggccacgaggagccggugcccaugaguacauacggguggaacauuguuaaacuuaugagcggaaaggauguguucuaccugccaccugaaaaaugugacacuuugcugugcgauaucggugaguccucucccagcccuaccgucgaagagucccgcacaauucgggugcucaagauggucgagccaugguuaaagaauaaccaguucuguaucaaagugcugaaucccuauaugccuaccguuauagaacaucuugagcgacugcagagaaagcacggcgggaugcuaguaaggaacccacucucacgcaauucuacucaugaaauguacuggauuaguaacggaacgggcaauaucguggccucggucaacauggugagccggcuguugcugaauagauuuacaaugacccaccguaggcccacuaucgagaaagacguugaucucggugcugggacccggcacgugaacgcggaaccggagacaccuaacauggacgucauuggagagcgcauaaagcgaaucaaagaagagcauaauuccacguggcacuaugacgaugaaaacccauacaagaccugggccuaucauggcucuuacgaggugaaggcaacuggcucagcuagcuccaugauuaaugggguagugaaacuucugacaaagcccugggacguugucccuauggugacccaaauggccaugacugauacaaccccauucggacagcagagaguguuuaaagaaaaggucgacacaaggacuccccggaguaugccggguacccgcagaguuaugggcaucacggcagagugguuauggaggacccuggggcgaaacaaaaagccucgguugugcacacgugaggaauucacuaagaaagugagaaccaaugccgcuaugggagccguauuuacagaggaaaaccaaugggauucugcgaaggcagccguggaggacgaagauuucuggaaacucgucgaccgcgagagggagcugcacaagcuaggcaaaugugguagcugcguguauaauaugauggggaagcgggaaaaaaagcuuggagaguuuggcaaggcuaaaggcucaagagccauuugguacauguggcugggggcacgcuaccucgaauucgaggcucugggauuuuugaacgaggaucauugguucuccagggaaaauaguuauagcgguguugagggcgaagggcugcacaagcucggauacauccuucgagacauaucuaaaauccccggcggugccauguaugcugaugacacugccgggugggacacccggauuacggaggaugaccugcacaacgaagagaagaucacacagcagauggauccagagcauagacaguuagcaaaugcgauuuuuaaacugaccuaccaaaacaagguggucaaggugcagaggccuacucccacaggaaccguaauggacaucauaucccgcaaagaucagcguggcucaggccagguugggacuuauggauugaauaccuucacaaacauggaagcccaacucauucggcagauggagggugaaggcgugcugagcaaggcugaccuagagaauccacaccuucccgaaaaaaagaucacgcaguggcuggagaccaaaggggucgagagacucaagaggauggccaucucgggagaugacugcguggugaagccuauugaugaccgcuuugcaaacgcucuguuggccuuaaacgauaugggcaaaguccgaaaggacauaccacaguggcaaccgucuaaagguuggcaugauuggcagcagguucccuucuguagucaccacuuccaugaacugaucaugaaggacgggcggaaacucgugguaccuugcagaccacaggacgagcuuauuggaagggcacgcaucucccaaggcgccggcuggagccugagagaaacugcgugucuagggaaggcuuacgcccagauguggucacugauguauuuucaccggagggaucuccguuuggcauccaaugccauuugcucugcugugcccguccauugggugccuacaagccgaaccacuuggaguauccacgcccaucaccaguggaugacaaccgaggacaugcugacgguuuggaaccgcguguggauagaagauaauccauggauggaggacaagacacccgucaccacuugggaggaugugccuuaccuuggaaaaagagaagaccaauggugugguucccugaucggccucaccagccgggcaacaugggcucagaacauuuuaacugccauccagcagguaaggucucugauugggaaugaggaauucuuggauuacaugccgucaaugaagcgcuuuagaaaagaggaggaaagugagggagcgaucugguga

SEQ ID NO: 15365 - RNA, 9873 nt, Artificial Sequence
  derived and/or modified CDS sequence (opt3) from DENV-3__KJ189284__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggugacccucccagaauauggaacucuuggccuggagugcucuccgcgaaccgguuuggacuucaaugagaugauccuacugacaaugaaaaacaaggccuggaugguacauagacagugguuuuucgaucucccccugccuuggaccagcggggcgacuacagaaacgccaaccuggaauaggaaagagcuucugguuacuuuuaagaacgcccacgcaaaaaagcaagaaguggucguguugggcucccaggagggagcuaugcacacagcccucaccggcgcuacagaaauccagaauucagggggaacuaguauuuucgccggucaucugaagugucgguuaaaaauggacaagcuggagcuaaaaggcaugagcuacgcaaugugcaccaacacguuuguccucaagaaagaggugucugaaacccagcacgggacaauacugaucaagguugaguacaagggagaagaugcccccuguaaaauuccuuucuccacugaggacggccaugguaaggcucacaacgggcgucuuaucaccgcgaauccagugguaacaaaaaaggaggaacccgucaacauagaggcagaaccgccuuucggcgagucaaauauugugaucggaaucggcgauaacgccuugaaaauuaauugguauaagaaggggagcaguaucggaaaaauguuugaagcuacugcccgcggugcaagaaggauggccauucugggcgacaccgcuugggauuucgggucuguuggaggcgugcucaacucccuggguaagaugguccaucaaauauuugggagcgccuacacggcacuuuucucgggcgugucuuggguaaugaaaaucggaauuggcgugcuguugacauggaucgggcucaauuccaagaacaccucaaugaguuuuagcugcaucgcgauuggaauaaucacucuguauuuaggcgcuguuguccaggccgacauggguugugugauuaauuggaaagggaaggagcugaagugcggauccggcaucuucgugacaaacgagguccacaccuggacugaacaguacaaauuucaggcagauucucccaagcggcuagccaccgcuauugccggugcaugggagaauggcguuugugggauccgaagcacaacgcgcauggaaaaccuccuguggaaacaaauagcuaaugagcuuaacuauaucuugugggaaaauaacauuaagcugaccguggugguaggagacaucauuggcguccucgagcaggggaaaagaacucugacaccacagccuauggaguuaaaguacucauggaaaaccuggggaaaggccaagaucgugacagcggaaacucagaacaguuccuucauaauugauggccccaauaccccagagugccccagcgccucuagggcuuggaacguuugggaaguggaggacuaugguuuuggggucuucacgacaaauaucuggcugcggcuucgcgaaguguacacccaauugugugaccacagacucaugucagcagccguuaaagaugagagggcugugcaugccgacaugggauacuggauugagagucagaagaacggcagcuggaaacuggaaaaggcaucccuaaucgagguaaaaacuugcaccuggccuaagucucacacacuguggucgaaugguguccucgaaagcgauaugauaaucccaaagucccuggcgggcccgauuucacagcauaaccaccgucccggguaucacacucagaccgccggaccuuggcaucuuggcaaauuggagcuggacuuuaauuacugcgaggggacaacgguggugaucaccgaaaacuguggaacucggggcccaaguuuacgaacaaccacugucucugguaagcucauucacgaguggugcuguagaagcugcacacugcccccucuuagguauaugggggaagauggauguugguacggcauggagauccgcccaauauccgaaaaagaggagaauaugguuaagucacuggugagcgcugguucuggcaaaguagacaacuucaccauggggguguugugccucgccauucuguuugaagaggucaugcggggaaaguucggcaagaaacauaugaucgcagggguguucuuuacguucguucuacugcucuccggacaaaucacuuggagagauauggcucacacccugauuaugaucggcaguaaugccagcgacaggauggguaugggggugacauaucuugcauugauugccaccuuuaagauacagcccuuccuggcuuuaggauuuuuccuccgcaaacugacuucucgagaaaaccuucugcuaggcgucggccucgcgauggccacaacccugcaguugccggaggauaucgaacaaauggcaaaugggauugcucugggauuaauggcccucaagcugaucacacaguuugagacuuaccagcuuuggaccgcccugauuuccuugacguguucaaacacaaucuucacccucacuguggcuuggcggaccgcaacacugauacuagccgguguuagucugcuuccugugugccagagcucguccaugcguaaaacugacuggcucccaauggcggucgcugccaugggcguacccccucugcccuuguuuaucuucucucugaaggauaccuuaaagagaaggagcuggccacucaaugagggggugauggcaguuggacuggugucaauucuugccaguucccuguugcgcaacgacgucccuauggcuggcccccucguggcaggugggcugcuaaucgccuguuauguaauuacgggaacaucugcggaucugaccguggaaaaagcugccgacaucacuugggaggaagaggcagaacaaacaggcgucagccauaaccuuaugauaaccguugacgaugacggcacuaugcggauuaaggaugacgagacagagaauauccucaccgugcuguugaaaacggccuuacugaucguguccgggauuuuuccauacucaauaccggcuacucuccuggucuggcacaccuggcagaagcagacacagagaagcggagugcuuugggauguuccuagucccccagaaacccaaaaagccgagcuggaagaggguguauacaggaucaagcagcagggcauuuucgggaaaacacaggugggagucggcgugcaaaaggaggguguuuuucacacuauguggcaugugacccgaggggcagucuugacguauaacggaaagcgccuagaacccaauugggcuucugugaaaaaggaccugaucuccuacggcggcggguggcggcucagcacacaguggcagaaaggagaggaaguacaagucauugccguggagccugguaagaacccaaaaaauuuccagacuaugcccggcaccuuccagacaaccacuggggaaaucggagcgauagcccuggauuuuaagccuggcaccucggguucaccgaucauuaacagagaggggaagguugugggacuuuauggcaauggcgucgugacaaaaaacgggggauacguuucugguaucgcacagacgaaugcugagccagacggccccacuccugaauuagaggaagagauguucaagaaaaggaaccugaccauuauggaucuccacccagggaguggaaagacacguaaauauuugcccgccaucgugcgcgaagcuauaaagcggagacugaggacccucauucuggcaccuacucgagucguggccgccgagauggaggaagcucuuaagggccugccgauccgguaccaaacaaccgcgacgaaauccgagcauacuggucgcgaaaucguagacuugaugugccacgcaacauuuaccaugagacuacugagccccgugaggguuccaaauuauaaccucauuaucauggaugaggcccauuucaccgacccugcuucuauagccgcacggggguacauuagcacucgagucggaaugggcgaagccgcugcgaucuuuaugacagccacccccccaggcacagcagaugcuuucccucaguccaaugcccccauucaggacgaggagagagacaucccagaacgcucauggaacagugggaaugaguggauaacugauuuugcaggaaagacggugugguucgugccgagcauuaaagccgguaacgacaucgcuaacuguuuaaggaagaauggcaaaaaggucauccagcugucucguaagaccuuugauacagaauaccaaaaaacuaagcuuaacgacugggauuucguagugaccacagacauuuccgagaugggggccaauuuuaaagcggaucggguuaucgacccuagaaggugccugaagcccgugauucucaccgauggaccagagcgcgucauauuggcaggccccaugccugugacugccgcuucagccgcucagcgaagaggucggguugggaggaacccacagaaagaaaaugaccaguauaucuucacgggccaaccccugaacaaugaugaggaccacgcacacuggaccgaagccaagaugcuccuggacaacauuaauacaccugagggaaucaucccggcucuuuucgaaccagagcgcgagaagagugccgcaauugauggcgaauaccgucuaaaaggggagagcagaaagacuuuuguggaacugaugcggaggggagacuugcccgucugguuagcgcauaaaguggccuccgaggguauaaaguauaccgaucgcaaauggugcuucgacggccagcgaaacaaucagauccuggaagagaacauggauguagagauuuggacaaaggaaggggagaaaaagaagcucagaccucgguggcuggacgcuaggaccuacucugauccccuugcccugaaagaauuuaaggacuucgcagcuggacgcaaaucgaucgcccucgauuuggugacugagauuggcagaguuccaagccaccuggcacauaggacacggaaugcccuagacaaccuggucaugcuccacacgucagaacacggugggcgugcuuaucgccaugcgguggaggagcuuccugaaaccauggagacucuguuauugcugggccucaugauccugcuuacaggaggcgccaugcuguuucucauauccgggaagggaaucgguaaaaccaguauuggcuugaucugugugauugcaucuagcgggaugcuguggauggcugaaauccccuuacaguggauagccuccgccauuguccuagaguucuuuaugaugguucugcucaucccagagccugaaaagcaacgaaccccgcaggauaaucagcuugcauacgugguaauuggaauccugacauuggcugccauaaucgcggcuaacgagaugggccugcucgaaacuacgaagagagaccuggguaugucaaaagagcccgggguggucucuccaaccagcuaucuugauguggaccuccacccugccagugcauggacacuguacgccguugcuacuaccgugauuacacccauguugaggcauaccaucgaaaauuccacugcaaacgucagccuggccgcgauugcuaaccaagccguaguguuaaugggccuagacaagggauggccaaucucuaaaauggaucugggcguuccucuccuugcacuggggugcuacucacaggugaaucccuugacgcugacagccgcuguccuccugcuuauaacccacuaugccauuaucggaccgggcuuacaggcaaaggcuacucgggaggcccagaaacgcaccgcggccgguaucaugaagaacccaacaguggacgggauuaugacuaucgaucuggacccugucauauacgauuccaaguucgagaaacaacucggacaggugauguugcugguucuaugugcagugcagcugcuccuuaugagaaccaguugggcucugugcgaagccuugacacuggcaacgggccccauuaccacucucugggaggguagcccaggcaaguuuuggaauacaaccaucgcuguaucgauggccaacauuuucagggggucuuaucuggccggagcgggcuuagcuuuuuccaucaugaaaagcguggggacuggaaagcggggcacagguucacagggggaaacccuuggagagaaauggaagaagaaacugaaucaacucagucgaaaggaauucgaccuauacaaaaagucuggcauaacggaggucgauagaaccgaggcaaaagaaggucugaagcgcggcgagaucacacaucacgccguuuccagggggagcgcuaaauugcagugguuuguggaacggaacauggucauucccgagggacgugugaucgaccugggcugugggagaggaggcuggucauauuacugcgccggucucaagaagguaacugaagugaggggguauaccaaaggaggcccuggccacgaggagccgguucccaugaguacauacggguggaauauugugaagcuuaugagcggaaaagaugucuucuaccugccaccugaaaagugugacacuuugcugugcgauaucggugaguccucucccagcccuaccguggaagagucccgcacaauucggguccucaaaaugguggagccaugguuaaagaacaaucaguucuguaucaagguucugaaccccuauaugccuaccguaauagaacaucuugagcgacugcagagaaaacacggcgggaugcuagugaggaauccacucucacgcaacucuacucaugaaauguacuggauuaguaauggaacgggcaacaucgucgcaucggugaauaugguuagccggcuguugcugaacagauuuacaaugacccaccguaggcccacuaucgagaaggacguggaucucggugccgggacccggcacgucaacgcugaaccggagacaccuaauauggacgugauuggagagcgcauaaaacgaaucaaggaagagcauaacuccacguggcacuaugacgaugaaaauccauacaaaaccugggcguaucauggcucuuacgagguaaaggccacuggcucagcaagcuccaugauuaacggggugguuaagcuucugacaaaacccugggacgucgugccuauggugacccaaauggcuaugacugauacaaccccauucggacagcagagagucuuuaaggaaaaaguugacacaaggacuccccggaguaugccggguacccgcagagugaugggcaucacggccgagugguuauggaggacccuggggcgaaauaagaaaccucgguugugcacacgugaggaauucacuaagaagguaagaaccaacgcagccaugggagcuguguuuacagaggaaaaucaaugggauucugccaaagcggcagucgaggacgaagauuucuggaagcucguggaccgcgagagggagcugcacaaacuaggcaagugugguagcugcguuuauaacaugauggggaaacgggaaaagaaacuuggagaguuuggcaaggccaagggcucaagagcuauuugguacauguggcugggggcccgcuaccucgaauucgaggcacugggauuuuugaaugaggaucauugguucuccagggaaaacaguuauagcgguguggagggcgaagggcugcacaaacucggauacauccuucgagacauaucuaagauccccggcggugcuauguaugccgaugacacugcugggugggacacccggauuacggaggaugaccugcacaaugaagagaaaaucacacagcagauggauccagagcauagacaguuagccaacgcaauuuuuaagcugaccuaccaaaauaaagucgugaagguacagaggccuacucccacaggaaccguuauggacaucauaucccgcaaggaucagcguggcucaggccagguggggacuuauggauugaacaccuucacaaauauggaagcgcaacucauucggcagauggagggugaaggcguccugagcaaagccgaccuagagaacccacaccuucccgaaaagaaaaucacgcaguggcuggagaccaaggggguggagagacucaaaaggauggcuaucucgggagaugacugcguggucaagccuauugaugaccgcuuugccaacgcacuguuggcuuuaaaugauaugggcaagguucgaaaagacauaccacaguggcaaccgucuaaggguuggcaugauuggcagcaggugcccuucuguagucaccacuuccaugaacugaucaugaaagacgggcggaagcucguagugccuugcagaccacaggacgagcuuauuggaagggcccgcaucucccaaggcgcaggcuggagccugagagaaacugccugucuagggaaagcguacgcucagauguggucacugauguauuuucaccggagggaucuccguuuggccuccaacgcaauuugcucugccguccccgugcauuggguuccuacaagccgaaccacuuggaguauccacgcucaucaccaguggaugacaaccgaggacaugcugacgguguggaaucgcgucuggauagaagauaacccauggauggaggacaagacacccgugaccacuugggaggauguaccuuaccuuggaaagagagaagaccaauggugugguucccugaucggccucaccagccgggccacaugggcacagaauauuccgacugcuauccagcagguuaggucuuuaauugggaacgaggaauuccuggauuacaugccaucaaugaaacgcuuuagaaaggaggaggaaagugagggagccaucugguga

SEQ ID NO: 15366 - RNA, 9873 nt, Artificial Sequence
  derived and/or modified CDS sequence (opt3) from DENV-3__KJ189286__SS-prME
accagcuucugccugaugaugauccuccccgcagcucuugcauuucaccugaccuccagagacggcgagccuaggaugauuguggggaagaacgaacggggaaaaucuuuguuauucaagacugccucagguauaaauauguguacgcugaucgcgauggauuugggcgagaugugcgacgauaccgucacauacaaauguccacauauuacugaaguugagccggaagacaucgauugcugguguaaccucaccaguacaugggugaccuaugggacuugcaaucaggcuggagagcaccgccgagacaagcguagcgucgcccuggcaccccaugugggcaugggucuugauacaagaacccaaacguggauguccgccgagggggcuuggaggcaggucgaaaaaguggagacuugggcacugcggcacccuggauuuaccauuuuggcccucuuccuggcucauuacaucggcacaucucugacucagaagguugugauauuuauccucuuaaugcuggucaccccaucgaugacaaugcgcugugugggcguagggaacagagacuucguugaaggacuuucaggugccaccuggguggaugucguguuggagcacggcgggugcgugacgacuauggcgaagaauaaacccacacuggacauugagcuacagaagaccgaagcaacucaacucgccacacugaggaaacuuuguaucgagggaaagauuaccaacaucacgaccgauagccggugcccuacacagggcgaagcuguccugccagaggaacaggaccagaauuauguuuguaaacacacuuacguggaucgcgguugggggaacggaugcggcuuguuuggcaaggggagucucguaaccugcgccaaguuccaaugucuggagcccauagagggaaaagugguccaguaugaaaauuuaaaguacacagugauuaucacuguucauaccggugaccagcaccaggugggcaacgagacacaaggggucaccgcagaaauuacuccucaggcuuccacgacagaggccacccugccagaauauggaacucucggccuugagugcucuccgcgaaccggucuggacuuuaaugagaugaucuugcuaacaaugaaaaacaaggcguggauggugcauagacagugguucuuugaucugccccucccuuggaccagcggggccacuacagaaacgccaaccuggaauaggaaagagcugcuuguaacuuucaagaacgcacacgcuaaaaagcaagaaguugugguccugggcucccaggagggagccaugcacacagcuuugaccggcgccacagaaauccaaaauucagggggaacaagcauuuuugcaggucaucucaagugucggcugaaaauggacaaguuagagcugaaaggcaugagcuacgccaugugcaccaacacguucgugcuaaagaaagaggucucugaaacccagcacgggacaauacucaucaagguggaguacaagggagaagaugcucccuguaaaauuccuuucuccacugaggacggccaugguaaggcgcacaacgggcgucugaucaccgcaaauccaguugugacuaagaaagaggaacccguaaacauagaggccgaaccgccuuuuggcgagucaaauauugucaucggaaucggcgauaacgcucuuaaaauuaauugguauaaaaaggggagcaguaucggaaaaauguucgaagccacugcacgcggugccagaaggauggcuauuuugggcgacaccgccugggauuuugggucugugggaggcguucugaacucccucgguaagauggugcaucaaauauucgggagcgcauacacggcgcuguuuucgggcgucucuugggugaugaaaaucggaauuggcguacuucugacauggaucgggcuaaauuccaagaacaccucaaugaguuucagcugcaucgcuauuggaauaaucacucucuaucugggcgccgugguucaggcagacauggguugugucauuaauuggaaagggaaggaguuaaagugcggauccggcaucuuugugacaaacgaggugcacaccuggacugaacaguacaaauuccaggccgauucucccaagcggcuggcuaccgccauugccggugcuugggagaauggcgucugugggauccgaagcacaacgcgcauggaaaaccuacucuggaaacaaauagccaaugagcugaacuauauccuuugggaaaauaacauuaaguugaccguuguggugggagacaucauuggcguacuggagcaggggaaaagaacucucacaccacagccuauggagcugaaguacucauggaaaaccuggggaaaggcgaagaucgucacagccgaaacucagaacaguuccuuuauaauugauggccccaauaccccagagugccccagcgcuucuagggcauggaacgugugggaaguugaggacuaugguuucgggguguuuacgacaaauaucugguuacggcugcgcgaagucuacacccaacuuugugaccacagauugaugucagccgcugugaaagaugagagggccguucaugcagacaugggauacuggauugagagucagaagaacggcagcuggaaacucgaaaaggcgucccugaucgaggugaaaacuugcaccuggccuaagucucacacacuauggucgaaugguguacuggaaagcgauaugauaaucccaaagucccucgccggcccgauuucacagcauaaccaccgucccggguaucacacucagaccgcuggaccuuggcaucugggcaaacuugaguuggacuucaauuacugcgaggggacaacggucgugaucaccgaaaacuguggaacucggggcccaagucugcgaacaaccacugugucugguaaguuaauucacgaguggugcuguagaagcugcacacucccaccucugagguauaugggggaagauggauguugguacggcauggagauccgcccaauauccgaaaaagaggagaauauggucaagucacuuguuagcgccgguucuggcaaaguggacaacuuuaccauggggguacugugcuuggcaauucucuucgaagaggugaugcggggaaaguucggcaagaaacauaugaucgcuggggucuuuuucacguuugugcugcuacuguccggacaaaucacuuggagagauauggcccacacccucauuaugaucggcaguaaugcaagcgacaggauggguauggggguuacauaucuggcccuuauugcuaccuucaagauacagcccuuuuuggcgcugggauucuuuuuacgcaaacucacuucucgagaaaaccugcuucugggcgugggccuagccauggcaacaacccuccagcugccggaggauaucgaacaaauggcuaaugggauugccuugggacugauggccuuaaagcucaucacacaguucgagacuuaccagcuguggaccgcucuuauuucccugacguguucaaacacaaucuuuaccuugacugucgcauggcggaccgccacacucauacuggcgggugugagucuacugccuguuugccagagcucguccaugcguaaaacugacuggcuuccaauggcuguggccgcaaugggcguacccccucucccccuguucaucuuuaauuugaaggauacccugaagagaaggucuuggccauuaaacgaggggguaauggccgugggacucguuagcauucuggcuucaagucuucugcgcaacgacgugccuauggcaggccccuuggucgccggugggcuccugaucgcguguuaugugauuacgggaacauccgcugaucuaaccguagaaaaagccgcagacaucacuugggaggaagaggccgaacaaacaggcgugucucauaaucugaugauaaccgucgacgaugacggcacuaugcggauuaaggaugacgagacagagaacauccuuaccguucuccugaaaacggcuuuguuaaucgugagcgggauuuucccauacuccauaccggccacucugcucguguggcacaccuggcagaagcagacacagagaucaggaguccugugggaugugccuagucccccagaaacccaaaaagcagagcuugaagaggguguuuacaggaucaagcagcagggcauuuuugggaaaacacagguaggagugggcguccaaaaggaggguguguuccacacuauguggcauguuacccgaggggcugugcugacguauaauggaaagcgcuuggaacccaacugggccagugucaaaaaggaccuaaucucuuacggcggcggguggcggcuguccacacaguggcagaaaggagaggaagugcaaguaauugcggucgagccugguaagaaucccaaaaauuuccagacuaugcccggcaccuuucagacaaccacuggggaaaucggagccauagcacucgauuucaagccuggcaccagcgguucgccgaucauuaauagagaggggaaggugguuggacuguauggcaacggcguggucaccaaaaaugggggauacgugucagguaucgcucagacgaacgccgagccagacggccccacuccugaacuugaggaagagauguuuaagaaaaggaauuuaaccauuauggaucugcacccagggucuggaaagacacguaaauaucuccccgcuaucguucgcgaagcaauaaagcggagauugaggacccugauucucgccccuacucgaguggucgccgcugagauggaggaagcgcugaagggccuuccgauccgguaccaaacaaccgcaacgaaaagugagcauacuggucgcgaaaucguggaccugaugugccacgccacauucaccaugagauugcuaucccccguaagggugccaaacuauaaucugauuaucauggaugaggcucauuuuaccgacccugccagcauagcagcccggggguacauuucuacucgaguuggaaugggcgaagcugcggccaucuucaugacagcaacacccccaggcacagcugaugccuuuccucagagcaacgcacccauucaggacgaggagagagacaucccagaacgcuccuggaacucagggaacgaguggauaacugauuucgccggaaagacggucugguuugugccgaguauuaaagcugguaacgacaucgccaauugucucaggaagaacggcaaaaaggugauccaguuaagccguaagaccuucgauacagaauaccagaaaacuaagcugaaugacugggauuuugucguaaccacagacauuucugagaugggggcgaacuucaaagcagaucgggugaucgacccuagaaggugccuuaagcccguuauucugaccgauggaccagagcgcgugauacucgccggccccaugccugucacugcugccuccgcugcacagcgaagaggucggguggggaggaauccacagaaagaaaacgaccaguauaucuucacgggccaacccuugaauaacgaugaggaccacgcccacuggaccgaagcuaagaugcugcucgacaauauuaacacaccugagggaaucaucccggcccuguuugaaccagagcgcgagaagucagcagcgauugauggcgaauaccgucuuaaaggggagaguagaaagacuuucguugaacuaaugcggaggggagaccugcccgugugguuggcccauaaagucgcuagcgaggguauaaaguauaccgaucgcaaauggugcuuugacggccagcgaaauaaccagaucuuagaagagaauauggauguggagauuuggacaaaggaaggggagaaaaagaagcugagaccucgguggcucgacgccaggaccuacuccgauccccuggcacuuaaagaguucaaggacuuugcugccggacgcaaaucuaucgcacuggaucucguaacugagauuggcagagugccaucgcacuuggcccauaggacacggaacgcucuggacaaucuaguuaugcugcacacgagcgaacacggugggcgugcguaucgccaugccgucgaggagcucccugaaaccauggagacucuucuguuauugggccugaugauccuccugacaggaggcgcaaugcuuuuccugauaucagggaagggaaucgguaaaaccuccauuggccucaucugugugauugcuaguucugggauguuguggauggccgaaaucccccugcaguggauagccagcgcaauuguguuagaguuuuucaugaugguccuacugaucccagagccugaaaagcaacgaaccccgcaggauaaccagcucgcuuacguugugauuggaauccuuacacuggccgcgauaaucgcugccaaugagaugggcuugcuggaaacuacgaagagagaccucgguauguccaaagagcccgggguagugucaccaaccucuuaucuggaugucgaccuucacccugcaagcgccuggacacucuacgcuguggcaacuaccguuauuacacccaugcugaggcauaccaucgaaaacaguacugccaacguguccuuggcggcuauugccaaucaagcagucguacugaugggcuuagacaagggauggccaaucagcaaaauggaucuaggcgugccucugcucgcccuugggugcuacucucagguuaacccccugacguugacagcugccgugcugcuccugauaacccacuaugcaauuaucggaccgggccuucaggcuaaggccacucgggaggcgcagaaacgcaccgccgcagguaucaugaagaauccaacagucgacgggauuaugacuaucgauuuagacccugugauauacgauucaaaguuugagaaacaacugggacaggucaugcucuuggugcugugugcuguucagcuacugcucaugagaaccuccugggcccuuugcgaagcacugacauuggcuacgggccccauuaccacucugugggaggguaguccaggcaaguucuggaacacaaccaucgccgugagcauggccaauauuuuuagggggucguaucucgcgggagcuggccuggcauucucuaucaugaaauccguagggacuggaaagcggggcacagguagccagggggaaaccuuaggagagaaauggaagaagaaacuuaaccaacugucacgaaaggaauuugaccucuacaaaaagaguggcauaacggagguggauagaaccgaggccaaagaaggucuaaagcgcggcgagaucacacaucacgcugucucuaggggguccgccaaacugcagugguucguugaacggaauauggugauucccgagggacgugucaucgacuugggcugugggagaggaggcuggagcuauuacugcgcaggucugaagaaggugacugaaguaaggggguauaccaaaggaggcccuggccacgaggagccggugcccaugucaacauacggguggaacauuguuaagcucaugaguggaaaagauguguucuaccuuccaccugaaaagugugacacucuguugugcgauaucggugagagcucccccucuccuaccgucgaagagagccgcacaauucgggugcugaaaauggucgagccauggcucaagaauaaccaguuuuguaucaagguguuaaaucccuauaugccuaccguuauagaacaucuggagcgacuucagagaaaacacggcgggaugcugguaaggaacccacuaucccgcaauucaacucaugaaauguacuggauuucuaacggaacgggcaauaucguggccagugucaacauggugucgcggcuccuguugaacagauucacaaugacccaccguaggcccacuaucgagaaggacguugaucugggugcugggacccggcacgugaaugcggaaccggagacaccuaacauggacgucauuggagagcgcauaaaacgaaucaaggaagaacauaauagcacguggcacuaugacgaugaaaacccauacaaaaccugggccuaucauggcuccuacgaggugaaggcaacuggcucugcuucaagcaugauuaaugggguagugaagcuccuuacaaaacccugggacguugucccuauggugacccaaauggccaugacugauacaaccccauuuggacagcagagaguguucaaggaaaaagucgacacaaggacuccccgguccaugccggguacccgcagaguuaugggcaucacggcagaguggcuguggaggaccuuagggcgaaacaagaaaccucggcugugcacacgugaggaauuuacuaagaaggugagaaccaaugccgcuaugggagccguauucacagaggaaaaccaaugggauagugcgaaagcagccguggaggacgaagauuuuuggaaguuggucgaccgcgagagggagcuccacaaacugggcaagugugguucuugcguguauaauaugauggggaaacgggaaaagaaacuaggagaguucggcaaggcuaagggcagcagagccauuugguacauguggcuuggggcacgcuaccuggaauuugaggcucucggauuccugaacgaggaucauugguuuucaagggaaaauuccuauagugguguugagggcgaaggguugcacaaacugggauacauccuccgagacauaagcaagauccccggcggugccauguaugcugaugacacugccgggugggacacccggauuacggaggaugaccuucacaacgaagagaaaaucacacagcagauggauccagagcauagacagcuggcaaaugcgauuuucaaguuaaccuaccaaaacaaaguggucaaggugcagaggccuacucccacaggaaccguaauggacaucauaucucgcaaggaucagcguggcuccggccagguugggacuuauggacugaauaccuuuacaaacauggaagcccaauugauucggcagauggagggugaaggcgugcucucaaaagcugaccuggagaacccacaccuacccgaaaagaaaaucacgcaguggcuugagaccaagggggucgagagacugaaaaggauggccaucagcggagaugacugcguggugaagccuauugaugaccgcuucgcaaaugcucuccuggccuugaacgauaugggcaagguccgaaaagacauaccacaguggcaaccgucgaaggguuggcaugauuggcagcagguucccuucuguucucaccacuuucaugaauuaaucaugaaagacgggcggaagcuggugguaccuugcagaccacaggacgagcucauuggaagggcacgcaucagucaaggcgccggcuggucccuuagagaaacugcgugucuggggaaggcuuacgcccagauguggagccuaauguauuuccaccggagggaucugcgucucgcaucaaaugccauuugcuccgcugugcccguccauugggugccuacaucucgaaccacuuggagcauccacgcccaucaccaguggaugacaaccgaggacauguugacgguuuggaaccgcguguggauagaagauaauccauggauggaggacaagacacccgucaccacuugggaggaugugccuuaccugggaaagagagaagaccaauggugugguagucuuaucggccugaccucccgggcaacaugggcucagaacauuccgacugccauccagcagguaaggagccucauugggaaugaggaauuuuuagauuacaugccaucuaugaaacgcuucagaaaggaggaggaaucagagggagcgaucugguga

SEQ ID NO: 15367 - RNA, 9873 nt, Artificial Sequence
  derived and/or modified CDS sequence (opt3) from DENV-3__KJ189287__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccacccucccagaauauggaacucuuggccuggagugcucuccgcgaaccgguuuggacuucaaugagaugauccuacugacaaugaaaaacaaggcguggauggugcauagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcacacagcucucaccggcgccacagaaauccagaauucagggggaacuaguauuuucgcaggucaucugaagugucgguuaaaaauggacaagcuggagcuaaaaggcaugagcuacgccaugugcaccaacacguuugugcucaagaaagaggucucugaaacccagcacgggacaauacugaucaagguggaguacaagggagaagaugcucccuguaaaauuccuuucuccacugaggacggccaugguaaggcgcacaacgggcgucuuaucaccgcaaauccaguugugacaaaaaaggaggaacccguaaacauagaggccgaaccgccuuucggcgagucaaauauugucaucggaaucggcgauaacgcuuugaaaauuaauugguauaagaaggggagcaguaucggaaaaauguuugaagccacugcacgcggugccagaaggauggcuauucugggcgacaccgccugggauuucgggucugugggaggcguucucaacucccuggguaagauggugcaucaaauauuugggagcgcauacacggcgcuuuucucgggcgucucuugggugaugaaaaucggaauuggcguacuguugacauggaucgggcucaauuccaagaacaccucaaugaguuuuagcugcaucgcuauuggaauaaucacucuguauuuaggcgccgugguucaggcagacauggguugugucauuaauuggaaagggaaggagcugaagugcggauccggcaucuucgugacaaacgaggugcacaccuggacugaacaguacaaauuucaggccgauucucccaagcggcuagcuaccgccauugcaggugcuugggagaauggcgucugugggauccgaagcacaacgcgcauggaaaaccuccuguggaaacaaauagccaaugagcuuaacuauaucuugugggaaaauaacauuaagcugaccguuguggugggagacaucauuggcauccucgagcaggggaaaagaacucugacaccacagccuauggaguuaaaguacucauggaaaaccuggggaaaggcgaagauaguaacagccgaaacucagaacaguuccuucauuaucgauggccccaauaccccagagugccccagcgcuucuagggcauggaacgucugggaaguggaggacuaugguuuugggguuuucacgacaaauauuuggcugcggcuucgcgaaguguacacccaauugugugaccacagacucaugucagccgcugucaaagaugagagggccgugcaugcagacaugggauacuggaucgagagucagaagaacggcagcuggaaacuggaaaaggcgucccuaauagagguuaaaacuugcaccuggccuaagucucacacacuguggucgaauggugugcucgaaagcgauaugaucauuccaaagucccuggccggcccgaucucacagcauaaccaccgucccggguaucacacucagaccgcuggaccuuggcaucuuggcaaauuggagcuggacuuuaauuacugcgaggggacaacgguagucauuaccgaaaacuguggaacucggggcccaaguuuacgaacaaccacugugucugguaagcucauccacgaguggugcuguagaagcugcacacugcccccucuuagguauaugggggaagauggauguugguacggcauggagauacgcccaauuuccgaaaaagaggagaauauggugaagucacuggucagcgccgguucuggcaaaguugacaacuucaccauggggguguugugccucgcaauccuguuugaagagguaaugcggggaaaguucggcaagaaacauaugaucgcugggguguucuuuacguucguccuacugcucuccggacaaauuacuuggagaaauauggcccacacccugaucaugauuggcaguaacgcaagcgauaggauggguaugggggugacauaucuugccuugauagcuaccuuuaagauccagcccuuccugguuuuaggauuuuuccuccgcaaacugacuucucgagaaaaucuucugcuaggcgugggccucgcgauggccacaacccugcaguugccggaggacauugaacaaauggcaaacgggaucgcucugggauuaauggcccucaagcugauuacacaguuugagacuuaccagcuuuggaccgcccugaucuccuugacguguucaaauacaauauucacccucacugucgcuuggcggaccgcaacacugauccuagccggugugagucugcuuccuguuugccagagcucguccaugcguaaaacugauuggcucccaauggcgguggcugccaugggcguccccccucugcccuuguuuauuuucucucugaaggacaccuuaaagagaaggagcuggccacucaacgaggggguaauggcagugggacugguuucaauccuugccaguucccuguugcgcaacgaugugccuauggcuggcccccucgucgcaggugggcugcuaauugccuguuaugugaucacgggaacaucugcggaccugaccguagaaaaagcugccgauauaacuugggaggaagaggcagaacaaacaggcgugagccauaaucuuaugauuaccgucgacgacgauggcacuaugcggaucaaggacgaugagacagagaacauccucaccguucuguugaaaacggccuuacugauuguguccgggauauuuccauacucaaucccggcuacucuccugguguggcacaccuggcagaagcagacacagagaagcggaguccuuugggacgugccuagucccccagaaacccaaaaagccgagcuggaagaggguguuuacaggauuaagcagcagggcaucuucgggaaaacacagguaggagugggcguccaaaaggaggguguguuucacacuauguggcauguuacccgaggggcaguguugacguauaauggaaagcgccuagaacccaacugggcuucugucaaaaaggaucugauuuccuacggcggcggguggcggcucagcacacaguggcagaaaggagaggaagugcaaguaaucgccgucgagccugguaagaauccaaaaaacuuccagacuaugcccggcaccuuccagacaaccacuggggaaauaggagcgaucgcccuggacuuuaagccuggcaccucggguucaccgauuaucaauagagaggggaaggugguuggacuuuauggcaacggcguggucacaaaaaaugggggauacgugucugguauugcacagacgaacgcugagccagauggccccacuccugaauuagaggaagagauguucaagaaaaggaaucugaccaucauggaccuccacccagggaguggaaagacacguaaauauuugcccgccauaguucgcgaagcuauuaagcggagacugaggacccucauccuggcaccuacucgaguggucgccgccgagauggaggaagcucuuaagggccugccgauccgguaccaaacaaccgcgacgaaauccgagcauacuggucgcgaaauuguggauuugaugugccacgcaacauuuaccaugagacuacugagccccguaagggugccaaacuauaaucucaucauaauggacgaggcccauuucaccgauccugcuucuauugccgcacggggguacaucagcacucgaguuggaaugggcgaagccgcugcgauuuuuaugacagccacccccccaggcacagcagacgcuuucccucaguccaacgcccccauccaggaugaggagagagacauaccagaacgcucauggaauagugggaacgaguggauuacugacuuugcaggaaagacggucugguucgugccgagcaucaaagccgguaacgauaucgcuaauuguuuaaggaagaacggcaaaaaggugauucagcugucucguaagaccuuugacacagaauaccaaaaaacuaagcuuaaugauugggacuucgucguaaccacagauaucuccgagaugggggccaacuuuaaagcggaccgggugauugauccuagaaggugccugaagcccguuauacucaccgacggaccagagcgcgugaucuuggcaggccccaugccugucacugccgcuucagccgcucagcgaagaggucggguggggaggaauccacagaaagaaaacgaucaguauauuuucacgggccaaccccugaauaacgacgaggaucacgcacacuggaccgaagccaagaugcuccuggacaauaucaacacaccugagggaaucauuccggcucuuuucgaaccagagcgcgagaagagugccgcaauagacggcgaauaccgucuaaaaggggagagcagaaagacuuuuguugaacugaugcggaggggagauuugcccgugugguuagcgcauaaagucgccuccgaggguaucaaguauaccgaccgcaaauggugcuucgauggccagcgaaauaaccagauucuggaagagaauauggacguggagaucuggacaaaggaaggggagaaaaagaagcucagaccucgguggcuggaugcuaggaccuacucugacccccuugcccugaaagaauuuaaggauuucgcagcuggacgcaaaucgauugcccucgacuugguaacugagaucggcagagugccaagccaccuggcacauaggacacggaacgcccuagauaaucugguuaugcuccacacgucagaacacggugggcgugcuuaucgccaugcggucgaggagcuuccugaaaccauggagacucuguuauugcugggccucaugauacugcuuacaggaggcgccaugcuguuucucaucuccgggaagggaauugguaaaaccaguaucggcuugauuugugugaucgcaucuagcgggaugcuguggauggcugaaauacccuuacaguggauugccuccgccaucgugcuagaguucuuuaugaugguccugcucauuccagagccugaaaagcaacgaaccccgcaggacaaccagcuugcauacguugugaucggaauacugacauuggcugccaucauugcggcuaaugagaugggccugcucgaaacuacgaagagagaucuggguaugucaaaagagcccgggguagugucuccaaccagcuaucuugacgucgaucuccacccugccagugcauggacacuguacgccguggcuacuaccguuaucacacccauguugaggcauaccauugaaaacuccacugcaaacgugagccuggccgcgaucgcuaaucaagccgucguauuaaugggccuagacaagggauggccaauaucuaaaauggaccugggcgugccucuccuugcacuggggugcuacucacagguuaaccccuugacgcugacagccgcugugcuccugcuuauuacccacuaugccaucaucggaccgggcuuacaggcaaaggcuacucgggaggcccagaaacgcaccgcggccgguauuaugaagaauccaacagucgaugggaucaugacuauagaccuggauccugugauuuacgacuccaaguucgagaaacaacucggacaggucauguugcuggugcuaugugcaguucagcugcuccuuaugagaaccaguugggcucugugcgaagccuugacacuggcaacgggccccaucaccacucucugggaggguagcccaggcaaguuuuggaacacaaccauugcugugucgauggccaauaucuucagggggucuuaucuggccggagcgggcuuagcuuuuuccauaaugaaaagcguagggacuggaaagcggggcacagguucacagggggaaacccuuggagagaaauggaagaagaaacugaaccaacucagucgaaaggaauucgaucuauacaaaaagucuggcaucacggagguggacagaaccgaggcaaaagaaggucugaagcgcggcgagauuacacaucacgccgucuccagggggagcgcuaaauugcagugguuuguugaacggaauauggugauccccgagggacgugucauugaucugggcugugggagaggaggcuggucauauuacugcgccggucucaagaaggugacugaaguaaggggguauaccaaaggaggcccuggccacgaggagccggugcccaugaguacauacggguggaacaucguuaagcuuaugagcggaaaagacguguucuaccugccaccugaaaagugugauacuuugcugugcgacauuggugaguccucucccagcccuaccgucgaagagucccgcacaauccgggugcucaaaauggucgagccaugguuaaagaauaaccaguucuguauaaaggugcugaaucccuauaugccuaccguuauugaacaucuugagcgacugcagagaaaacacggcgggaugcuaguaaggaacccacucucacgcaauucuacucaugaaauguacuggaucaguaacggaacgggcaauaucguggcaucggucaacauggugagccggcuguugcugaacagauuuacaaugacccaccguaggcccacuauugagaaggauguugaccucggugccgggacccggcacgugaaugcugaaccggagacaccuaacauggaugucauaggagagcgcaucaaacgaauuaaggaagagcauaauuccacguggcacuaugacgacgaaaacccauacaaaaccugggcguaucauggcucuuacgaggugaaggccacuggcucagcaagcuccaugaucaaugggguagugaagcuucugacaaaacccugggauguugucccuauggugacccaaauggcuaugacugacacaaccccauucggacagcagagaguguuuaaggaaaaagucgauacaaggacuccccggaguauggccgguacccgcagaguuaugggcauuacggcagagugguuauggaggacccuggggcgaaacaagaaaccgcgguugugcacacgugaggaauucacuaagaaggugagaaccaaugccgcuaugggagccguauuuacagaggaaaaccaaugggacucugcgaaagcagccguggaggaugaagacuucuggaagcucgucgaucgcgagagggagcugcacaaacuaggcaagugugguagcugcguguauaauaugauggggaaacgggaaaagaaacuuggagaguuuggcaaggcuaagggcucaagagccaucugguacauguggcugggggcacgcuaccucgaauucgaggcucugggauuuuugaacgaggaccauugguucuccagggaaaauaguuauagcgguguugagggcgaagggcugcacaaacucggauacauacuucgagauaucucuaagauuccuggcggugccauguaugcugacgauacugccgggugggacacccggaucacggaggacgaucugcacaacgaagagaaaauuacacagcagauggaccccgagcauagacaguuagcaaaugcgaucuuuaagcugaccuaccaaaacaaaguggucaaggugcagaggccaacuccuacaggaaccguaauggauauaauuucccgcaaggaccagcguggcucaggccagguugggacuuauggauugaauaccuucacaaacauggaagcccaacucauccggcagauggagggugaaggcgugcugagcaaagcugaucuagagaacccccaccuuccagaaaagaaaaucacgcaguggcuggagaccaagggggucgagagacucaaaaggauggccauuucgggagacgauugcguggugaagcccauagacgaucgcuuugcaaaugcucuguuggccuuaaacgacaugggcaagguccgaaaagauaucccucaguggcaaccaucuaaggguuggcaugacuggcagcagguuccguucuguagucaccacuuccaugaacugauuaugaaagaugggcggaagcucgugguacccugcagaccucaggacgagcuuaucggaagggcacgcauuucccaaggcgccggcuggagccugagagaaacugcgugucuagggaaagcuuacgcccagauguggucacugauguauuuucaccggagggaccuccguuuggcauccaaugccaucugcucugcugugccaguccauugggugcccacaagccgaaccacuuggaguauacacgcccaucaccaguggaugacaaccgaggauaugcugacgguuuggaaccgcguguggaucgaagacaauccuuggauggaggauaagacaccagucaccacuugggaggacgugcccuaccuuggaaagagagaagaucaauggugugguucccugauuggccucaccagccgggcaacaugggcucagaacaucccuacugccauucagcagguaaggucuuuaaucgggaaugaggaauuccuggacuacaugccgucaaugaaacgcuuuagaaaggaggaggaaagugagggagcgauuugguga

SEQ ID NO: 15368 - RNA, 9873 nt, Artificial Sequence
  derived and/or modified CDS sequence (opt3) from DENV-3__KJ189288__SS-prME
accagccugugccucaugaugauccuucccgccgcucuggcauuccacuugacauccagagacggcgagccuaggaugauuguggggaagaacgaacggggaaaaucuuuacuguuuaagacugccucagguacgaauauguguacccuaauagcgauggaucucggcgagaugugcgacgauacagucacuuacaaauguccacauaucaccgaaguugagccggaagacauugauugcugguguaaccugacaaguaccugggugacuuaugggacaugcaaucaggcuggagagcaccgccgagacaagcguagcguagcccuugcaccccaugugggcaugggucuggauaccagaacgcaaacuuggauguccgccgagggggcuuggaggcaggucgaaaaaguggagaccugggcauugcggcacccuggauucacaauccucgcccuguuucuggcucauuacauuggcacuucucucacccagaagguugugaucuucauauuacugaugcuugucacaccaucgaugaccaugcgcugugugggcguagggaacagagacuuuguugaaggauugucaggugccacguggguggaugucgugcuggagcacggcgggugcgugacuacaauggcgaagaauaaacccacccuagacaucgagcuccagaagacugaagcaacacaacuggccacccuuaggaaacuguguauugagggaaagaucacgaacauuaccacagauagccggugcccuacucagggcgaagcugucuugccagaggaacaggaccagaauuauguuuguaaacacaccuacguggaucgcgguugggggaacggaugcggccucuucggcaaggggagucugguaacaugcgccaaguuucaauguuuagagcccaucgagggaaaaauggugcaguaugaaaaucugaaguacacugucauaauuaccgugcauacaggugaccagcaccagguuggcaacgagacccaaggggugacugcagaaaucacgccucaggcuuccacaaccgaggccacucucccagaauauggaacccuuggccuggagugcucuccgcgaacagguuuggacuucaaugagaugauucuacugaccaugaaaaacaaggcguggaugguccauagacagugguuuuucgaucucccccugccuuggacuagcggggccacaacggaaaccccaacuuggaauaggaaagagcuucuggugacauuuaagaacgcacacgcuaaaaagcaagaaguaguuguguugggcucccaggagggagccaugcacaccgcucucacaggcgccacugaaauccagaauucagggggaaccaguaucuucgcaggucaucugaagugucgguuaaaaauggacaagcuggagcuaaaaggcaugagcuacgccaugugcacgaacaccuuuguccucaagaaagaggugucugaaacacagcacgggacuauucugauaaaggucgaguacaagggagaagaugcucccuguaaaaucccuuucuccaccgaggacggccaugguaaggcgcacaacgggcgucuuauuacagcaaauccagugguuacuaaaaaggaggaacccgugaacaucgaggccgaaccgccuuucggcgagucaaauauaguaauuggaaucggcgauaacgcuuugaaaaucaauugguauaagaaggggagcaguauuggaaaaauguuugaagccaccgcacgcggugccagaaggauggcuauccugggcgacacggccugggauuucgggucugucggaggcgugcucaacucccuggguaagaugguucaucaaauuuuugggagcgcauacacagcgcuuuucucgggcgugucuugggucaugaaaauaggaaucggcgugcuguugaccuggauugggcucaauuccaagaacacuucaaugaguuuuagcugcaucgcuaucggaauuauaacacuguauuuaggcgccguagugcaggcagacauggguuguguuaucaauuggaaagggaaggagcugaagugcggauccggcauuuucgucaccaacgaggugcacacuuggaccgaacaguacaaauuucaggccgauucucccaagcggcuagcuacagccaucgcaggugcuugggagaauggcgugugugggauucgaagcacgacccgcauggaaaaccuccuguggaaacaaaucgccaaugagcuuaacuauauauugugggaaaauaacgucaagcugacuguuguggugggagacaucauuggcguacucgagcaggggaaaagaacacugaccccacagccuauggaguuaaaguacucauggaaaacauggggaaaggcgaagaucgucacugccgaaacccagaacaguuccuucauuaucgauggccccaauacgccagagugccccagcgcuucuagggcauggaacgugugggaaguugaggacuaugguuuugggguguucacaaccaauauauggcugcggcuucgcgaagccuacacucaauugugugaccacagacucaugucagcugccgucaaagaugagagggcagugcaugcggacaugggauacuggauugagagucagaagaacggcagcuggaaacuggaaaaggccucccuaaucgagguuaaaaccugcacauggccuaagucucacacucuguggucgaauggugugcucgaaagcgauaugauuaucccaaagucccuggcuggcccgauaucacagcauaaccaccgucccggguaucacacccagacagccggaccuuggcaucuuggcaaauuggagcuggacuuuaauuacugcgaggggacgaccguagucaucacugaaaacuguggaacacggggcccaaguuuacgaaccacuacagugucugguaagcucauucacgaguggugcuguagaagcugcacccugcccccucuuagguauaugggggaagauggauguugguacggcauggagauccgcccaauuuccgaaaaagaggagaauauggugaagucacuggucagcgcagguucuggcaaaguugacaacuucacgauggggguguugugccucgcuauccuguuugaagagguaaugcggggaaaguucggcaagaaacauaugauagccgggguguucuuuacuuucguccuacugcucuccggacaaauuaccuggagagauauggcacacacacugaucaugaucggcaguaaugccagcgacaggauggguaugggggugaccuaucuugcuuugauugcgacuuuuaagauccagcccuuccuggccuuaggauuuuuccuccgcaaacugacaucucgagaaaaccuucugcuaggcguuggccucgcaauggcuaccacacugcaguugccggaggauauugaacaaauggccaaugggauagcccugggauuaauggcucucaagcugaucacucaguuugagaccuaccagcuuuggacggcacugauuuccuugacauguucaaacaccaucuucacucucaccguggccuggcggacagcgacucugauucuagcuggugucagucugcuuccugugugccagagcucguccaugcguaaaaccgacuggcucccaauggccguugcagccaugggcgugcccccucugcccuuguuuaucuucucucugaaggauacguuaaagagaaggagcuggccacucaaugagggggucauggcuguaggacuggugucaauacuugcaaguucccuguugcgcaacgacguuccuauggccggcccccucguggcgggugggcugcuaaucgcuuguuaugucauuacaggaaccucugccgaucugacuguggaaaaagcagccgacaucacaugggaggaagaggcugaacaaaccggcguaagccauaaccuuaugauuacuguggacgaugacggcacaaugcggaucaaggaugacgagaccgagaauauacucacgguccuguugaaaacugccuuacugauuguuuccgggaucuuuccauacucaaucccggcaacccuccugguguggcacacauggcagaagcagacccagagaagcggagugcuuugggaugucccuagucccccagaaacacaaaaagcugagcuggaagaggguguguacaggauuaagcagcagggcauauucgggaaaacucagguuggaguaggcgugcaaaaggagggugucuuucacaccauguggcaugugacgcgaggggccguuuugacauauaacggaaagcgccuagaacccaauugggcgucugugaaaaaggaccugaucuccuacggcggcggguggcggcucagcacucaguggcagaaaggagaggaaguccaagugauugccguagagccugguaagaacccaaaaaauuuccagaccaugcccggcacauuccagaccacuaccggggaaaucggagcaauugcucuggauuuuaagccuggcacaucggguucaccgaucauaaacagagaggggaaggucgugggacuuuauggcaauggcguugugacgaaaaacgggggauacgucucugguaucgcccagacuaaugcugagccagacggccccaccccugaauuagaggaagagauguucaagaaaaggaaccugacaauuauggaucuccacccagggaguggaaagacccguaaauauuugcccgcaaucgugcgcgaagccauuaagcggagacugaggacucucauccuggccccuacacgaguuguggcugcggagauggaggaagcacuuaagggccugccgauacgguaccaaaccacggccacuaaauccgagcauacaggucgcgaaauugucgacuugaugugccacgcuaccuuuaccaugagacuacugagccccgugaggguaccaaauuauaaccucaucaucauggaugaggcccauuucacugacccugcaucuauugccgcucggggguacaucagcacacgagugggaaugggcgaagcggccgcaauauuuaugaccgcuacacccccaggcacugccgaugcauucccucaguccaaugcccccauucaggacgaggagagagacaucccagaacgcucauggaacagugggaaugaguggauuacggauuuugcuggaaagaccguuugguucgucccgagcaucaaagccgguaacgacauagcgaacuguuuaaggaagaauggcaaaaaggugauucagcugucucguaagacauuugauacugaauaccaaaaaaccaagcuuaacgacugggauuucguggucacaaccgacaucuccgagaugggggcaaauuuuaaagccgaucggguaaucgacccuagaaggugccugaagcccgugauucucacugauggaccagagcgcguuaucuuggcuggccccaugccugugacggccgcuucagcagcccagcgaagaggucgggucgggaggaacccacagaaagaaaaugaccaguauauuuucaccggccaaccccugaacaaugaugaggaccacgcucacuggacagaagccaagaugcuccuggacaacauaaauacuccugagggaaucauuccggcacuuuucgaaccagagcgcgagaagagugcggccaucgauggcgaauaccgucuaaaaggggagagcagaaagaccuuuguggaacugaugcggaggggagacuugcccguuugguuagcucauaaaguggccuccgaggguaucaaguauacagaucgcaaauggugcuucgacggccagcgaaacaaucagauucuggaagagaacauggaugucgagauauggaccaaggaaggggagaaaaagaagcucagaccucgguggcuggacgcaaggacuuacucugauccccuugcucugaaagaauuuaaggacuucgccgcaggacgcaaaucgaucgcccucgauuuggugacagagauuggcagaguaccaagccaccuggcucauaggacgcggaaugcgcuagacaaccuggugaugcuccacaccucagaacacggugggcgugccuaucgccaugcaguugaggagcuuccugaaacuauggagacacuguuauugcugggccucaugauccugcuuaccggaggcgcuaugcuguuucucauuuccgggaagggaaucgguaaaaccaguauaggcuugaucugugucauugccucuagcgggaugcuguggauggccgaaauccccuuacaguggauugcauccgcuaucgugcuagaguucuuuaugauggugcugcucgucccagagccugaaaagcaacgaacaccgcaggauaaucagcuugccuacguugugauaggaauucugacuuuggcggcuaucauugccgcaaacgagaugggccugcucgaaacgaccaagagagaccuggguaugucaaaagagcccgggguagugucuccaacaagcuaucuugaugucgaccuccacccugccagugcuuggacucuguacgcaguggccaccacaguuaucacccccauguugaggcauacuauagaaaauuccacggcgaacgugagccuggcugccaucgcaaaccaagccgucguauuaaugggccuagacaagggauggccaauuucuaaaauggaucugggcgugccucuccuugcucuggggugcuacucacagguuaaucccuugacacugaccgccgcagugcuccugcuuaucacucacuaugcuauuaucggaccgggcuuacaggccaaggcgacccgggaggcccagaaacgcacagcagcugguauaaugaagaacccaacugucgacgggauuaugaccaucgaucuggacccugugaucuacgauuccaaguucgagaaacaacucggacaggucauguugcuggugcuaugugccguucagcugcuccuuaugagaacaaguugggcacugugcgaagcuuugacgcuggccaccggccccauuacuacacucugggaggguagcccaggcaaguuuuggaauaccacuaucgccgugucgauggcgaacauauucagggggucuuaucuggcuggagcaggcuuagccuuuuccauuaugaaaagcguagggacaggaaagcggggcaccgguucacagggggaaacgcuuggagagaaauggaagaagaaacugaaucaacucagucgaaaggaauucgaccuauacaaaaagucuggcaucaccgagguggauagaacagaggcuaaagaaggucugaagcgcggcgagauuacucaucacgccgucuccagggggagcgcaaaauugcagugguuuguugaacggaacauggugauccccgagggacgugucauagaccugggcugugggagaggaggcuggucauauuacugcgccggucucaagaaggugaccgaaguaaggggguauacaaaaggaggcccuggccacgaggagccggugcccaugaguacuuacggguggaauaucguuaagcuuaugagcggaaaagauguguucuaccugccaccugaaaagugugacaccuugcugugcgauauuggugaguccucucccagcccuacagucgaagagucccgcaccauccgggugcucaaaauggucgagccaugguuaaagaacaaucaguucuguauuaaggugcugaaccccuauaugccuacuguuaucgaacaucuugagcgacugcagagaaaacacggcgggaugcuaguaaggaauccacucucacgcaacucuacgcaugaaauguacuggauuaguaauggaacaggcaacaucguggcuucggucaauauggugagccggcuguugcugaacagauuuaccaugacucaccguaggcccaccauagagaaggacguugaucucggugcggggacacggcacgugaacgccgaaccggagacgccuaauauggacgucauuggagagcgcaucaaacgaaucaaggaagagcauaacuccaccuggcacuaugacgaugaaaauccauacaaaacuugggcauaucauggcucuuacgaggugaaggcuacaggcucagccagcuccaugauuaacgggguagugaagcuucugaccaaacccugggacguugucccuauggugacucaaauggcaaugacagauaccacaccauucggacagcagagaguguuuaaggaaaaagucgacacuaggaccccccggaguaugccggguacgcgcagaguuaugggcauaaccgccgagugguuauggaggacacuggggcgaaauaagaaaccucgguugugcacucgugaggaauucaccaagaaggugagaacaaacgcugccaugggagcgguauuuacugaggaaaaucaaugggauucugcaaaagccgcuguggaggacgaagauuucuggaagcucgucgaccgcgagagggagcugcacaaacuaggcaagugugguagcugcguguauaacaugauggggaaacgggaaaagaaacuuggagaguuuggcaaggccaagggcucaagagcaaucugguacauguggcugggggcucgcuaccucgaauucgaggcccugggauuuuugaaugaggaucauugguucuccagggaaaacaguuauagcgguguugagggcgaagggcugcacaaacucggauacauucuucgagacaucucuaagauucccggcggugcuauguaugccgaugacaccgcagggugggacacgcggaucacagaggaugaccugcacaaugaagagaaaauaacccagcagauggauccagagcauagacaguuagcgaacgccaucuuuaagcugacuuaccaaaauaaaguggucaaggugcagaggccuacacccaccggaacuguaauggacauuaucucccgcaaggaucagcguggcucaggccagguugggaccuauggauugaacacauucacgaauauggaagcucaacucauucggcagauggagggugaaggcgugcugagcaaagccgaccuagagaacccacaccuucccgaaaagaaaaucacccaguggcuggagacuaagggggucgagagacucaaaaggauggcaauaucgggagaugacugcguggugaagccuauugaugaccgcuuugcuaacgcccuguuggcauuaaaugauaugggcaagguccgaaaagacaucccacaguggcaaccgucuaaggguuggcaugauuggcagcagguucccuucuguagucaccacuuccaugaacugaucaugaaagacgggcggaagcucgugguaccuugcagaccacaggacgagcuuauuggaagggcccgcauaucccaaggcgcgggcuggagccugagagaaacagcuugucuagggaaagccuacgcacagauguggucacugauguauuuucaccggagggaucuccguuuggccuccaacgcuaucugcucugccgugcccguccauugggugccuaccagccgaacuacauggaguauucacgcacaucaccaguggaugaccacggaggacaugcugacaguuuggaaucgcguguggaucgaagauaacccauggauggaggacaagacccccgucacuaccugggaggaugugccuuaccuuggaaagagagaagaccaauggugugguucccugauuggccucacaagccgggcuacuugggcccagaauaucccgaccgcgauacagcagguaaggucuuuaaucgggaacgaggaauuccuggauuacaugccaucaaugaaacgcuuuagaaaggaggaggaaagugagggagcuauuugguga

SEQ ID NO: 15369 - RNA, 9873 nt, Artificial Sequence
  derived and/or modified CDS sequence (opt3) from DENV-3__KJ189289__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccacccucccagaauauggaacucuuggccuggagugcucuccgcgaaccgguuuggacuucaaugagaugauccuacugacaaugaaaaacaaggcguggauggugcauagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcacacagcucucaccggcgccacagaaauccagaauucagggggaacuaguauuuucgcaggucaucugaagugucgguuaaaaauggacaagcuggagcuaaaaggcaugagcuacgccaugugcaccaacacguuugugcucaagaaagaggucucugaaacccagcacgggacaauacugaucaagguggaguacaagggagaagaugcucccuguaaaauuccuuucuccacugaggacggccaugguaaggcgcacaacgggcgucuuaucaccgcaaauccaguugugacaaaaaaggaggaacccguaaacauagaggccgaaccgccuuucggcgagucaaauauugucaucggaaucggcgauaacgcuuugaaaauuaauugguauaagaaggggagcaguaucggaaaaauguuugaagccacugcacgcggugccagaaggauggcuauucugggcgacaccgccugggauuucgggucugugggaggcguucucaacucccuggguaagauggugcaucaaauauuugggagcgcauacacggcgcuuuucucgggcgucucuugggugaugaaaaucggaauuggcguacuguugacauggaucgggcucaauuccaagaacaccucaaugaguuuuagcugcaucgcuauuggaauaaucacucuguauuuaggcgccgugguucaggcagacauggguugugucauuaauuggaaagggaaggagcugaagugcggauccggcaucuucgugacaaacgaggugcacaccuggacugaacaguacaaauuucaggccgauucucccaagcggcuagcuaccgccauugcaggugcuugggagaauggcgucugugggauccgaagcacaacgcgcauggaaaaccuccuguggaaacaaauagccaaugagcuuaacuauaucuugugggaaaauaacauuaagcugaccguuguggugggagacacuaucggcguacucgagcaggggaaaagaacacugaccccacagccuauggaguuaaaguacucauggaaaacauggggaaaggcgaagauugucacugccgaaacccagaacaguuccuucaucauagauggccccaauacgccagagugccccagcgcuucuagggcauggaacgugugggaaguugaggacuaugguuuugggguguucacaaccaauauuuggcugcggcuucgcgaagucuacacucaauugugugaccacagacucaugucagccgcugugaaagaugagagggccguucaugcagacaugggauacuggaucgagagucagaagaacggcagcuggaaacuggaaaaggcgucccuaauugaggugaaaaccugcacauggccuaagucucacacucuguggucgaaugguguacucgaaagcgauaugaucauaccaaagucccuggccggcccgaucucacagcauaaccaccgucccggguaucacacccagacagcuggaccuuggcaucuuggcaaauuggagcuggacuuuaauuacugcgaggggacgaccgucgugauuacugaaaacuguggaacacggggcccaaguuuacgaaccacuacagugucugguaagcucauccacgaguggugcuguagaagcugcacccugcccccucuuagguauaugggggaagauggauguugguacggcauggagauucgcccaaucuccgaaaaagaggagaauauggucaagucacugguuagcgccgguucuggcaaaguggacaacuucacgauggggguauugugccucgcaauacuguuugaagaggugaugcggggaaaguucggcaagaaacauaugauugcuggggucuucuuuacuuucgugcuacugcucuccggacaaaucaccuggagagauauggcccacacacugaucaugauuggcaguaaugcaagcgacaggauggguauggggguuaccuaucuugccuugaucgcuacuuuuaagauucagcccuuccuggcguuaggauuuuuccuccgcaaacugacaucucgagaaaaccuucugcuaggcgugggccucgccauggcaaccacacugcaguugccggaggauauagaacaaauggcuaaugggaucgcccugggauuaauggcccucaagcugauuacucaguuugagaccuaccagcuuuggacggcucugaucuccuugacauguucaaacaccauuuucacucucaccgucgcauggcggacagccacucugauccuagcgggugugagucugcuuccuguuugccagagcucguccaugcguaaaaccgacuggcucccaauggcuguggccgcaaugggcguccccccucugcccuuguuuauauucucucugaaggauacguuaaagagaaggagcuggccacucaaugaggggguaauggccgugggacugguuucaauccuugcuaguucccuguugcgcaacgacgugccuauggcaggcccccucgucgccggugggcugcuaauugcguguuaugugaucacaggaaccucugcugaucugacuguagaaaaagccgcagacauuacaugggaggaagaggccgaacaaaccggcgugagccauaaccuuaugaucacugucgacgaugacggcacaaugcggauaaaggaugacgagaccgagaauauucucacgguucuguugaaaacugcuuuacugaucguguccgggaucuuuccauacucaauuccggccacccuccugguguggcacacauggcagaagcagacccagagaagcggaguccuuugggaugugccuagucccccagaaacacaaaaagcagagcuggaagaggguguuuacaggauaaagcagcagggcaucuucgggaaaacucagguaggagugggcguccaaaaggaggguguguuucacaccauguggcauguuacgcgaggggcuguguugacauauaacggaaagcgccuagaacccaauugggccucugucaaaaaggaccugauuuccuacggcggcggguggcggcucagcacucaguggcagaaaggagaggaagugcaaguaaucgcggucgagccugguaagaacccaaaaaauuuccagaccaugcccggcacauuccagaccacuaccggggaaauuggagccaucgcacuggauuuuaagccuggcacaucggguucaccgauaaucaacagagaggggaaggugguuggacuuuauggcaauggcguggucacgaaaaacgggggauacgugucugguauugcucagacuaaugccgagccagacggccccaccccugaauuagaggaagagauguucaagaaaaggaaccugacaaucauggaucuccacccagggaguggaaagacccguaaauauuugcccgcuauuguucgcgaagcaaucaagcggagacugaggacucucauacuggccccuacacgaguggucgccgcugagauggaggaagcgcuuaagggccugccgauucgguaccaaaccacggcaacuaaauccgagcauacaggucgcgaaaucguggacuugaugugccacgccaccuuuaccaugagacuacugagccccguaagggugccaaauuauaaccucaucauuauggaugaggcucauuucacugacccugccucuaucgcagcccggggguacauaagcacacgaguuggaaugggcgaagcugcggccauuuuuaugaccgcaacacccccaggcacugcugaugccuucccucaguccaaugcacccauccaggacgaggagagagacauuccagaacgcucauggaacagugggaaugaguggaucacggauuuugccggaaagaccgucugguucgugccgagcauaaaagcugguaacgacauugccaacuguuuaaggaagaauggcaaaaaggugauccagcugucucguaagacauuugauacugaauaccaaaaaaccaagcuuaacgacugggauuucgucguaacaaccgacaucuccgagaugggggcgaauuuuaaagcagaucgggugauugacccuagaaggugccugaagcccguuauccucacugauggaccagagcgcgugauuuuggccggccccaugccugucacggcugccucagcugcacagcgaagaggucggguggggaggaacccacagaaagaaaaugaccaguauauauucaccggccaaccccugaacaaugaugaggaccacgcccacuggacagaagcuaagaugcuccuggacaacaucaauacuccugagggaauuaucccggcccuuuucgaaccagagcgcgagaagagugcagcgaucgauggcgaauaccgucuaaaaggggagagcagaaagaccuuuguugaacugaugcggaggggagacuugcccgugugguuagcccauaaagucgcuuccgaggguauuaaguauacagaucgcaaauggugcuucgacggccagcgaaacaaucagauacuggaagagaacauggauguggagaucuggaccaaggaaggggagaaaaagaagcucagaccucgguggcuggacgccaggacuuacucugauccccuugcacugaaagaauuuaaggacuucgcugccggacgcaaaucgauugcacucgauuugguaacagagaucggcagagugccaagccaccuggcccauaggacgcggaaugcucuagacaaccugguuaugcuccacaccucagaacacggugggcgugcguaucgccaugccgucgaggagcuuccugaaacuauggagacacuguuauugcugggccucaugauucugcuuaccggaggcgcaaugcuguuucucaucuccgggaagggaauagguaaaaccaguaucggcuugauuugugugaucgcuucuagcgggaugcuguggauggccgaaauucccuuacaguggaucgccuccgcaauagugcuagaguucuuuaugaugguccugcucauuccagagccugaaaagcaacgaacaccgcaggauaaucagcuugcuuacguugugaucggaauucugacuuuggccgcgaucauagcugccaacgagaugggccugcucgaaacgaccaagagagaccuggguaugucaaaagagcccgggguagugucuagcacaaguuaucuugaugucgaccuccacccagcauccgccuggacucuguacgcuguggcaaccacaguuaucaccccuauguugaggcauacuauugaaaauagcacggccaacgugucucuggcggcuaucgccaaccaagcagucguauuaaugggccuagacaagggauggcccauuucaaaaauggaucugggcgugccacuccuugcccuggggugcuacucccagguuaauccuuugacacugaccgcugccgugcuccugcuuaucacucacuaugcaauaauuggacccggcuuacaggcuaaggccacccgggaggcgcagaaacgcacagccgcagguaucaugaagaacccgacugucgacgggaucaugaccauugaucuggacccagugaucuacgauaguaaguucgagaaacaacucggacaggucauguugcuggugcuaugugcuguucagcugcuccuuaugagaacaagcugggcccugugcgaagcauugacgcuggcuaccggcccuauaacuacacucugggaggguucgcccggcaaguuuuggaauaccacuauugccgugucuauggccaacaucuucaggggguccuaucuggcgggagcuggcuuagcauuuagcauuaugaaaucaguagggacaggaaagcggggcaccgguagucagggggaaacgcuuggagagaaauggaagaagaaacugaaucaacucucucgaaaggaauucgaccuauacaaaaaguccggcaucaccgagguggauagaacagaggccaaagaaggucugaagcgcggcgagauaacucaucacgcugucagcagggggucagccaaauugcagugguuuguugaacggaacauggugaucccagagggacgugucauugaccugggcugugggagaggaggcuggaguuauuacugcgcaggucucaagaaggugaccgaaguaaggggguauacaaaaggaggccccggccacgaggagccugugccgaugagcacuuacggguggaauaucguuaagcuuauguccggaaaagauguguucuaccugcccccagaaaagugugacaccuugcugugcgauauuggugagucuagcccuucccccacagucgaagagucacgcaccauccgggugcucaaaauggucgagccuugguuaaagaacaaucaguucuguauuaaggugcugaacccauauaugcccacuguuaucgaacaucuugagcgacugcagagaaaacacggcgggaugcuaguaaggaauccucucucucgcaacaguacgcaugaaauguacuggauaucgaauggaacaggcaacauuguggccagcgucaauauggugucccggcuguugcugaacagauuuaccaugacucaccguaggccaaccaucgagaaggacguugaucucggugcugggacacggcacgugaacgcggaacccgagacgccgaauauggacgucaucggagagcgcauuaaacgaauaaaggaagagcauaacucuaccuggcacuaugacgaugaaaauccuuacaaaacuugggccuaucauggcucauacgaggugaaggcaacaggcagcgcuuccaguaugaucaacgggguagugaagcuucugaccaaaccaugggacguuguccccauggugacucaaauggccaugacagauaccacaccuuucggacagcagagaguguuuaaggaaaaagucgacacuaggaccccacggucuaugcccgguacgcgcagaguuaugggcauuaccgcagagugguuauggaggacacuggggcgaaauaagaaaccgcgguugugcacucgugaggaauucaccaagaaggugagaacaaacgccgcuaugggagccguauuuacugaggaaaaucaaugggauagcgcgaaaaccgcaguggaggacgaagauuucuggaagcucgucgaccgcgagagggagcugcacaaacuaggcaagugugguucaugcguguauaacaugauggggaaacgggaaaagaaacuuggagaguuuggcaaggccaagggcuccagagcuaucugguacauguggcugggggcccgcuaccucgaauucgaggcacugggauuuuugaaugaggaucauugguucaguagggaaaacagcuauucugguguugagggcgaagggcugcacaaacucggauacauucuucgagacaucuccaagauaccuggcggugcuauguaugccgaugacacggcugggugggacacacggaucaccgaggaugaccugcacaaugaagagaaaauuacucagcagauggaucccgagcauagacaguuagccaacgcaaucuuuaagcugacauaccaaaauaaaguggucaaggugcagaggccaaccccuacuggaaccguaauggacauuaucucacgcaaggaucagcguggcagcggccagguugggacauauggauugaacacguucaccaauauggaagcgcaacucauacggcagauggagggugaaggcgugcugucgaaagccgaccuagagaacccccaccuuccagaaaagaaaauuacucaguggcuggagacaaagggggucgagagacucaaaaggauggcuaucucuggagaugacugcguggugaagcccaucgaugaccgcuuugccaacgcacuguuggcuuuaaaugauaugggcaagguccgaaaagacauuccucaguggcaaccaaguaaggguuggcaugauuggcagcagguuccguucuguucccaccacuuccaugaacugauaaugaaagacgggcggaagcucgugguacccugcagaccucaggacgagcuuaucggaagggcccgcauuagccaaggcgcaggcuggucacugagagaaaccgccugucuagggaaagcguacgcucagauguggucccugauguauuuucaccggagggaucuccguuuggccucuaacgcaaucugcagcgccgugccaguccauugggugcccacuagucgaacaaccugguccauucacgcucaucaccaguggaugacgacagaggacaugcugaccguuuggaaucgcguguggaucgaagauaacccuuggauggaggacaagacuccagucaccacaugggaggaugugcccuaccuuggaaagagagaagaccaauggugugguagccugauaggccucacuucucgggccaccugggcacagaauaucccuacagcuauucagcagguaaggucauuaaucgggaacgaggaauuccuggauuacaugccgaguaugaaacgcuuuagaaaggaggaggaauccgagggagccauuugguga

SEQ ID NO: 15370 - RNA, 9873 nt, Artificial Sequence
  derived and/or modified CDS sequence (opt3) from DENV-3__KJ189290__SS-prME
accagccugugccucaugaugauccuucccgcagcucuggcauuccacuugaccucccgggacggcgagccuaggaugauuguggggaagaacgaacggggaaaaucuuuacuguuuaagacugccucagguauaaauauguguacguuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccacccucccagaauauggaacucuuggccuggagugcucuccgcgaaccgguuuggacuucaaugagaugauccuacugacaaugaaaaacaaggcguggauggugcauagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcacacagcucucaccggcgccacagaaauccaaaauucagggggaacaaguauuuucgcaggucaucugaagugucgguuaaaaauggacaagcuggagcuaaaaggcaugagcuacgccaugugcaccaacacguuugugcucaagaaagaggucucugaaacccagcacgggacaauacugaucaagguggaguacaagggagaagaugcucccuguaaaauuccuuucuccacugaggacggccaugguaaggcgcacaacgggcgucuuaucaccgcaaauccaguugugacuaagaaggaggaacccguaaacauagaggccgaaccgccuuucggcgagucaaauauugucaucggaaucggcgauaacgcuuugaaaauuaauugguauaagaaggggagcaguaucggaaaaauguuugaagccacugcacgcggugccagaaggauggcuauucugggcgacaccgccugggauuucgggucugugggaggcguucucaacucccuggguaagauggugcaucaaauauuugggagcgcauacacggcgcuuuucucgggcgucucuugggugaugaaaaucggaauuggcguacuguugacauggaucgggcucaauuccaagaacaccucaaugaguuuuagcugcaucgcuauuggaauaaucacucuguauuuaggcgccgugguucaggcagacauggguugugucauuaauuggaaagggaaggagcugaagugcggauccggcaucuucgugacaaacgaggugcacaccuggacugaacaguacaaauuucaggccgauucucccaagcggcuagcuaccgccauugccggugcuugggagaauggcgucugugggauccgaagcacaacgcgcauggaaaaccuccuguggaaacaaauagccaaugagcuuaacuauaucuugugggaaaauaacauuaagcugaccguuguggugggagacaucauuggcguacucgagcaggggaaaagaacucugacaccacagccuauggaguuaaaguacucauggaaaaccuggggaaaggcgaagaucgucacagccgaaacucagaacaguuccuucauaauugauggccccaauaccccagagugccccagcgcuucuagggcauggaacgugugggaaguugaggacuaugguuuugggguguucacgacaaauaucuggcugcggcuucgcgaagucuacacccaauugugugaccacagacucaugucagccgcugugaaagaugagagggccguucaugcagacaugggauacuggauugagagucagaagaacggcagcuggaaacuggaaaaggcgucccuaaucgaggugaaaacuugcaccuggccuaagucucacacacuguggucgaaugguguacucgaaagcgauaugauaaucccaaagucccuggccggcccgauuucacagcauaaccaccgucccggguaucacacucagaccgcuggaccuuggcaucuuggcaaauuggagcuggacuuuaauuacugcgaggggacaacggucgugaucaccgaaaacuguggaacucggggcccaaguuuacgaacaaccacugugucugguaagcucauucacgaguggugcuguagaagcugcacacugcccccucuuagguauaugggggaagauggauguugguacggcauggagauccgcccaauauccgaaaaagaggagaauauggucaagucacugguuagcgccgguucuggcaaaguggacaacuucaccauggggguauugugccucgcaauucuguuugaagaggugaugcggggaaaguucggcaagaaacauaugaucgcuggggucuucuuuacguucgugcuacugcucuccggacaaaucacuuggagaaauauggcccacacccugauuaugaucggcaguaacgcaagcgauaggauggguauggggguuacauaucuugccuugauugcuaccuuuaagauacagcccuuccuggcguuaggauuuuuccuccgcaaacugacuucucgagaaaaucuucugcuaggcgugggccucgccauggcaacaacccugcaguugccggaggacaucgaacaaauggcuaacgggauugcccugggauuaauggcccucaagcugaucacacaguuugagacuuaccagcuuuggaccgcucugauuuccuugacguguucaaauacaaucuucacccucacugucgcauggcggaccgccacacugauacuagcgggugugagucugcuuccuguuugccagagcucguccaugcguaaaacugauuggcucccaauggcuguggccgcaaugggcgucccaccucugcccuuguuuaucuucucucugaaggacaccuuaaagagaaggagcuggccacucaacgaggggguaauggccgugggacugguuucaauucuugcuaguucccuguugcgcaacgaugugccuauggcaggcccccucgucgccggugggcugcuaaucgcguguuaugugauuacgggaacaucugcugaccugaccguagaaaaagccgcagauaucacuugggaggaagaggccgaacaaacaggcgugagccauaaucuuaugauaaccgucgacgacgauggcacuaugcggauuaaggacgaugagacagagaacauccucaccguucuguugaaaacggcuuuacugaucguguccgggauuuuuccauacucaauaccggccacucuccugguguggcacaccuggcagaagcagacacagagaagcggaguccuuugggacgugccuagucccccagaaacccaaaaagcagagcuggaagaggguguuuacaggaucaagcagcagggcauuuucgggaaaacacagguaggagugggcguccaaaaggaggguguguuucacacuauguggcauguuacccgaggggcuguguugacguauaauggaaagcgccuagaacccaacugggccucugucaaaaaggaucugaucuccuacggcggcggguggcggcucagcacacaguggcagaaaggagaggaagugcaaguaauugcggucgagccugguaagaaucccaagaacuuccagacuaugcccggcaccuuccagacaaccacuggggaaaucggagccauagcacuggacuuuaagccuggcaccucggguucaccgaucauuaauagagaggggaaggugguuggacuuuauggcaacggcguggucaccaagaaugggggauacgugucugguaucgcucagacgaacgccgagccagauggccccacuccugaauuagaggaagagauguucaagaaaaggaaucugaccauuauggaccuccacccagggaguggaaagacacguaaauauuugcccgcuaucguucgcgaagcaauaaagcggagacugaggacccucauucuggccccuacucgaguggucgccgcugagauggaggaagcgcuuaagggccugccgauccgguaccaaacaaccgcaacgaaauccgagcauacuggucgcgaaaucguggauuugaugugccacgccacauuuaccaugagacuacugagccccguaagggugccaaacuauaaucucauuaucauggacgaggcucauuucaccgauccugccucuauagcagcccggggguacauuagcacucgaguuggaaugggcgaagcugcggccaucuuuaugacagcaacacccccaggcacagcugacgccuucccucaguccaacgcacccauucaggaugaggagagagacaucccagaacgcucauggaauagugggaacgaguggauaacugacuuugccggaaagacggucugguucgugccgagcauuaaagcugguaacgauaucgccaauuguuuaaggaagaacggcaaaaaggugauccagcugucucguaagaccuuugacacagaauaccagaaaacuaaacuuaaugauugggacuucgucguaaccacagauauuuccgagaugggggcgaacuuuaaagcagaccgggugaucgauccuagaaggugccugaagcccguuauucucaccgacggaccagagcgcgugauauuggccggccccaugccugucacugcugccucagcugcacagcgaagaggucggguggggaggaauccacagaaagaaaacgaucaguauaucuucacgggccaaccccugaauaacgacgaggaucacgcccacuggaccgaagcuaagaugcuccuggacaauauuaacacaccugagggaaucaucccggcccuuuucgaaccagagcgcgagaagagugcagcgauugacggcgaauaccgucuaaaaggggagagcagaaagacuuuuguugaacugaugcggaggggagauuugcccgugugguuagcccauaaagucgcuuccgaggguauaaaguauaccgaccgcaaauggugcuucgauggccagcgaaauaaccagauccuggaagagaauauggacguggagauuuggacaaaggaaggggagaaaaagaagcucagaccucgguggcuggaugccaggaccuacucugacccccuugcacugaaagaauuuaaggauuucgcugccggacgcaaaucgaucgcacucgacuugguaacugagauuggcagagugccaagccaccuggcccauaggacacggaacgcucuagauaaucugguuaugcuccacacgucagaacacggugggcgugcguaucgccaugccgucgaggagcuuccugaaaccauggagacucuguuauugcugggccucaugauccugcuuacaggaggcgcaaugcuguuucucauauccgggaagggaaucgguaaaaccaguauuggcuugaucugugugauugcuucuagcgggaugcuguggauggccgaaauccccuuacaguggauagccuccgcaauugugcuagaguucuuuaugaugguccugcucaucccagagccugaaaagcaacgaaccccgcaggacaaccagcuugcuuacguugugauuggaauccugacauuggccgcgauaaucgcugccaaugagaugggccugcucgaaacuacgaagagagaucuggguaugucaaaagagcccgggguagugucuccaaccagcuaucuugacgucgaucuccacccugcaagugccuggacacuguacgcuguggcaacuaccguuauuacacccauguugaggcauaccaucgaaaacuccacugccaacgugagccuggcggcuauugccaaucaagcagucguauuaaugggccuagacaagggauggccaaucucuaaaauggaccugggcgugccucuccuugcccuggggugcuacucacagguuaaccccuugacgcugacagcugccgugcuccugcuuauaacccacuaugcaauuaucggaccgggcuuacaggcuaaggccacucgggaggcgcagaaacgcaccgccgcagguaucaugaagaauccaacagucgaugggauuaugacuaucgaccuggauccugugauauacgacuccaaguucgagaaacaacucggacaggucauguugcuggugcuaugugcuguucagcugcuccuuaugagaaccaguugggcccugugcgaagcauugacacuggcuacgggccccauuaccacucucugggaggguagcccaggcaaguuuuggaacacaaccaucgccgugucgauggccaauauuuucagggggucuuaucuggcgggagcuggcuuagcauuuuccaucaugaaaagcguagggacuggaaagcggggcacagguucacagggggaaacccuuggagagaaauggaagaagaaacugaaccaacucagucgaaaggaguucgaucuauacaaaagaucuggcauaacggagguggaccgcaccgaggccaaggaaggucugaaaaggggcgagaucacacaucacgcugucucccgggggagcgccaaguugcagugguuuguugaacguaauauggugauucccgagggaagagucaucgaucugggcugugggaggggaggcuggucauauuacugcgcaggucucaaaaaggugacugaaguacgcggguauaccaagggaggcccuggccacgaggagccggugcccaugaguacauacggguggaacauuguuaaacuuaugagcggaaaggacguguucuaccugccaccugaaaaaugugauacuuugcugugcgacaucggugaguccucucccagcccuaccgucgaagagucccggacaauucgagugcucaagauggucgagccauggcugaaaaauaaccaguucuguaucaaggugcuaaaucccuauaugccuaccguuauagaacaucuugagagacugcagaggaagcacggcgggaugcuaguacgcaacccacucucaagaaauucuacucaugaaauguacuggauuaguaacggaacgggcaauaucguggccucggucaacauggugagcagacuguugcugaaccguuuuacaaugacccacaggcggcccacuaucgagaaagauguugaccucggugcugggacccgccacgugaaugcggaaccggagacaccuaacauggaugucauuggagagcgaauaaagagaaucaaagaagaacauaauuccacguggcacuaugacgaagagaacccauacaagaccugggccuaucauggcucuuacgaagugaaagcaacuggcucagcuagcuccaugauuaaugggguagugaaacuucugacaaagcccugggacguugucccuauggugacccaaauggccaugacugauacaaccccauucggacagcagaggguguuuaaagagaaggucgacacacggacuccccgcaguaugccggguaccagaaggguuaugggcaucacggcagagugguuauggcgaacccuggggcggaacaaaaagccucguuugugcacaagagaagaguucacuaaaaaggugcgcaccaaugccgcuaugggagccguauuuacagaagagaaccaaugggauucugcgaaggcagccguggaagacgaggauuucuggaaacucgucgacagggagcgggaacugcacaagcuaggcaaaugugguagcugcguguauaauaugauggggaagagagagaagaaacuuggagaauuuggcaaagcuaaaggcucacgcgccauuugguacauguggcugggggcaagguaccucgaguucgaggcucugggauuuuugaacgaagaucauugguucucccgagagaauaguuauagcgguguugaaggcgaggggcugcacaagcucggauacauccuucgggacauaucuaaaauccccggcggugccauguaugcugaugacacugccgggugggauaccagaauuacggaagacgaccugcacaacgaggagaagaucacacagcagauggauccagaacauaggcaguuagcaaaugcgauuuuuaaacugaccuaccaaaacaagguggucaaagugcagcgcccuacucccacaggaaccguaauggacaucauaucccguaaggaucagcggggcucaggccagguugggacuuauggauugaauaccuucacaaacauggaggcccaacucauuagacagauggaaggugagggcgugcugagcaaggcugaccuagaaaacccacaccuucccgagaaaaagaucacgcaguggcuggagaccaaaggggucgaaaggcucaagcgcauggccaucucgggagaugacugcguggugaaaccuauugaugaccgauuugcaaaugcucuguuggccuuaaacgauaugggcaagguccggaaggacauaccacaguggcaaccgucuaaagguuggcaugauuggcagcagguucccuucuguagucaccacuuccaugagcugaucaugaaggacgggagaaaacucgugguaccuugcaggccacaggaugaacuuauuggacgcgcaagaaucucccaaggcgccggcuggagccugcgggagacugcgugucuagggaaggcuuacgcccagauguggucacugauguauuuucacaggcgugaccuccgauuggcauccaaugccauuugcucugcugugcccguccauugggugccuacaagccgcaccacuuggaguauccacgcccaucaccaguggaugacaaccgaagacaugcugacgguuuggaacagaguguggauagaggauaauccauggauggaggacaaaacacccgucaccacuugggaagaugugccuuaccuuggaaagcgggaggaccaauggugugguucccugaucggccucaccagcagggcaacaugggcucagaacauuccgacugccauccagcagguacgcucuuuaauugggaaugaagaguuccuggauuacaugccaucaaugaagagauuucggaaagaggaagagagugaaggagcgaucugguga

SEQ ID NO: 15371 - RNA, 9873 nt, Artificial Sequence
  derived and/or modified CDS sequence (opt3) from DENV-3__KJ189291__SS-prME
accagccugugccucaugaugauccuucccgcagcucuggcauuccacuugaccucccgggacggcgagccuaggaugauuguggggaagaacgaacggggaaaaucuuuacuguuuaagacugccucagguauaaauauguguacguuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccacccucccagaauauggaacucuuggccuggagugcucuccgcgaaccgguuuggacuucaaugagaugauccuacugacaaugaaaaacaaggcguggauggugcauagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcacacagcucucaccggcgccacagaaauccaaaauucagggggaacaaguauuuucgcaggucaucugaagugucgguuaaaaauggacaagcuggagcuaaaaggcaugagcuacgccaugugcaccaacacguuugugcucaagaaagaggucucugaaacccagcacgggacaauacugaucaagguggaguacaagggagaagaugcucccuguaaaauuccuuucuccacugaggacggccaugguaaggcgcacaacgggcgucuuaucaccgcaaauccaguugugacuaagaaggaggaacccguaaacauagaggccgaaccgccuuucggcgagucaaauauugucaucggaaucggcgauaacgcuuugaaaauuaauugguauaagaaggggagcaguaucggaaaaauguuugaagccacugcacgcggugccagaaggauggcuauucugggcgacaccgccugggauuucgggucugugggaggcguucucaacucccuggguaagauggugcaucaaauauuugggagcgcauacacggcgcuuuucucgggcgucucuugggugaugaaaaucggaauuggcguacuguugacauggaucgggcucaauuccaagaacaccucaaugaguuuuagcugcaucgcuauuggaauaaucacucuguauuuaggcgccgugguucaggcagacauggguugugucauuaauuggaaagggaaggagcugaagugcggauccggcaucuucgugacaaacgaggugcacaccuggacugaacaguacaaauuucaggccgauucucccaagcggcuagcuaccgccauugccggugcuugggagaauggcgucugugggauccgaagcacaacgcgcauggaaaaccuccuguggaaacaaauagccaaugagcuuaacuauaucuugugggaaaauaacauuaagcugaccguuguggugggagacaucauuggcguacucgagcaggggaaaagaacucugacaccacagccuauggaguuaaaguacucauggaaaaccuggggaaaggcgaagaucgucacagccgaaacucagaacaguuccuucauaauugauggccccaauaccccagagugccccagcgcuucuagggcauggaacgugugggaaguugaggacuaugguuuugggguguucacgacaaauaucuggcugcggcuucgcgaagucuacacccaauugugugaccacagacucaugucagccgcugugaaagaugagagggccguucaugcagacaugggauacuggauugagagucagaagaacggcagcuggaaacuggaaaaggcgucccuaaucgaggugaaaacuugcaccuggccuaagucucacacacuguggucgaaugguguacucgaaagcgauaugauaaucccaaagucccuggccggcccgauuucacagcauaaccaccgucccggguaucacacucagaccgcuggaccuuggcaucuuggcaaauuggagcuggacuuuaauuacugcgaggggacaacggucgugaucaccgaaaacuguggaacucggggcccaaguuuacgaacaaccacugugucugguaagcucauucacgaguggugcuguagaagcugcacacugcccccucuuagguauaugggggaagauggauguugguacggcauggagauccgcccaauauccgaaaaagaggagaauauggucaagucacugguuagcgccgguucuggcaaaguggacaacuucaccauggggguauugugccucgcaauucuguuugaagaggugaugcggggaaaguucggcaagaaacauaugaucgcuggggucuucuuuacguucgugcuacugcucuccggacaaaucacuuggagaaauauggcccacacccugauuaugaucggcaguaacgcaagcgauaggauggguauggggguuacauaucuugccuugauugcuaccuuuaagauacagcccuuccuggcguuaggauuuuuccuccgcaaacugacuucucgagaaaaucuucugcuaggcgugggccucgccauggcaacaacccugcaguugccggaggacaucgaacaaauggcuaacgggauugcccugggauuaauggcccucaagcugaucacacaguuugagacuuaccagcuuuggaccgcucugauuuccuugacguguucaaauacaaucuucacccucacugucgcauggcggaccgccacacugauacuagcgggugugagucugcuuccuguuugccagagcucguccaugcguaaaacugauuggcucccaauggcuguggccgcaaugggcgucccaccucugcccuuguuuaucuucucucugaaggacaccuuaaagagaaggagcuggccacucaacgaggggguaauggccgugggacugguuucaauucuugcuaguucccuguugcgcaacgaugugccuauggcaggcccccucgucgccggugggcugcuaaucgcguguuaugugauuacgggaacaucugcugaccugaccguagaaaaagccgcagauaucacuugggaggaagaggccgaacaaacaggcgugagccauaaucuuaugauaaccgucgacgacgauggcacuaugcggauuaaggacgaugagacagagaacauccucaccguucuguugaaaacggcuuuacugaucguguccgggauuuuuccauacucaauaccggccacucuccugguguggcacaccuggcagaagcagacacagagaagcggaguccuuugggacgugccuagucccccagaaacccaaaaagcagagcuggaagaggguguuuacaggaucaagcagcagggcauuuucgggaaaacacagguaggagugggcguccaaaaggaggguguguuucacacuauguggcauguuacccgaggggcuguguugacguauaauggaaagcgccuagaacccaacugggccucugucaaaaaggaucugaucuccuacggcggcggguggcggcucagcacacaguggcagaaaggagaggaagugcaaguaauugcggucgagccugguaagaaucccaagaacuuccagacuaugcccggcaccuuccagacaaccacuggggaaaucggagccauagcacuggacuuuaagccuggcaccucggguucaccgaucauuaauagagaggggaaggugguuggacuuuauggcaacggcguggucaccaagaaugggggauacgugucugguaucgcucagacgaacgccgagccagauggccccacuccugaauuagaggaagagauguucaagaaaaggaaucugaccauuauggaccuccacccagggaguggaaagacacguaaauauuugcccgcuaucguucgcgaagcaauaaagcggagacugaggacccucauucuggccccuacucgaguggucgccgcugagauggaggaagcgcuuaagggccugccgauccgguaccaaacaaccgcaacgaaauccgagcauacuggucgcgaaaucguggauuugaugugccacgccacauuuaccaugagacuacugagccccguaagggugccaaacuauaaucucauuaucauggacgaggcucauuucaccgauccugccucuauagcagcccggggguacauuagcacucgaguuggaaugggcgaagcugcggccaucuuuaugacagcaacacccccaggcacagcugacgccuucccucaguccaacgcacccauucaggaugaggagagagacaucccagaacgcucauggaauagugggaacgaguggauaacugacuuugccggaaagacggucugguucgugccgagcauuaaagcugguaacgauaucgccaauuguuuaaggaagaacggcaaaaaggugauccagcugucucguaagaccuuugacacagaauaccagaaaacuaaacuuaaugauugggacuucgucguaaccacagauauuuccgagaugggggcgaacuuuaaagcagaccgggugaucgauccuagaaggugccugaagcccguuauucucaccgacggaccagagcgcgugauauuggccggccccaugccugucacugcugccucagcugcacagcgaagaggucggguggggaggaauccacagaaagaaaacgaucaguauaucuucacgggccaaccccugaauaacgacgaggaucacgcccacuggaccgaagcuaagaugcuccuggacaauauuaacacaccugagggaaucaucccggcccuuuucgaaccagagcgcgagaagagugcagcgauugacggcgaauaccgucuaaaaggggagagcagaaagacuuuuguugaacugaugcggaggggagauuugcccgugugguuagcccauaaagucgcuuccgaggguauaaaguauaccgaccgcaaauggugcuucgauggccagcgaaauaaccagauccuggaagagaauauggacguggagauuuggacaaaggaaggggagaaaaagaagcucagaccucgguggcuggaugccaggaccuacucugacccccuugcacugaaagaauuuaaggauuucgcugccggacgcaaaucgaucgcacucgacuugguaacugagauuggcagagugccaagccaccuggcccauaggacacggaacgcucuagauaaucugguuaugcuccacacgucagaacacggugggcgugcguaucgccaugccgucgaggagcuuccugaaaccauggagacucuguuauugcugggccucaugauccugcuuacaggaggcgcaaugcuguuucucauauccgggaagggaaucgguaaaaccaguauuggcuugaucugugugauugcuucuagcgggaugcuguggauggccgaaauccccuuacaguggauagccuccgcaauugugcuagaguucuuuaugaugguccugcucaucccagagccugaaaagcaacgaaccccgcaggacaaccagcuugcuuacguugugauuggaauccugacauuggccgcgauaaucgcugccaaugagaugggccugcucgaaacuacgaagagagaucuggguaugucaaaagagcccgggguagugucuccaaccagcuaucuugacgucgaucuccacccugcaagugccuggacacuguacgcuguggcaacuaccguuauuacacccauguugaggcauaccaucgaaaacuccacugccaacgugagccuggcggcuauugccaaucaagcagucguauuaaugggccuagacaagggauggccaaucucuaaaauggaccugggcgugccucuccuugcccuggggugcuacucacagguuaaccccuugacgcugacagcugccgugcuccugcuuauaacccacuaugcaauuaucggaccgggcuuacaggcuaaggccacucgggaggcgcagaaacgcaccgccgcagguaucaugaagaauccaacagucgaugggauuaugacuaucgaccuggauccugugauauacgacuccaaguucgagaaacaacucggacaggucauguugcuggugcuaugugcuguucagcugcuccuuaugagaaccaguugggcccugugcgaagcauugacacuggcuacgggccccauuaccacucucugggaggguagcccaggcaaguuuuggaacacaaccaucgccgugucgauggccaauauuuucagggggucuuaucuggcgggagcuggcuuagcauuuuccaucaugaaaagcguagggacuggaaagcggggcacagguucacagggggaaacccuuggagagaaauggaagaagaaacugaaccaacucagucgaaaggaguucgaucuauacaaaagaucuggcauaacggagguggaccgcaccgaggccaaggaaggucugaaaaggggcgagaucacacaucacgcugucucccgggggagcgccaaguugcagugguuuguugaacguaauauggugauucccgagggaagagucaucgaucugggcugugggaggggaggcuggucauauuacugcgcaggucucaaaaaggugacugaaguacgcggguauaccaagggaggcccuggccacgaggagccggugcccaugaguacauacggguggaacauuguuaaacuuaugagcggaaaggacguguucuaccugccaccugaaaaaugugauacuuugcugugcgacaucggugaguccucucccagcccuaccgucgaagagucccggacaauucgagugcucaagauggucgagccauggcugaaaaauaaccaguucuguaucaaggugcuaaaucccuauaugccuaccguuauagaacaucuugagagacugcagaggaagcacggcgggaugcuaguacgcaacccacucucaagaaauucuacucaugaaauguacuggauuaguaacggaacgggcaauaucguggccucggucaacauggugagcagacuguugcugaaccguuuuacaaugacccacaggcggcccacuaucgagaaagauguugaccucggugcugggacccgccacgugaaugcggaaccggagacaccuaacauggaugucauuggagagcgaauaaagagaaucaaagaagaacauaauuccacguggcacuaugacgaagagaacccauacaagaccugggccuaucauggcucuuacgaagugaaagcaacuggcucagcuagcuccaugauuaaugggguagugaaacuucugacaaagcccugggacguugucccuauggugacccaaauggccaugacugauacaaccccauucggacagcagaggguguuuaaagagaaggucgacacacggacuccccgcaguaugccggguaccagaaggguuaugggcaucacggcagagugguuauggcgaacccuggggcggaacaaaaagccucguuugugcacaagagaagaguucacuaaaaaggugcgcaccaaugccgcuaugggagccguauuuacagaagagaaccaaugggauucugcgaaggcagccguggaagacgaggauuucuggaaacucgucgacagggagcgggaacugcacaagcuaggcaaaugugguagcugcguguauaauaugauggggaagagagagaagaaacuuggagaauuuggcaaagcuaaaggcucacgcgccauuugguacauguggcugggggcaagguaccucgaguucgaggcucugggauuuuugaacgaagaucauugguucucccgagagaauaguuauagcgguguugaaggcgaggggcugcacaagcucggauacauccuucgggacauaucuaaaauccccggcggugccauguaugcugaugacacugccgggugggauaccagaauuacggaagacgaccugcacaacgaggagaagaucacacagcagauggauccagaacauaggcaguuagcaaaugcgauuuuuaaacugaccuaccaaaacaagguggucaaagugcagcgcccuacucccacaggaaccguaauggacaucauaucccguaaggaucagcggggcucaggccagguugggacuuauggauugaauaccuucacaaacauggaggcccaacucauuagacagauggaaggugagggcgugcugagcaaggcugaccuagaaaacccacaccuucccgagaaaaagaucacgcaguggcuggagaccaaaggggucgaaaggcucaagcgcauggccaucucgggagaugacugcguggugaaaccuauugaugaccgauuugcaaaugcucuguuggccuuaaacgauaugggcaagguccggaaggacauaccacaguggcaaccgucuaaagguuggcaugauuggcagcagguucccuucuguagucaccacuuccaugagcugaucaugaaggacgggagaaaacucgugguaccuugcaggccacaggaugaacuuauuggacgcgcaagaaucucccaaggcgccggcuggagccugcgggagacugcgugucuagggaaggcuuacgcccagauguggacacugauguauuuucacaggcgugaccuccgauuggcaucaaaugccauuugcuccgcugugcccguccauugggugccuaccucucgcacuacauggagcauccacgcccaucaccaguggaugaccacggaagacaugcugacaguuuggaacagaguguggauagaggauaauccauggauggaggacaaaacccccgucacuaccugggaagaugugccuuaccuuggaaagcgggaggaccaauggugugguagucugaucggccucacauccagggcaacuugggcucagaacauuccgaccgccauccagcagguacgcagcuuaauugggaaugaagaguuccuggauuacaugccaucuaugaagagauuucggaaagaggaagagucagaaggagcgaucugguga

SEQ ID NO: 15372 - RNA, 9873 nt, Artificial Sequence
  derived and/or modified CDS sequence (opt3) from DENV-3__KJ189292__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaagcugagccggaagacaucgauugcugguguaaccugaccaguacauggguuaccuaugggacuugcaaucaggccggagagcaccgccgagacaagcguagcguggcacuugccccccauguaggcaugggucuggauacaagaacccaaacguggauguccgcugagggggcauggaggcagguggaaaaagucgagacuugggccuugcggcacccuggauucaccauucucgcucuguuucuggcccauuacaucggcacaucucucacucagaaggugguuauauucaucuuacugaugcuugugaccccaucgaugacaaugcgcugugucggcguggggaacagagacuuuguagaaggauugucaggugcgaccuggguugaugugguccuggagcacggcgggugcgugacgacuauggcaaagaauaaacccacacuagacauugagcuccagaagaccgaagccacucaacuggcuacacuuaggaaacuguguaucgagggaaagauuaccaacaucacgaccgauagccggugcccuacacagggcgaagccguguugccagaggaacaggaccagaauuaugucuguaaacacacuuacguugaucgcgguugggggaacggaugcggccucuucggcaaggggagucuggugaccugcgcaaaguuucaauguuuagagcccauagagggaaaaguagugcaguaugaaaaucugaaguacacagucauuaucacugugcauaccggugaccagcaccagguuggcaacgagacacaaggggugaccgcugaaauuacuccucaggccuccacgacagaggcgacccucccagaauauggaacucuuggccuggagugcucuccgcgaaccgguuuggacuucaaugagaugauccuacugacaaugaaaaacaaggccuggaugguccauagacagugguuuuucgaucucccccugccuuggaccagcggggcaacuacagaaacgccaaccuggaauaggaaagagcuucuggugacuuuuaagaacgcucacgccaaaaagcaagaaguaguuguguugggcucccaggagggagcuaugcacacagcccucaccggcgcaacagaaauccagaauucagggggaacuaguauuuucgccggucaucugaagugucgguuaaaaauggacaagcuggagcuaaaaggcaugagcuacgcuaugugcaccaacacguuuguccucaagaaagaggugucugaaacccagcacgggacaauacugaucaaggucgaguacaagggagaagaugcgcccuguaaaauuccuuucuccacugaggacggccaugguaaggcacacaacgggcgucuuaucaccgccaauccagugguuacaaaaaaggaggaacccgugaacauagaggcugaaccgccuuucggcgagucaaauauuaugaucggaaucggcgauaacgccuugaaaauuaauugguauaagaaggggagcaguaucggaaaaauguuugaagcaacugcccgcggugcuagaaggauggccauucugggcgacaccgcaugggauuucgggucuguaggaggcguccucaacucccuggguaagauggugcaucaaauauuugggagcgcguacacggcucuuuucucgggcguuucuugggugaugaaaaucggaauuggcguccuguugacauggaucgggcucaauuccaagaacaccucaaugaguuuuagcugcaucgccauuggaauaaucacucuguauuuaggcgcagugguacaggccgacauggguuguauuaucaauuggaaagggaaggagcugaagugcggauccggcauuuucgugacaaacgagguucacaccuggacugaacaguacaaauuucaggcugauucucccaagcggcuagccaccgcaaucgcuggugccugggagaauggcgucugugggauacgaagcacaacgcgcauggaaaaccuccuguggaaacaaaucgcgaaugagcuuaacuauauuuugugggaaaauaacaucaagcugaccgugguggucggagacauuaucggcguucucgagcaggggaaaagaacucugacaccacagccuauggaguuaaaguacucauggaaaaccuggggaaaggccaagauagugacagcugaaacucagaacaguuccuucauuaucgauggccccaauaccccagagugccccagcgcaucuagggccuggaacgugugggaaguagaggacuaugguuuuggggucuucacgacaaauauuuggcugcggcuucgcgaaguguacacccaauugugugaccacagacucaugucagcugccguuaaagaugagagggcagugcaugcggacaugggauacuggaucgagagucagaagaacggcagcuggaaacuggaaaaggccucccuaauagaggucaaaacuugcaccuggccuaagucucacacacuguggucgaauggugugcucgaaagcgauaugaucauuccaaagucccuggcuggcccgaucucacagcauaaccaccgucccggguaucacacucagaccgccggaccuuggcaucuuggcaaauuggagcuggacuuuaauuacugcgaggggacaacgguugugauuaccgaaaacuguggaacucggggcccaaguuuacgaacaaccacuguaucugguaagcucauccacgaguggugcuguagaagcugcacacugcccccucuuagguauaugggggaagauggauguugguacggcauggagauacgcccaauuuccgaaaaagaggagaauauggucaagucacuggugagcgcagguucuggcaaaguggacaacuucaccaugggggucuugugccucgcuauccuguuugaagagguuaugcggggaaaguucggcaagaaacauaugaucgccgggguguucuuuacguucguacuacugcucuccggacaaauuacuuggagagauauggcacacacccugaucaugauuggcaguaaugccagcgacaggauggguaugggggugacauaucuugcuuugauagcgaccuuuaagauccagcccuuccuggccuuaggauuuuuccuccgcaaacugacuucucgagaaaaccuucugcuaggcgucggccucgcaauggcuacaacccugcaguugccggaggauauugaacaaauggccaaugggaucgcccugggauuaauggcucucaagcugauuacacaguuugagacuuaccagcuuuggaccgcacugaucuccuugacguguucaaacacaauauucacccucacuguggccuggcggaccgcgacacugauccuagcugguguuagucugcuuccugugugccagagcucguccaugcguaaaacugacuggcucccaauggccgucgcagccaugggcgugcccccucugcccuuguuuauuuucucucugaaggauaccuuaaagagaaggagcuggccacucaaugaggggguuauggcugugggacuggucucaauccuugcaaguucccuguugcgcaacgacguaccuauggccggcccccucguggcgggugggcugcuaauugcuuguuauguuaucacgggaacaucugccgaucugaccguggaaaaagcagccgacauaacuugggaggaagaggcugaacaaacaggcgucagccauaaccuuaugauuaccguggacgaugacggcacuaugcggaucaaggaugacgagacagagaauauccucaccguacuguugaaaacggccuuacugauuguguccgggauauuuccauacucaaucccggcaacucuccuggucuggcacaccuggcagaagcagacacagagaagcggaguucuuugggaugugccuagucccccagaaacccaaaaagcugagcuggaagaggguguguacaggauuaagcagcagggcaucuucgggaaaacacaggucggagugggcguucaaaaggaggguguauuucacacuauguggcaugugacccgaggggccgucuugacguauaacggaaagcgccuagaacccaauugggcgucugugaaaaaggaccugauuuccuacggcggcggguggcggcucagcacacaguggcagaaaggagaggaaguucaagugaucgccgucgagccugguaagaacccaaaaaauuuccagacuauacccggcaccuuccagacaaccacuggggaaaucggagcaauugcucuggauuuuaagccuggcaccucggguucaccgaucauuaacagagaggggaaggugguaggacuuuauggcaauggcgucgugacaaaaaacgggggauacguuucugguaucgcccagacgaaugcugagccagacggcaguacucccgaauuagaggaagagauguucaagaaaaggaaccugaccauaauggaucuccacccuggguccggaaagacacguaaauauuugccagcaauugugcgcgaagccaucaagcggagacugaggacccucauccuggcccccacucgagucguggcugcggagauggaggaagcacuuaagggccugccuauucgguaccaaacaaccgccacgaaaagcgagcauacuggucgcgaaaucguugacuugaugugccacgcuacauuuaccaugagacuacugucuccggugaggguccccaauuauaaccucauaauuauggaugaggcccauuucaccgacccagcaagcaucgccgcucggggguacauuuccacucgagugggaaugggcgaagcggccgcaaucuuuaugacagcuaccccucccggcacagccgaugcauucccacagucaaaugccccuauacaggacgaggagagagacauucccgaacgcaguuggaacagcgggaaugaguggaucacugauuuugcuggaaagacgguaugguucgugccaucuaucaaagccgguaacgacauugcgaacuguuuaaggaagaauggcaaaaagguuauccagcugucccguaagaccuuugauacagaauaccaaaaaacuaagcuuaacgacugggauuucgucgugaccacagacauuucagagaugggggcaaauuuuaaagccgaucgggugauagacccgagaaggugccugaagccugucauccucaccgauggacccgagcgcguaauuuuggcuggcccaaugcccgugacuguugccagugcugcacagcgaagaggucggguggggaggaacccucagaaagaaaaugaccaguauaucuucacgggccaaccacugaacaaugaugaggaccacgcccacuggaccgaagcuaagaugcuccuggacaacaucaauacacccgagggaauuauaccugcccuuuucgaaccggagcgcgagaagagcgcagcgaucgauggcgaauaccgucuaaaaggggaguccagaaagacuuuugucgaacugaugcggaggggagacuugccagugugguuagcccauaaaguugcuucugaggguauuaaguauaccgaucgcaaauggugcuucgacggccagcgaaacaaucagauccuggaagagaacauggauguggagauuuggacaaaggaaggggagaaaaagaagcucagaccccgguggcuggacgccaggaccuacucggauccucuugcacugaaagaauuuaaggacuucgcugccggacgcaaaagcaucgcacucgauuuggucacugagauaggcagagugcccucacaccuggcccauaggacacggaaugcucuagacaaccugguaaugcuccacacguccgaacacggugggcgugcguaucgccaugccguggaggagcuuccagaaaccauggagacucuguuauugcugggccucaugauccugcuuacaggaggcgcaaugcuguuucucauuagugggaagggaaucgguaaaaccucuauuggcuugaucuguguuauagcuagcuccgggaugcuguggauggccgaaauuccuuuacaguggaucgccucagcaauuguccuagaguucuuuaugauggugcugcucauccccgagccagaaaagcaacgaaccccucaggauaaucagcuugcuuacguggucauaggaauccugacauuggccgcgauuaucgcugccaacgagaugggccugcucgaaacuacgaagagagaccuggguaugucuaaagagccggggguugugagccccaccaguuaucuugauguagaccuccacccagcauccgccuggacacuguacgcuguggcaacuaccgucauuacaccuauguugaggcauaccaucgaaaauagcacugccaacgugucucuggcggcuauagccaaccaagcaguuguguuaaugggccuagacaagggauggcccauuucaaaaauggaucugggcgucccacuccuugcccuggggugcuacucccagguaaauccuuugacgcugacagcugccgugcuccugcuuaucacccacuaugcaaucauuggacccggcuuacaggcuaaggccacucgggaggcgcagaaacgcaccgccgcagguaucaugaagaacccgacaguugacgggauaaugacuauugaucuggacccagugaucuacgauaguaaguucgagaaacaacucggacaggucauguugcuggugcuaugugcuguccagcugcuccuuaugagaaccagcugggcccugugcgaagcauugacacuggcuacgggcccuauuaccacucucugggaggguucgcccggcaaguuuuggaauacaaccaucgccgugucuauggccaacauauucaggggguccuaucuggcgggagcuggcuuagcauuuagcaucaugaaaucaguugggacuggaaagcggggcacagguagucagggggaaacccuuggagagaaauggaagaagaaacugaaucaacucucucgaaaggaauucgaccuauacaaaaaguccggcauuacggagguggauagaaccgaggccaaagaaggucugaagcgcggcgagaucacacaucacgcuguaagcagggggucagccaaauugcagugguuuguggaacggaacauggucauuccagagggacguguuaucgaccugggcugugggagaggaggcuggaguuauuacugcgcaggucucaagaaggugacugaagucaggggguauaccaaaggaggccccggccacgaggagccugugccgaugagcacauacggguggaauauuguaaagcuuauguccggaaaagauguguucuaccugcccccagaaaagugugacacuuugcugugcgauaucggugagucuagcccuucccccaccguugaagagucacgcacaauacgggugcucaaaauggucgagccuugguuaaagaacaaucaguucuguauuaaggugcugaacccauauaugcccaccgucaucgaacaucuugagcgacugcagagaaaacacggcgggaugcuagugaggaauccucucucucgcaacaguacucaugaaauguacuggaucucgaauggaacgggcaacauuguugccagcguaaauauggugucccggcuguugcugaacagauuuacaaugacccaccguaggccaacuauagagaaggacgucgaucucggugcugggacccggcacgugaacgcggaacccgagacaccgaauauggacguuaucggagagcgcauuaaacgaaucaaggaagagcauaacucuacguggcacuaugacgaugaaaauccuuacaaaaccugggccuaucauggcucauacgaggugaaggcaacuggcagcgcuuccaguaugauuaacggggucgugaagcuucugacaaaaccaugggacguagugcccaugguuacccaaauggccaugacugauacaaccccuuucggacagcagagagucuuuaaggaaaaaguggacacaaggacuccacggucuaugcccgguacccgcagagugaugggcaucacggcagagugguuauggaggacccuggggcgaaauaagaaaccgcgguugugcacacgugaggaauucacuaagaaggucagaaccaacgccgcuaugggagccguuuuuacagaggaaaaucaaugggauagcgcgaaagcagccguggaggacgaagauuucuggaagcucguagaccgcgagagggagcugcacaaacuaggcaagugugguucaugcguguauaacaugauggggaaacgggaaaagaaacuuggagaguuuggcaaggcuaagggcuccagagccauaugguacauguggcugggggcacgcuaccucgaauucgaggcucugggauuuuugaaugaggaucauugguucaguagggaaaacagcuauucuggugucgagggcgaagggcugcacaaacucggauacauccuucgagacauuuccaagaucccuggcggugccauguaugcugaugacacugccgggugggacacccggauuacggaggaugaccugcacaaugaagagaaaaucacacagcagauggaucccgagcauagacaguuagcaaacgcgauauuuaagcugaccuaccaaaauaaagugguuaaggugcagaggccaacuccuacaggaaccgucauggacauuaucucacgcaaggaucagcguggcagcggccagguggggacuuauggauugaacaccuucacaaauauggaaguacaacucauccggcagauggagggugaaggcguucugucgaaagccgaccuagagaacccccaccuuccagaaaagaaaauuacgcaguggcuggagaccaaggggguggagagacucaaaaggauggcuauaucuggagaugacugcgucgugaagcccaucgaugaccgcuuugccaacgcacuguuggcuuuaaaugauaugggcaagauucgaaaagacaucccucaguggcaaccaaguaaggguuggcaugauuggcagcaggugccguucuguucccaccacuuccaugaacugauuaugaaagacgggcggaagcucgucguucccugcagaccucaggacgagcuuaucggaagggcccgcauaagccaaggcgcaggcuggucacugagagaaacugccugucuagggaaagcguacgcucagauguggucccugauguauuuucaccggagggaucuccguuuggccucuaacgcaaucugcagcgccgugccaguacauugggugcccacaagucgaaccacuugguccauucacgcucaucaccaguggaugacaaccgaggacaugcugacggucuggaaucgcguguggaucgaagauaacccuuggauggaggacaagacaccaguuaccacuugggaggaugugcccuaccuuggaaagagagaagaccaauggugugguagccugauuggccucaccucucgggccacaugggcacagaauaucccuacugcuauucagcaggucaggucauuaauagggaacgaggaauuccuggauuacaugccgaguaugaaacgcuuuagaaaggaggaggaauccgagggagccaucugguga

SEQ ID NO: 15373 - RNA, 9873 nt, Artificial Sequence
  derived and/or modified CDS sequence (opt3) from DENV-3__KJ189293__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccacccucccagaauauggaacucuuggccuggagugcucuccgcgaaccgguuuggacuucaaugagaugauccuacugacaaugaaaaacaaggcguggauggugcauagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcacacagcucucaccggcgccacagaaauccagaauucagggggaacuaguauuuucgcaggucaucugaagugucgguuaaaaauggacaagcuggagcuaaaaggcaugagcuacgccaugugcaccaacacguuugugcucaagaaagaggucucugaaacccagcacgggacaauacugaucaagguggaguacaagggagaagaugcucccuguaaaauuccuuucuccacugaggacggccaugguaaggcgcacaacgggcgucuuaucaccgcaaauccaguugugacaaaaaaggaggaacccguaaacauagaggccgaaccgccuuucggcgagucaaauauugucaucggaaucggcgauaacgcuuugaaaauuaauugguauaagaaggggagcaguaucggaaaaauguuugaagccacugcacgcggugccagaaggauggcuauucugggcgacaccgccugggauuucgggucugugggaggcguucucaacucccuggguaagauggugcaucaaauauuugggagcgcauacacggcgcuuuucucgggcgucucuugggugaugaaaaucggaauuggcguacuguugacauggaucgggcucaauuccaagaacaccucaaugaguuuuagcugcaucgcuauuggaauaaucacucuguauuuaggcgccgugguucaggcagacauggguugugucauuaauuggaaagggaaggagcugaagugcggauccggcaucuucgugacaaacgaggugcacaccuggacugaacaguacaaauuucaggccgauucucccaagcggcuagcuaccgccauugcaggugcuugggagaauggcgucugugggauccgaagcacaacgcgcauggaaaaccuccuguggaaacaaauagccaaugagcuuaacuauaucuugugggaaaauaacauuaagcugaccguuguggugggagacaucauuggcguacucgagcaggggaaaagaacucugacaccacagccuauggaguuaaaguacucauggaaaaccuggggaaaggcgaagaucgucacagccgaaacucagaacaguuccuucauaauugauggccccaauaccccagagugccccagcgcuucuagggcauggaacgugugggaaguugaggacuaugguuuugggguguucacgacaaauaucuggcugcggcuucgcgaagucuacacccaauugugugaccacagacucaugucagccgcugugaaagaugagagggccguucaugcagacaugggauacuggauugagagucagaagaacggcagcuggaaacuggaaaaggcgucccuaaucgaggugaaaacuugcaccuggccuaagucucacacacuguggucgaaugguguacucgaaagcgauaugauaaucccaaagucccuggccggcccgauuucacagcauaaccaccgucccggguaucacacucagaccgcuggaccuuggcaucuuggcaaauuggagcuggacuuuaauuacugcgaggggacaacggucgugaucaccgaaaacuguggaacucggggcccaaguuuacgaacaaccacugugucugguaagcucauucacgaguggugcuguagaagcugcacacugcccccucuuagguauaugggggaagauggauguugguacggcauggagauccgcccaauauccgaaaaagaggagaauauggucaagucacugguuagcgccgguucuggcaaaguggacaacuucaccauggggguauugugccucgcaauucuguuugaagaggugaugcggggaaaguucggcaagaaacauaugaucgcuggggucuucuuuacguucgugcuacugcucuccggacaaaucacuuggagagauauggcccacacccugauuaugaucggcaguaaugcaagcgacaggauggguauggggguuacauaucuugccuugauugcuaccuuuaagauacagcccuuccuggcguuaggauuuuuccuccgcaaacugacuucucgagaaaaccuucugcuaggcgugggccucgccauggcaacaacccugcaguugccggaggauaucgaacaaauggcuaaugggauugcccugggauuaauggcccucaagcugaucacacaguuugagacuuaccagcuuuggaccgcucugauuuccuugacguguucaaacacaaucuucacccucacugucgcauggcggaccgccacacugauacuagcgggugugagucugcuuccuguuugccagagcucguccaugcguaaaacugacuggcucccaauggcuguggccgcaaugggcguccccccucugcccuuguuuaucuucucucugaaggauaccuuaaagagaaggagcuggccacucaaugaggggguaauggccgugggacugguuucaauucuugcuaguucccuguugcgcaacgacgugccuauggcaggcccccucgucgccggugggcugcuaaucgcguguuaugugauuacgggaacaucugcugaucugaccguagaaaaagccgcagacaucacuugggaggaagaggccgaacaaacaggcgugagccauaaccuuaugauaaccgucgacgaugacggcacuaugcggauuaaggaugacgagacagagaauauccucaccguucuguugaaaacggcuuuacugaucguguccgggauuuuuccauacucaauaccggccacucuccugguguggcacaccuggcagaagcagacacagagaagcggaguccuuugggaugugccuagucccccagaaacccaaaaagcagagcuggaagaggguguuuacaggaucaagcagcagggcauuuucgggaaaacacagguaggagugggcguccaaaaggaggguguguuucacacuauguggcauguuacccgaggggcuguguugacguauaacggaaagcgccuagaacccaauugggccucugucaaaaaggaccugaucuccuacggcggcggguggcggcucagcacacaguggcagaaaggagaggaagugcaaguaauugcggucgagccugguaagaacccaaaaaauuuccagacuaugcccggcaccuuccagacaaccacuggggaaaucggagccauagcacuggauuuuaagccuggcaccucggguucaccgaucauuaacagagaggggaaggugguuggacuuuauggcaauggcguggucacaaaaaacgggggauacgugucugguaucgcucagacgaaugccgagccagacggccccacuccugaauuagaggaagagauguucaagaaaaggaaccugaccauuauggaucuccacccagggaguggaaagacacguaaauauuugcccgcuaucguucgcgaagcaauaaagcggagacugaggacccucauucuggccccuacucgaguggucgccgcugagauggaggaagcgcuuaagggccugccgauccgguaccaaacaaccgcaacgaaauccgagcauacuggucgcgaaaucguggacuugaugugccacgccacauuuaccaugagacuacugagccccguaagggugccaaauuauaaccucauuaucauggaugaggcucauuucaccgacccugccucuauagcagcccggggguacauuagcacucgaguuggaaugggcgaagcugcggccaucuuuaugacagcaacccccccaggcacagcugaugccuucccucaguccaaugcacccauucaggacgaggagagagacaucccagaacgcucauggaacagugggaaugaguggauaacugauuuugccggaaagacggucugguucgugccgagcauuaaagcugguaacgacaucgccaacuguuuaaggaagaauggcaaaaaggugauccagcugucucguaagaccuuugauacagaauaccaaaaaacuaagcuuaacgacugggauuucgucguaaccacagacauuuccgagaugggggcgaauuuuaaagcagaucgggugaucgacccuagaaggugccugaagcccguuauucucaccgauggaccagagcgcgugauauuggccggccccaugccugucacugcugccucagcugcacagcgaagaggucggguggggaggaacccacagaaagaaaaugaccaguauaucuucacgggccaaccccugaacaaugaugaggaccacgcccacuggaccgaagcuaagaugcuccuggacaacauuaauacaccugagggaaucaucccggcccuuuucgaaccagagcgcgagaagagugcagcgauugauggcgaauaccgucuaaaaggggagagcagaaagacuuuuguugaacugaugcggaggggagacuugcccgugugguuagcccauaaagucgcuuccgaggguauaaaguauaccgaucgcaaauggugcuucgacggccagcgaaacaaucagauccuggaagagaacauggauguggagauuuggacaaaggaaggggagaaaaagaagcucagaccucgguggcuggacgccaggaccuacucugauccccuugcacugaaagaauuuaaggacuucgcugccggacgcaaaucgaucgcacucgauuugguaacugagauuggcagagugccaagccaccuggcccauaggacacggaaugcucuagacaaccugguuaugcuccacacgucagaacacggugggcgugcguaucgccaugccgucgaggagcuuccugaaaccauggagacucuguuauugcugggccucaugauccugcuuacaggaggcgcaaugcuguuucucauauccgggaagggaaucgguaaaaccaguauuggcuugaucugugugauugcuucuagcgggaugcuguggauggccgaaauccccuuacaguggauagccuccgcaauugugcuagaguucuuuaugaugguccugcucaucccagagccugaaaagcaacgaaccccgcaggauaaucagcuugcuuacguugugauuggaauccugacauuggccgcgauaaucgcugccaacgagaugggccugcucgaaacuacgaagagagaccuggguaugucaaaagagcccgggguagugucuccaaccagcuaucuugaugucgaccuccacccugcaagugccuggacacuguacgcuguggcaacuaccguuauuacacccauguugaggcauaccaucgaaaauuccacugccaacgugagccuggcggcuauugccaaccaagcagucguauuaaugggccuagacaagggauggccaaucucuaaaauggaucugggcgugccucuccuugcccuggggugcuacucacagguuaaucccuugacgcugacagcugccgugcuccugcuuauaacccacuaugcaauuaucggaccgggcuuacaggcuaaggccacucgggaggcgcagaaacgcaccgccgcagguaucaugaagaacccaacagucgacgggauuaugacuaucgaucuggacccugugauauacgauuccaaguucgagaaacaacucggacaggucauguugcuggugcuaugugcuguucagcugcuccuuaugagaaccaguugggcccugugcgaagcauugacacuggcuacgggccccauuaccacucucugggaggguagcccaggcaaguuuuggaauacaaccaucgccgugucgauggccaacauuuucagggggucuuaucuggcgggagcuggcuuagcauuuuccaucaugaaaagcguagggacuggaaagcggggcacagguucacagggggaaacccuuggagagaaauggaagaagaaacugaaucaacucagucgaaaggaauucgaccuauacaaaaagucuggcauaacggagguggauagaaccgaggccaaagaaggucugaagcgcggcgagaucacacaucacgcugucuccagggggagcgccaaauugcagugguuuguugaacggaacauggugauucccgagggacgugucaucgaccugggcugugggagaggaggcuggucauauuacugcgcaggucucaagaaggugacugaaguaaggggguauaccaaaggaggcccuggccacgaggagccggugcccaugaguacauacggguggaauauuguuaagcuuaugagcggaaaagauguguucuaccugccaccugaaaagugugacacuuugcugugcgauaucggugaguccucucccagcccuaccgucgaagagucccgcacaauucgggugcucaaaauggucgagccaugguuaaagaacaaucaguucuguaucaaggugcugaaccccuauaugccuaccguuauagaacaucuugagcgacugcagagaaaacacggcgggaugcuaguaaggaauccacucucacgcaacucuacucaugaaauguacuggauuaguaauggaacgggcaacaucguggccucggucaauauggugagccggcuguugcugaacagauuuacaaugacccaccguaggcccacuaucgagaaggacguugaucucggugcugggacccggcacgugaacgcggaaccggagacaccuaauauggacgucauuggagagcgcauaaaacgaaucaaggaagagcauaacuccacguggcacuaugacgaugaaaauccauacaaaaccugggccuaucauggcucuuacgaggugaaggcaacuggcucagcuagcuccaugauuaacgggguagugaagcuucugacaaaacccugggacguugucccuauggugacccaaauggccaugacugauacaaccccauucggacagcagagaguguuuaaggaaaaagucgacacaaggacuccccggaguaugccggguacccgcagaguuaugggcaucacggcagagugguuauggaggacccuggggcgaaauaagaaaccucgguugugcacacgugaggaauucacuaagaaggugagaaccaacgccgcuaugggagccguauuuacagaggaaaaucaaugggauucugcgaaagcagccguggaggacgaagauuucuggaagcucgucgaccgcgagagggagcugcacaaacuaggcaagugugguagcugcguguauaacaugauggggaaacgggaaaagaaacuuggagaguuuggcaaggcuaagggcucaagagccauuugguacauguggcugggggcacgcuaccucgaauucgaggcucugggauuuuugaaugaggaucauugguucuccagggaaaacaguuauagcgguguugagggcgaagggcugcacaaacucggauacauccuucgagacauaucuaagauccccggcggugccauguaugcugaugacacugccgggugggacacccggauuacggaggaugaccugcacaaugaagagaaaaucacacagcagauggauccagagcauagacaguuagcaaacgcgauuuuuaagcugaccuaccaaaauaaaguggucaaggugcagaggccuacucccacaggaaccguaauggacaucauaucccgcaaggaucagcguggcucaggccagguugggacuuauggauugaacaccuucacaaauauggaagcccaacucauucggcagauggagggugaaggcgugcugagcaaagcugaccuagagaacccacaccuucccgaaaagaaaaucacgcaguggcuggagaccaagggggucgagagacucaaaaggauggccaucucgggagaugacugcguggugaagccuauugaugaccgcuuugcaaacgcucuguuggccuuaaaugauaugggcaagguccgaaaagacauaccacaguggcaaccgucuaaggguuggcaugauuggcagcagguucccuucuguagucaccacuuccaugaacugaucaugaaagacgggcggaagcucgugguaccuugcagaccacaggacgagcuuauuggaagggcacgcaucucccaaggcgccggcuggagccugagagaaacugcgugucuagggaaagcuuacgcccagauguggucacugauguauuuucaccggagggaucuccguuuggcauccaacgccauuugcucugcugugcccguccauugggugccuacaagccgaaccacuuggaguauccacgcccaucaccaguggaugacaaccgaggacaugcugacgguuuggaaucgcguguggauagaagauaacccauggauggaggacaagacacccgucaccacuugggaggaugugccuuaccuuggaaagagagaagaccaauggugugguucccugaucggccucaccagccgggcaacaugggcucagaauauuccgacugccauccagcagguaaggucuuuaauugggaacgaggaauuccuggauuacaugccaucaaugaaacgcuuuagaaaggaggaggaaagugagggagcgaucugguga

SEQ ID NO: 15374 - RNA, 9873 nt, Artificial Sequence
  derived and/or modified CDS sequence (opt3) from DENV-3__KJ189294__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccacccucccagaauauggaacucuuggccuggagugcucuccgcgaaccgguuuggacuucaaugagaugauccuacugacaaugaaaaacaaggcguggauggugcauagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcacacagcucucaccggcgccacagaaauccagaauucagggggaacuaguauuuucgcaggucaucugaagugucgguuaaaaauggacaagcuggagcuaaaaggcaugagcuacgccaugugcaccaacacguuugugcucaagaaagaggucucugaaacccagcacgggacaauacugaucaagguggaguacaagggagaagaugcucccuguaaaauuccuuucuccacugaggacggccaugguaaggcgcacaacgggcgucuuaucaccgcaaauccaguugugacaaaaaaggaggaacccguaaacauagaggccgaaccgccuuucggcgagucaaauauugucaucggaaucggcgauaacgcuuugaaaauuaauugguauaagaaggggagcaguaucggaaaaauguuugaagccacugcacgcggugccagaaggauggcuauucugggcgacaccgccugggauuucgggucugugggaggcguucucaacucccuggguaagauggugcaucaaauauuugggagcgcauacacggcgcuuuucucgggcgucucuugggugaugaaaaucggaauuggcguacuguugacauggaucgggcucaauuccaagaacaccucaaugaguuuuagcugcaucgcuauuggaauaaucacucuguauuuaggcgccgugguucaggcagacauggguugugucauuaauuggaaagggaaggagcugaagugcggauccggcaucuucgugacaaacgaggugcacaccuggacugaacaguacaaauuucaggccgauucucccaagcggcuagcuaccgccauugcaggugcuugggagaauggcgucugugggauccgaagcacaacgcgcauggaaaaccuccuguggaaacaaauagccaaugagcuuaacuauaucuugugggaaaauaacauuaagcugaccguuguggugggagacaucauuggcauccucgagcaggggaaaagaacucugacaccacagccuauggaguuaaaguacucauggaaaaccuggggaaaggcgaagauaguaacagccgaaacucagaacaguuccuucauuaucgauggccccaauaccccagagugccccagcgcuucuagggcauggaacgucugggaaguggaggacuaugguuuugggguuuucacgacaaauauuuggcugcggcuucgcgaaguguacacccaauugugugaccacagacucaugucagccgcugucaaagaugagagggccgugcaugcagacaugggauacuggaucgagagucagaagaacggcagcuggaaacuggaaaaggcgucccuaauagagguuaaaacuugcaccuggccuaagucucacacacuguggucgaauggugugcucgaaagcgauaugaucauuccaaagucccuggccggcccgaucucacagcauaaccaccgucccggguaucacacucagaccgcuggaccuuggcaucuuggcaaauuggagcuggacuuuaauuacugcgaggggacaacgguagucauuaccgaaaacuguggaacucggggcccaaguuuacgaacaaccacugugucugguaagcucauccacgaguggugcuguagaagcugcacacugcccccucuuagguauaugggggaagauggauguugguacggcauggagauacgcccaauuuccgaaaaagaggagaauauggugaagucacuggucagcgccgguucuggcaaaguugacaacuucaccauggggguguugugccucgcaauccuguuugaagagguaaugcggggaaaguucggcaagaaacauaugaucgcugggguguucuuuacguucguccuacugcucuccggacaaauuacuuggagagauauggcccacacccugaucaugauuggcaguaaugcaagcgacaggauggguaugggggugacauaucuugccuugauagcuaccuuuaagauccagcccuuccuggcguuaggauuuuuccuccgcaaacugacuucucgagaaaaccuucugcuaggcguuggccucgccauggcaacaacccugcaguugccggaggauauugaacaaauggcuaaugggaucgcccugggauuaauggcccucaagcugauuacacaguuugagacuuaccagcuuuggaccgcucugaucuccuugacguguucaaacacaauauucacccucacuguggcauggcggaccgccacacugauccuagcgggugucagucugcuuccugugugccagagcucguccaugcguaaaacugacuggcucccaauggcuguugccgcaaugggcgugcccccucugcccuuguuuauuuucucucugaaggauaccuuaaagagaaggagcuggccacucaaugagggggucauggccguaggacuggugucaauccuugcuaguucccuguugcgcaacgacguuccuauggcaggcccccucguggccggugggcugcuaauugcguguuaugucaucacgggaacaucugcugaucugaccguggaaaaagccgcagacauaacuugggaggaagaggccgaacaaacaggcguaagccauaaccuuaugauuaccguggacgaugacggcacuaugcggaucaaggaugacgagacagagaauauccucaccguccuguugaaaacggcuuuacugauuguuuccgggauauuuccauacucaaucccggccacucuccugguguggcacaccuggcagaagcagacacagagaagcggagugcuuugggaugucccuagucccccagaaacccaaaaagcagagcuggaagaggguguguacaggauuaagcagcagggcaucuucgggaaaacacagguuggaguaggcgugcaaaaggagggugucuuucacacuauguggcaugugacccgaggggcuguuuugacguauaacggaaagcgccuagaacccaauugggccucugugaaaaaggaccugauuuccuacggcggcggguggcggcucagcacacaguggcagaaaggagaggaaguccaagugaucgcgguagagccugguaagaacccaaaaaauuuccagacuaugcccggcaccuuccagacaaccacuggggaaauaggagccaucgcacuggauuuuaagccuggcaccucggguucaccgauuaucaacagagaggggaaggucgugggacuuuauggcaauggcguugugacaaaaaacgggggauacgucucugguauugcucagacgaaugccgagccagacggccccacuccugaauuagaggaagagauguucaagaaaaggaaccugaccaucauggaucuccacccagggaguggaaagacacguaaauauuugcccgcuauagugcgcgaagcaauuaagcggagacugaggacccucauccuggccccuacucgaguuguggccgcugagauggaggaagcgcuuaagggccugccgauccgguaccaaacaaccgcaacgaaauccgagcauacuggucgcgaaauugucgacuugaugugccacgccacauuuaccaugagacuacugagccccgugaggguaccaaauuauaaccucaucauaauggaugaggcucauuucaccgacccugccucuauugcagcccggggguacaucagcacucgagugggaaugggcgaagcugcggccauuuuuaugacagcaacccccccaggcacagcugaugccuucccucaguccaaugcacccauccaggacgaggagagagacauaccagaacgcucauggaacagugggaaugaguggauuacugauuuugccggaaagacgguuugguucgucccgagcaucaaagcugguaacgacaucgccaacuguuuaaggaagaauggcaaaaaggugauucagcugucucguaagaccuuugauacagaauaccaaaaaacuaagcuuaacgacugggauuucguggucaccacagacaucuccgagaugggggcgaauuuuaaagcagaucggguaauugacccuagaaggugccugaagcccgugauacucaccgauggaccagagcgcguuaucuuggccggccccaugccugugacugcugccucagcugcacagcgaagaggucgggucgggaggaacccacagaaagaaaaugaccaguauauuuucacgggccaaccccugaacaaugaugaggaccacgcccacuggaccgaagcuaagaugcuccuggacaacaucaauacaccugagggaaucauuccggcccuuuucgaaccagagcgcgagaagagugcagcgauagauggcgaauaccgucuaaaaggggagagcagaaagacuuuuguggaacugaugcggaggggagacuugcccguuugguuagcccauaaaguggcuuccgaggguaucaaguauaccgaucgcaaauggugcuucgacggccagcgaaacaaucagauucuggaagagaacauggaugucgagaucuggacaaaggaaggggagaaaaagaagcucagaccucgguggcuggacgccaggaccuacucugauccccuugcacugaaagaauuuaaggacuucgcugccggacgcaaaucgauugcacucgauuuggugacugagaucggcagaguaccaagccaccuggcccauaggacacggaaugcucuagacaaccuggugaugcuccacacgucagaacacggugggcgugcguaucgccaugccguugaggagcuuccugaaaccauggagacucuguuauugcugggccucaugauacugcuuacaggaggcgcaaugcuguuucucaucuccgggaagggaauugguaaaaccaguaucggcuugauuugugucaucgcuucuagcgggaugcuguggauggccgaaauacccuuacaguggauugccuccgcaaucgugcuagaguucuuuaugauggugcugcucauuccagagccugaaaagcaacgaaccccgcaggauaaucagcuugcuuacgucguuaucggaauacugacauuggccgcgaucauugcugccaacgagaugggccugcucgaaacuacgaagagagaccuggguaugucaaaagagcccggggugguaucuccaaccagcuaucuugauguggaccuccacccugcaagugccuggacacuguacgcugucgcaacuaccgugaucacacccauguugaggcauaccauugaaaauuccacugccaacguuagccuggcggcuaucgccaaccaagcaguggucuuaaugggccuagacaagggauggccaauaucuaaaauggaucugggcguaccucuccuugcccuggggugcuacucacaggugaaucccuugacgcugacagcugccguucuccugcuuauuacccacuaugcaaucaucggaccgggcuuacaggcuaaggccacucgggaggcgcagaaacgcaccgccgcagguauuaugaagaacccaacaguggacgggaucaugacuauagaucuggacccugucauuuacgauuccaaguucgagaaacaacucggacaggugauguugcugguccuaugugcugugcagcugcuccuuaugagaaccaguugggcccugugcgaagcauugacacuggcuacgggccccaucaccacucucugggaggguagcccaggcaaguuuuggaauacaaccauugccguuucgauggccaacaucuucagggggucuuaucuggcgggagcuggcuuagcauuuuccauaaugaaaagcguggggacuggaaagcggggcacagguucacagggggaaacccuuggagagaaauggaagaagaaacugaaucaacucagucgaaaggaauucgaccuauacaaaaagucuggcaucacggagguagauagaaccgaggccaaagaaggucugaagcgcggcgagauuacacaucacgcuguguccagggggagcgccaaauugcagugguuugucgaacggaacaugguuauccccgagggacgugugauugaccugggcugugggagaggaggcuggucauauuacugcgcaggucucaagaaggucacugaagugaggggguauaccaaaggaggcccuggccacgaggagccgguacccaugaguacauacggguggaauaucgugaagcuuaugagcggaaaagauguuuucuaccugccaccugaaaagugugacacuuugcugugcgauauuggugaguccucucccagcccuaccguggaagagucccgcacaauccggguccucaaaaugguggagccaugguuaaagaacaaucaguucuguauaaagguccugaaccccuauaugccuaccgugauugaacaucuugagcgacugcagagaaaacacggcgggaugcuaguuaggaauccacucucacgcaacucuacucaugaaauguacuggaucaguaauggaacgggcaacaucguagccucggugaauauggucagccggcuguugcugaacagauuuacaaugacccaccguaggcccacuauugagaaggacguggaucucggugcugggacccggcacguuaacgcggaaccggagacaccuaauauggacgugauaggagagcgcaucaaacgaauuaaggaagagcauaacuccacguggcacuaugacgaugaaaauccauacaaaaccugggccuaucauggcucuuacgaggucaaggcaacuggcucagcuagcuccaugaucaacggggugguaaagcuucugacaaaacccugggacgugguuccuauggucacccaaauggccaugacugauacaaccccauucggacagcagagaguguuuaaggaaaaaguggacacaaggacuccccggaguaugccggguacccgcagagucaugggcauuacggcagagugguuauggaggacccuggggcgaaauaagaaaccucgguugugcacacgugaggaauucacuaagaagguuagaaccaacgccgcuaugggagccguguuuacagaggaaaaucaaugggauucugcgaaagcagccguagaggacgaagauuucuggaagcucguggaccgcgagagggagcugcacaaacuaggcaagugugguagcugcgucuauaacaugauggggaaacgggaaaagaaacuuggagaguuuggcaaggcuaagggcucaagagccaucugguacauguggcugggggcacgcuaccucgaauucgaggcucugggauuuuugaaugaggaucauugguucuccagggaaaacaguuauagcgguguggagggcgaagggcugcacaaacucggauacauacuucgagacaucucuaagauucccggcggugccauguaugcugaugacacugccgggugggacacccggaucacggaggaugaccugcacaaugaagagaaaauuacacagcagauggauccagagcauagacaguuagcaaacgcgaucuuuaagcugaccuaccaaaauaaaguugugaagguccagaggccuacucccacaggaaccgugauggacauaauuucccgcaaggaucagcguggcucaggccagguagggacuuauggauugaacaccuucacaaauauggaagcccaacucauccggcagauggagggugaaggcguucugagcaaagcugaccuagagaacccacaccuucccgaaaagaaaaucacgcaguggcuggagaccaaggggguggagagacucaaaaggauggccauuucgggagaugacugcgucgugaagccuauagaugaccgcuuugcaaacgcucuguuggccuuaaaugauaugggcaaggugcgaaaagacaucccacaguggcaaccgucuaaggguuggcaugauuggcagcagguccccuucuguagucaccacuuccaugaacugauuaugaaagacgggcggaagcucguugugccuugcagaccacaggacgagcuuaucggaagggcacgcauuucccaaggcgccggcuggagccugagagaaacugcgugucuagggaaagcuuacgcccagauguggucacugauguauuuucaccggagggaucuccguuuggcauccaacgccaucugcucugcuguacccgugcauugggucccuacaagccgaaccacuuggaguauacacgcccaucaccaguggaugacaaccgaggacaugcugacgguguggaaucgcguuuggaucgaagauaacccauggauggaggacaagacacccgugaccacuugggaggaugucccuuaccuuggaaagagagaagaccaauggugugguucccugauuggccucaccagccgggcaacaugggcucagaauaucccgacugccauucagcaggugaggucuuuaaucgggaacgaggaauuccuggauuacaugccaucaaugaaacgcuuuagaaaggaggaggaaagugagggagcgauuugguga

SEQ ID NO: 15375 - RNA, 9873 nt, Artificial Sequence
  derived and/or modified CDS sequence (opt3) from DENV-3__KJ189295__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccacccucccagaauauggaacucuuggccuggagugcucuccgcgaaccgguuuggacuucaaugagaugauccuacugacaaugaaaaacaaggcguggauggugcauagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcacacagcucucaccggcgccacagaaauccagaauucagggggaacuaguauuuucgcaggucaucugaagugucgguuaaaaauggacaagcuggagcuaaaaggcaugagcuacgccaugugcaccaacacguuugugcucaagaaagaggucucugaaacccagcacgggacaauacugaucaagguggaguacaagggagaagaugcucccuguaaaauuccuuucuccacugaggacggccaugguaaggcgcacaacgggcgucuuaucaccgcaaauccaguugugacaaaaaaggaggaacccguaaacauagaggccgaaccgccuuucggcgagucaaauauugucaucggaaucggcgauaacgcuuugaaaauuaauugguauaagaaggggagcaguaucggaaaaauguuugaagccacugcacgcggugccagaaggauggcuauucugggcgacaccgccugggauuucgggucugugggaggcguucucaacucccuggguaagauggugcaucaaauauuugggagcgcauacacggcgcuuuucucgggcgucucuugggugaugaaaaucggaauuggcguacuguugacauggaucgggcucaauuccaagaacaccucaaugaguuuuagcugcaucgcuauuggaauaaucacucuguauuuaggcgccgugguucaggcagacauggguugugucauuaauuggaaagggaaggagcugaagugcggauccggcaucuucgugacaaacgaggugcacaccuggacugaacaguacaaauuucaggccgauucucccaagcggcuagcuaccgccauugcaggugcuugggagaauggcgucugugggauccgaagcacaacgcgcauggaaaaccuccuguggaaacaaauagccaaugagcuuaacuauaucuugugggaaaauaacauuaagcugaccguuguggugggagacaucauuggcguacucgagcaggggaaaagaacucugacaccacagccuauggaguuaaaguacucauggaaaaccuggggaaaggcgaagaucgucacagccgaaacucagaacaguuccuucauaauugauggccccaauaccccagagugccccagcgcuucuagggcauggaacgugugggaaguugaggacuaugguuuugggguguucacgacaaauaucuggcugcggcuucgcgaagucuacacccaauugugugaccacagacucaugucagccgcugugaaagaugagagggccguucaugcagacaugggauacuggauugagagucagaagaacggcagcuggaaacuggaaaaggcgucccuaaucgaggugaaaacuugcaccuggccuaagucucacacacuguggucgaaugguguacucgaaagcgauaugauaaucccaaagucccuggccggcccgauuucacagcauaaccaccgucccggguaucacacucagaccgcuggaccuuggcaucuuggcaaauuggagcuggacuuuaauuacugcgaggggacaacggucgugaucaccgaaaacuguggaacucggggcccaaguuuacgaacaaccacugugucugguaagcucauucacgaguggugcuguagaagcugcacacugcccccucuuagguauaugggggaagauggauguugguacggcauggagauccgcccaauauccgaaaaagaggagaauauggucaagucacugguuagcgccgguucuggcaaaguggacaacuucaccauggggguauugugccucgcaauucuguuugaagaggugaugcggggaaaguucggcaagaaacauaugaucgcuggggucuucuuuacguucgugcuacugcucuccggacaaaucacuuggagagauauggcccacacccugauuaugaucggcaguaaugcaagcgacaggauggguauggggguuacauaucuugccuugauugcuaccuuuaagauacagcccuuccuggcguuaggauuuuuccuccgcaaacugacuucucgagaaaaccuucugcuaggcgugggccucgccauggcaacaacccugcaguugccggaggauaucgaacaaauggcuaaugggauugcccugggauuaauggcccucaagcugaucacacaguuugagacuuaccagcuuuggaccgcucugauuuccuugacguguucaaacacaaucuucacccucacugucgcauggcggaccgccacacugauacuagcgggugugagucugcuuccuguuugccagagcucguccaugcguaaaacugacuggcucccaauggcuguggccgcaaugggcguccccccucugcccuuguuuaucuucucucugaaggauaccuuaaagagaaggagcuggccacucaaugaggggguaauggccgugggacugguuucaauucuugcuaguucccuguugcgcaacgacgugccuauggcaggcccccucgucgccggugggcugcuaaucgcguguuaugugauuacgggaacaucugcugaucugaccguagaaaaagccgcagacaucacuugggaggaagaggccgaacaaacaggcgugagccauaaccuuaugauaaccgucgacgaugacggcacuaugcggauuaaggaugacgagacagagaauauccucaccguucuguugaaaacggcuuuacugaucguguccgggauuuuuccauacucaauaccggccacucuccugguguggcacaccuggcagaagcagacacagagaagcggaguccuuugggaugugccuagucccccagaaacccaaaaagcagagcuggaagaggguguuuacaggaucaagcagcagggcauuuucgggaaaacacagguaggagugggcguccaaaaggaggguguguuucacacuauguggcauguuacccgaggggcuguguugacguauaacggaaagcgccuagaacccaauugggccucugucaaaaaggaccugaucuccuacggcggcggguggcggcucagcacacaguggcagaaaggagaggaagugcaaguaauugcggucgagccugguaagaacccaaaaaauuuccagacuaugcccggcaccuuccagacaaccacuggggaaaucggagccauagcacuggauuuuaagccuggcaccucggguucaccgaucauuaacagagaggggaaggugguuggacuuuauggcaauggcguggucacaaaaaacgggggauacgugucugguaucgcucagacgaaugccgagccagacggccccacuccugaauuagaggaagagauguucaagaaaaggaaccugaccauuauggaucuccacccagggaguggaaagacacguaaauauuugcccgcuaucguucgcgaagcaauaaagcggagacugaggacccucauucuggccccuacucgaguggucgccgcugagauggaggaagcgcuuaagggccugccgauccgguaccaaacaaccgcaacgaaauccgagcauacuggucgcgaaaucguggacuugaugugccacgccacauuuaccaugagacuacugagccccguaagggugccaaauuauaaccucauuaucauggaugaggcucauuucaccgacccugccucuauagcagcccggggguacauuagcacucgaguuggaaugggcgaagcugcggccaucuuuaugacagcaacccccccaggcacagcugaugccuucccucaguccaaugcacccauucaggacgaggagagagacaucccagaacgcucauggaacagugggaaugaguggauaacugauuuugccggaaagacggucugguucgugccgagcauuaaagcugguaacgacaucgccaacuguuuaaggaagaauggcaaaaaggugauccagcugucucguaagaccuuugauacagaauaccaaaaaacuaagcuuaacgacugggauuucgucguaaccacagacauuuccgagaugggggcgaauuuuaaagcagaucgggugaucgacccuagaaggugccugaagcccguuauucucaccgauggaccagagcgcgugauauuggccggccccaugccugucacugcugccucagcugcacagcgaagaggucggguggggaggaacccacagaaagaaaaugaccaguauaucuucacgggccaaccccugaacaaugaugaggaccacgcccacuggaccgaagcuaagaugcuccuggacaacauuaauacaccugagggaaucaucccggcccuuuucgaaccagagcgcgagaagagugcagcgauugauggcgaauaccgucuaaaaggggagagcagaaagacuuuuguugaacugaugcggaggggagacuugcccgugugguuagcccauaaagucgcuuccgaggguauaaaguauaccgaucgcaaauggugcuucgacggccagcgaaacaaucagauccuggaagagaacauggauguggagauuuggacaaaggaaggggagaaaaagaagcucagaccucgguggcuggacgccaggaccuacucugauccccuugcacugaaagaauuuaaggacuucgcugccggacgcaaaucgaucgcacucgauuugguaacugagauuggcagagugccaagccaccuggcccauaggacacggaaugcucuagacaaccugguuaugcuccacacgucagaacacggugggcgugcguaucgccaugccgucgaggagcuuccugaaaccauggagacucuguuauugcugggccucaugauccugcuuacaggaggcgcaaugcuguuucucauauccgggaagggaaucgguaaaaccaguauuggcuugaucugugugauugcuucuagcgggaugcuguggauggccgaaauccccuuacaguggauagccuccgcaauugugcuagaguucuuuaugaugguccugcucaucccagagccugaaaagcaacgaaccccgcaggauaaucagcuugcuuacguugugauuggaauccugacauuggccgcgauaaucgcugccaacgagaugggccugcucgaaacuacgaagagagaccuggguaugucaaaagagcccgggguagugucuccaaccagcuaucuugaugucgaccuccacccugcaagugccuggacacuguacgcuguggcaacuaccguuauuacacccauguugaggcauaccaucgaaaauuccacugccaacgugagccuggcggcuauugccaaccaagcagucguauuaaugggccuagacaagggauggccaaucucuaaaauggaucugggcgugccucuccuugcccuggggugcuacucacagguuaaucccuugacgcugacagcugccgugcuccugcuuauaacccacuaugcaauuaucggaccgggcuuacaggcuaaggccacucgggaggcgcagaaacgcaccgccgcagguaucaugaagaacccaacagucgacgggauuaugacuaucgaucuggacccugugauauacgauuccaaguucgagaaacaacucggacaggucauguugcuggugcuaugugcuguucagcugcuccuuaugagaaccaguugggcccugugcgaagcauugacacuggcuacgggccccauuaccacucucugggaggguagcccaggcaaguuuuggaauacaaccaucgccgugucgauggccaacauuuucagggggucuuaucuggcgggagcuggcuuagcauuuuccaucaugaaaagcguagggacuggaaagcggggcacagguucacagggggaaacccuuggagagaaauggaagaagaaacugaaucaacucagucgaaaggaauucgaccuauacaaaaagucuggcauaacggagguggauagaaccgaggccaaagaaggucugaagcgcggcgagaucacacaucacgcugucuccagggggagcgccaaauugcagugguuuguugaacggaacauggugauucccgagggacgugucaucgaccugggcugugggagaggaggcuggucauauuacugcgcaggucucaagaaggugacugaaguaaggggguauaccaaaggaggcccuggccacgaggagccggugcccaugaguacauacggguggaauauuguuaagcuuaugagcggaaaagauguguucuaccugccaccugaaaagugugacacuuugcugugcgauaucggugaguccucucccagcccuaccgucgaagagucccgcacaauucgggugcucaaaauggucgagccaugguuaaagaacaaucaguucuguaucaaggugcugaaccccuauaugccuaccguuauagaacaucuugagcgacugcagagaaaacacggcgggaugcuaguaaggaauccacucucacgcaacucuacucaugaaauguacuggauuaguaauggaacgggcaacaucguggccucggucaauauggugagccggcuguugcugaacagauuuacaaugacccaccguaggcccacuaucgagaaggacguugaucucggugcugggacccggcacgugaacgcggaaccggagacaccuaauauggacgucauuggagagcgcauaaaacgaaucaaggaagagcauaacuccacguggcacuaugacgaugaaaauccauacaaaaccugggccuaucauggcucuuacgaggugaaggcaacuggcucagcuagcuccaugauuaacgggguagugaagcuucugacaaaacccugggacguugucccuauggugacccaaauggccaugacugauacaaccccauucggacagcagagaguguuuaaggaaaaagucgacacaaggacuccccggaguaugccggguacccgcagaguuaugggcaucacggcagagugguuauggaggacccuggggcgaaauaagaaaccucgguugugcacacgugaggaauucacuaagaaggugagaaccaacgccgcuaugggagccguauuuacagaggaaaaucaaugggauucugcgaaagcagccguggaggacgaagauuucuggaagcucgucgaccgcgagagggagcugcacaaacuaggcaagugugguagcugcguguauaacaugauggggaaacgggaaaagaaacuuggagaguuuggcaaggcuaagggcucaagagccauuugguacauguggcugggggcacgcuaccucgaauucgaggcucugggauuuuugaaugaggaucauugguucuccagggaaaacaguuauagcgguguugagggcgaagggcugcacaaacucggauacauccuucgagacauaucuaagauccccggcggugccauguaugcugaugacacugccgggugggacacccggauuacggaggaugaccugcacaaugaagagaaaaucacacagcagauggauccagagcauagacaguuagcaaacgcgauuuuuaagcugaccuaccaaaauaaaguggucaaggugcagaggccuacucccacaggaaccguaauggacaucauaucccgcaaggaucagcguggcucaggccagguugggacuuauggauugaacaccuucacaaauauggaagcccaacucauucggcagauggagggugaaggcgugcugcuaaaagcugaccuugagaacccacaccugcccgaaaagaaaaucacgcaguggcucgagaccaagggggucgagagacugaaaaggauggccaucagcggagaugacugcguggugaagccuauugaugaccgcuuugcaaacgcuuuguuagcccugaaugauaugggcaagguccgaaaagacauaccacaguggcaaccgucgaaggguuggcaugauuggcagcagguucccuucuguucucaccacuuccaugaacucaucaugaaagacgggcggaagcuugugguaccuugcagaccacaggacgagcugauuggaagggcacgcaucagucaaggcgccggcuggucccuaagagaaacugcgugucuggggaaagcuuacgcccagauguggagccucauguauuuucaccggagggauuugcgucuggcaucaaacgccauuugcuccgcugugcccguccauugggugccuacaucucgaaccacuuggagcauccacgcccaucaccaguggaugacaaccgaggacaugcuuacgguuuggaaucgcguguggauagaagauaacccauggauggaggacagaacacccgucaccacuugggaggaugugccuuaccugggaaagcgggaagaccaauggugugguagucucaucggcuuaaccuccagggcaacaugggcucagaauauuccgacugccauccagcagguacgcagccugauugggaacgaggaauucuuggauuacaugccaucuaugaagagauuucggaaagaggaggaaucagagggagcgaucugguga

SEQ ID NO: 15376 - RNA, 9873 nt, Artificial Sequence
  derived and/or modified CDS sequence (opt3) from DENV-3__KJ189297__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccacccucccagaauauggaacucuuggccuggagugcucuccgcgaaccgguuuggacuucaaugagaugauccuacugacaaugaaaaacaaggcguggauggugcauagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcacacagcucucaccggcgccacagaaauccagaauucagggggaacuaguauuuucgcaggucaucugaagugucgguuaaaaauggacaagcuggagcuaaaaggcaugagcuacgccaugugcaccaacacguuugugcucaagaaagaggucucugaaacccagcacgggacaauacugaucaagguggaguacaagggagaagaugcucccuguaaaauuccuuucuccacugaggacggccaugguaaggcgcacaacgggcgucuuaucaccgcaaauccaguugugacaaaaaaggaggaacccguaaacauagaggccgaaccgccuuucggcgagucaaauauugucaucggaaucggcgauaacgcuuugaaaauuaauugguauaagaaggggagcaguaucggaaaaauguuugaagccacugcacgcggugccagaaggauggcuauucugggcgacaccgccugggauuucgggucugugggaggcguucucaacucccuggguaagauggugcaucaaauauuugggagcgcauacacggcgcuuuucucgggcgucucuugggugaugaaaaucggaauuggcguacuguugacauggaucgggcucaauuccaagaacaccucaaugaguuuuagcugcaucgcuauuggaauaaucacucuguauuuaggcgccgugguucaggcagacauggguugugucauuaauuggaaagggaaggagcugaagugcggauccggcaucuucgugacaaacgaggugcacaccuggacugaacaguacaaauuucaggccgauucucccaagcggcuagcuaccgccauugcaggugcuugggagaauggcgucugugggauccgaagcacaacgcgcauggaaaaccuccuguggaaacaaauagccaaugagcuuaacuauaucuugugggaaaauaacauuaagcugaccguuguggugggagacaucauuggcguacucgagcaggggaaaagaacucugacaccacagccuauggaguuaaaguacucauggaaaaccuggggaaaggcgaagaucgucacagccgaaacucagaacaguuccuucauaauugauggccccaauaccccagagugccccagcgcuucuagggcauggaacgugugggaaguugaggacuaugguuuugggguguucacgacaaauaucuggcugcggcuucgcgaagucuacacccaauugugugaccacagacucaugucagccgcugugaaagaugagagggccguucaugcagacaugggauacuggauugagagucagaagaacggcagcuggaaacuggaaaaggcgucccuaaucgaggugaaaacuugcaccuggccuaagucucacacacuguggucgaaugguguacucgaaagcgauaugauaaucccaaagucccuggccggcccgauuucacagcauaaccaccgucccggguaucacacucagaccgcuggaccuuggcaucuuggcaaauuggagcuggacuuuaauuacugcgaggggacaacggucgugaucaccgaaaacuguggaacucggggcccaaguuuacgaacaaccacugugucugguaagcucauucacgaguggugcuguagaagcugcacacugcccccucuuagguauaugggggaagauggauguugguacggcauggagauccgcccaauauccgaaaaagaggagaauauggucaagucacugguuagcgccgguucuggcaaaguggacaacuucaccauggggguauugugccucgcaauucuguuugaagaggugaugcggggaaaguucggcaagaaacauaugaucgcuggggucuucuuuacguucgugcuacugcucuccggacaaaucacuuggagagauauggcccacacccugauuaugaucggcaguaaugcaagcgacaggauggguauggggguuacauaucuugccuugauugcuaccuuuaagauacagcccuuccuggcguuaggauuuuuccuccgcaaacugacuucucgagaaaaccuucugcuaggcgugggccucgccauggcaacaacccugcaguugccggaggauaucgaacaaauggcuaaugggauugcccugggauuaauggcccucaagcugaucacacaguuugagacuuaccagcuuuggaccgcucugauuuccuugacguguucaaacacaaucuucacccucacugucgcauggcggaccgccacacugauacuagcgggugugagucugcuuccuguuugccagagcucguccaugcguaaaacugacuggcucccaauggcuguggccgcaaugggcguccccccucugcccuuguuuaucuucucucugaaggauaccuuaaagagaaggagcuggccacucaaugaggggguaauggccgugggacugguuucaauucuugcuaguucccuguugcgcaacgacgugccuauggcaggcccccucgucgccggugggcugcuaaucgcguguuaugugauuacgggaacaucugcugaucugaccguagaaaaagccgcagacaucacuugggaggaagaggccgaacaaacaggcgugagccauaaccuuaugauaaccgucgacgaugacggcacuaugcggauuaaggaugacgagacagagaauauccucaccguucuguugaaaacggcuuuacugaucguguccgggauuuuuccauacucaauaccggccacucuccugguguggcacaccuggcagaagcagacacagagaagcggaguccuuugggaugugccuagucccccagaaacccaaaaagcagagcuggaagaggguguuuacaggaucaagcagcagggcauuuucgggaaaacacagguaggagugggcguccaaaaggaggguguguuucacacuauguggcauguuacccgaggggcuguguugacguauaacggaaagcgccuagaacccaauugggccucugucaaaaaggaccugaucuccuacggcggcggguggcggcucagcacacaguggcagaaaggagaggaagugcaaguaauugcggucgagccugguaagaacccaaaaaauuuccagacuaugcccggcaccuuccagacaaccacuggggaaaucggagccauagcacuggauuuuaagccuggcaccucggguucaccgaucauuaacagagaggggaaggugguuggacuuuauggcaauggcguggucacaaaaaacgggggauacgugucugguaucgcucagacgaaugccgagccagacggccccacuccugaauuagaggaagagauguucaagaaaaggaaccugaccauuauggaucuccacccagggaguggaaagacacguaaauauuugcccgcuaucguucgcgaagcaauaaagcggagacugaggacccucauucuggccccuacucgaguggucgccgcugagauggaggaagcgcuuaagggccugccgauccgguaccaaacaaccgcaacgaaauccgagcauacuggucgcgaaaucguggacuugaugugccacgccacauuuaccaugagacuacugagccccguaagggugccaaauuauaaccucauuaucauggaugaggcucauuucaccgacccugccucuauagcagcccggggguacauuagcacucgaguuggaaugggcgaagcugcggccaucuuuaugacagcaacccccccaggcacagcugaugccuucccucaguccaaugcacccauucaggacgaggagagagacaucccagaacgcucauggaacagugggaaugaguggauaacugauuuugccggaaagacggucugguucgugccgagcauuaaagcugguaacgacaucgccaacuguuuaaggaagaauggcaaaaaggugauccagcugucucguaagaccuuugauacagaauaccaaaaaacuaagcuuaacgacugggauuucgucguaaccacagacauuuccgagaugggggcgaauuuuaaagcagaucgggugaucgacccuagaaggugccugaagcccguuauucucaccgauggaccagagcgcgugauauuggccggccccaugccugucacugcugccucagcugcacagcgaagaggucggguggggaggaacccacagaaagaaaaugaccaguauaucuucacgggccaaccccugaacaaugaugaggaccacgcccacuggaccgaagcuaagaugcuccuggacaacauuaauacaccugagggaaucaucccggcccuuuucgaaccagagcgcgagaagagugcagcgauugauggcgaauaccgucuaaaaggggagagcagaaagacuuuuguugaacugaugcggaggggagacuugcccgugugguuagcccauaaagucgcuuccgaggguauaaaguauaccgaucgcaaauggugcuucgacggccagcgaaacaaucagauccuggaagagaacauggauguggagauuuggacaaaggaaggggagaaaaagaagcucagaccucgguggcuggacgccaggaccuacucugauccccuugcacugaaagaauuuaaggacuucgcugccggacgcaaaucgaucgcacucgauuugguaacugagauuggcagagugccaagccaccuggcccauaggacacggaaugcucuagacaaccugguuaugcuccacacgucagaacacggugggcgugcguaucgccaugccgucgaggagcuuccugaaaccauggagacucuguuauugcugggccucaugauccugcuuacaggaggcgcaaugcuguuucucauauccgggaagggaaucgguaaaaccaguauuggcuugaucugugugauugcuucuagcgggaugcuguggauggccgaaauccccuuacaguggauagccuccgcaauugugcuagaguucuuuaugaugguccugcucaucccagagccugaaaagcaacgaaccccgcaggauaaucagcuugcuuacguugugauuggaauccugacauuggccgcgauaaucgcugccaacgagaugggccugcucgaaacuacgaagagagaccuggguaugucaaaagagcccgggguagugucuccaaccagcuaucuugaugucgaccuccacccugcaagugccuggacacuguacgcuguggcaacuaccguuauuacacccauguugaggcauaccaucgaaaauuccacugccaacgugagccuggcggcuauugccaaccaagcagucguauuaaugggccuagacaagggauggccaaucucuaaaauggaucugggcgugccucuccuugcccuggggugcuacucacagguuaaucccuugacgcugacagcugccgugcuccugcuuauaacccacuaugcaauuaucggaccgggcuuacaggcuaaggccacucgggaggcgcagaaacgcaccgccgcagguaucaugaagaacccaacagucgacgggauuaugacuaucgaucuggacccugugauauacgauuccaaguucgagaaacaacucggacaggucauguugcuggugcuaugugcuguucagcugcuccuuaugagaaccaguugggcccugugcgaagcauugacacuggcuacgggccccauuaccacucucugggaggguagcccaggcaaguuuuggaauacaaccaucgccgugucgauggccaacauuuucagggggucuuaucuggcgggagcuggcuuagcauuuuccaucaugaaaagcguagggacuggaaagcggggcacagguucacagggggaaacccuuggagagaaauggaagaagaaacugaaucaacucagucgaaaggaauucgaccuauacaaaaagucuggcauaacggagguggauagaaccgaggccaaagaaggucugaagcgcggcgagaucacacaucacgcugucuccagggggagcgccaaauugcagugguuuguugaacggaacauggugauucccgagggacgugucaucgaccugggcugugggagaggaggcuggucauauuacugcgcaggucucaagaaggugacugaaguaaggggguauaccaaaggaggcccuggccacgaggagccggugcccaugaguacauacggguggaauauuguuaagcuuaugagcggaaaagauguguucuaccugccaccugaaaagugugacacuuugcugugcgauaucggugaguccucucccagcccuaccgucgaagagucccgcacaauucgggugcucaaaauggucgagccaugguuaaagaacaaucaguucuguaucaaggugcugaaccccuauaugccuaccguuauagaacaucuugagcgacugcagagaaaacacggcgggaugcuaguaaggaauccacucucacgcaacucuacucaugaaauguacuggauuaguaauggaacgggcaacaucguggccucggucaauauggugagccggcuguugcugaacagauuuacaaugacccaccguaggcccacuaucgagaaggacguugaucucggugcugggacccggcacgugaacgcggaaccggagacaccuaauauggacgucauuggagagcgcauaaaacgaaucaaggaagagcauaacuccacguggcacuaugacgaugaaaauccauacaaaaccugggccuaucauggcucuuacgaggugaaggcaacuggcucagcuagcuccaugauuaacgggguagugaagcuucugacaaaacccugggacguugucccuauggugacccaaauggccaugacugauacaaccccauucggacagcagagaguguuuaaggaaaaagucgacacaaggacuccccggaguaugccggguacccgcagaguuaugggcaucacggcagagugguuauggaggacccuggggcgaaauaagaaaccucgguugugcacacgugaggaauucacuaagaaggugagaaccaacgccgcuaugggagccguauuuacagaggaaaaucaaugggauucugcgaaagcagccguggaggacgaagauuucuggaagcucgucgaccgcgagagggagcugcacaaacuaggcaagugugguagcugcguguauaacaugauggggaaacgggaaaagaaacuuggagaguuuggcaaggcuaagggcucaagagccauuugguacauguggcugggggcacgcuaccucgaauucgaggcucugggauuuuugaaugaggaucauugguucuccagggaaaacaguuauagcgguguugagggcgaagggcugcacaaacucggauacauccuucgagacauaucucagauccccggcggugccauguaugcugaugacacugccgggugggacacccggauuacggaggaugaccugcacaaugaagagaagaucacacagcagauggauccagagcauagacaauuagcaaacgcgauuuuuaaacugaccuaccagaauaagguggucaaagugcagaggccuacucccacaggaaccguaauggacaucauaucccgcaaggaucagcguggcucaggccaaguugggacuuauggauugaacaccuucacaaauauggaagcccagcucauucggcagauggagggugaaggcgugcugagcaaggcugaccuagagaacccacaccuucccgaaaaaaagaucacgcaguggcuggagaccaaaggggucgagagacucaagaggauggccaucucgggagaugacugcguggugaaaccuauugaugaccgcuuugcaaacgcucuguuggccuuaaaugauaugggcaagguccgaaaggacauaccacaauggcagccgucuaaagguuggcaugauuggcagcagguucccuucuguagucaccacuuccaugaacugaucaugaaggacgggcggaaacucgugguaccuugcagaccacaagacgagcuuauuggaagggcacgcaucucccagggcgccggcuggagccugagagaaacugcgugucuagggaaggcuuacgcccagauguggucacugauguauuuucaccggagggaucuccguuuggcauccaacgccauuugcucugcugugcccguccauugggugccuacaagccgaaccacuuggaguauccacgcccaucaccaauggaugacaaccgaggacaugcugacgguuuggaaucgcguguggauagaagauaacccauggauggaggacaaaacacccgucaccacuugggaggaugugccuuaccuuggaaagagagaagaccaguggugugguucccugaucggccucaccagccgggcaacaugggcucagaauauuccgacugccauccagcaaguaaggucuuuaauugggaacgaggaauuccuggauuacaugccaucaaugaagcgcuuuagaaaagaggaggaaagugagggagcgaucugguga

SEQ ID NO: 15377 - RNA, 9873 nt, Artificial Sequence
  derived and/or modified CDS sequence (opt3) from DENV-3__KJ189298__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccacccucccagaauauggaacucuuggccuggagugcucuccgcgaaccgguuuggacuucaaugagaugauccuacugacaaugaaaaacaaggcguggauggugcauagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcacacagcucucaccggcgccacagaaauccagaauucagggggaacuaguauuuucgcaggucaucugaagugucgguuaaaaauggacaagcuggagcuaaaaggcaugagcuacgccaugugcaccaacacguuugugcucaagaaagaggucucugaaacccagcacgggacaauacugaucaagguggaguacaagggagaagaugcucccuguaaaauuccuuucuccacugaggacggccaugguaaggcgcacaacgggcgucuuaucaccgcaaauccaguugugacaaaaaaggaggaacccguaaacauagaggccgaaccgccuuucggcgagucaaauauugucaucggaaucggcgauaacgcuuugaaaauuaauugguauaagaaggggagcaguaucggaaaaauguuugaagccacugcacgcggugccagaaggauggcuauucugggcgacaccgccugggauuucgggucugugggaggcguucucaacucccuggguaagauggugcaucaaauauuugggagcgcauacacggcgcuuuucucgggcgucucuugggugaugaaaaucggaauuggcguacuguugacauggaucgggcucaauuccaagaacaccucaaugaguuuuagcugcaucgcuauuggaauaaucacucuguauuuaggcgccgugguucaggcagacauggguugugucauuaauuggaaagggaaggagcugaagugcggauccggcaucuucgugacaaacgaggugcacaccuggacugaacaguacaaauuucaggccgauucucccaagcggcuagcuaccgccauugcaggugcuugggagaauggcgucugugggauccgaagcacaacgcgcauggaaaaccuccuguggaaacaaauagccaaugagcuuaacuauaucuugugggaaaauaacauuaagcugaccguuguggugggagacaucauuggcguacucgagcaggggaaaagaacucugacaccacagccuauggaguuaaaguacucauggaaaaccuggggaaaggcgaagaucgucacagccgaaacucagaacaguuccuucauaauugauggccccaauaccccagagugccccagcgcuucuagggcauggaacgugugggaaguugaggacuaugguuuugggguguucacgacaaauaucuggcugcggcuucgcgaagucuacacccaauugugugaccacagacucaugucagccgcugugaaagaugagagggccguucaugcagacaugggauacuggauugagagucagaagaacggcagcuggaaacuggaaaaggcgucccuaaucgaggugaaaacuugcaccuggccuaagucucacacacuguggucgaaugguguacucgaaagcgauaugauaaucccaaagucccuggccggcccgauuucacagcauaaccaccgucccggguaucacacucagaccgcuggaccuuggcaucuuggcaaauuggagcuggacuuuaauuacugcgaggggacaacggucgugaucaccgaaaacuguggaacucggggcccaaguuuacgaacaaccacugugucugguaagcucauucacgaguggugcuguagaagcugcacacugcccccucuuagguauaugggggaagauggauguugguacggcauggagauccgcccaauauccgaaaaagaggagaauauggucaagucacugguuagcgccgguucuggcaaaguggacaacuucaccauggggguauugugccucgcaauucuguuugaagaggugaugcggggaaaguucggcaagaaacauaugaucgcuggggucuucuuuacguucgugcuacugcucuccggacaaaucacuuggagaaauauggcccacacccugauuaugaucggcaguaacgcaagcgauaggauggguauggggguuacauaucuugccuugauugcuaccuuuaagauacagcccuuccuggcguuaggauuuuuccuccgcaaacugacuucucgagaaaaucuucugcuaggcgugggccucgccauggcaacaacccugcaguugccggaggacaucgaacaaauggcuaacgggauugcccugggauuaauggcccucaagcugaucacacaguuugagacuuaccagcuuuggaccgcucugauuuccuugacguguucaaauacaaucuucacccucacugucgcauggcggaccgccacacugauacuagcgggugugagucugcuuccuguuugccagagcucguccaugcguaaaacugauuggcucccaauggcuguggccgcaaugggcguccccccucugcccuuguuuaucuucucucugaaggacaccuuaaagagaaggagcuggccacucaacgaggggguaauggccgugggacugguuucaauucuugcuaguucccuguugcgcaacgaugugccuauggcaggcccccucgucgccggugggcugcuaaucgcguguuaugugauuacgggaacaucugcugaccugaccguagaaaaagccgcagauaucacuugggaggaagaggccgaacaaacaggcgugagccauaaucuuaugauaaccgucgacgacgauggcacuaugcggauuaaggacgaugagacagagaacauccucaccguucuguugaaaacggcuuuacugaucguguccgggauuuuuccauacucaauaccggccacucuccugguguggcacaccuggcagaagcagacacagagaagcggaguccuuugggacgugccuagucccccagaaacccaaaaagcagagcuggaagaggguguuuacaggaucaagcagcagggcauuuucgggaaaacacagguaggagugggcguccaaaaggaggguguguuucacacuauguggcauguuacccgaggggcuguguugacguauaauggaaagcgccuagaacccaacugggccucugucaaaaaggaucugaucuccuacggcggcggguggcggcucagcacacaguggcagaaaggagaggaagugcaaguaauugcggucgagccugguaagaauccaaaaaacuuccagacuaugcccggcaccuuccagacaaccacuggggaaaucggagccauagcacuggacuuuaagccuggcaccucggguucaccgaucauuaauagagaggggaaggugguuggacuuuauggcaacggcguggucacaaaaaaugggggauacgugucugguaucgcucagacgaacgccgagccagauggccccacuccugaauuagaggaagagauguucaagaaaaggaaucugaccauuauggaccuccacccagggaguggaaagacacguaaauauuugcccgcuaucguucgcgaagcaauaaagcggagacugaggacccucauucuggccccuacucgaguggucgccgcugagauggaggaagcgcuuaagggccugccgauccgguaccaaacaaccgcaacgaaauccgagcauacuggucgcgaaaucguggauuugaugugccacgccacauuuaccaugagacuacugagccccguaagggugccaaacuauaaucucauuaucauggacgaggcucauuucaccgauccugccucuauagcagcccggggguacauuagcacucgaguuggaaugggcgaagcugcggccaucuuuaugacagcaacccccccaggcacagcugacgccuucccucaguccaacgcacccauucaggaugaggagagagacaucccagaacgcucauggaauagugggaacgaguggauaacugacuuugccggaaagacggucugguucgugccgagcauuaaagcugguaacgauaucgccaauuguuuaaggaagaacggcaaaaaggugauccagcugucucguaagaccuuugacacagaauaccaaaaaacuaagcuuaaugauugggacuucgucguaaccacagauauuuccgagaugggggcgaacuuuaaagcagaccgggugaucgauccuagaaggugccugaagcccguuauucucaccgacggaccagagcgcgugauauuggccggccccaugccugucacugcugccucagcugcacagcgaagaggucggguggggaggaauccacagaaagaaaacgaucaguauaucuucacgggccaaccccugaauaacgacgaggaucacgcccacuggaccgaagcuaagaugcuccuggacaauauuaacacaccugagggaaucaucccggcccuuuucgaaccagagcgcgagaagagugcagcgauugacggcgaauaccgucuaaaaggggagagcagaaagacuuuuguugaacugaugcggaggggagauuugcccgugugguuagcccauaaagucgcuuccgaggguauaaaguauaccgaccgcaaauggugcuucgauggccagcgaaauaaccagauccuggaagagaauauggacguggagauuuggacaaaggaaggggagaaaaagaagcucagaccucgguggcuggaugccaggaccuacucugacccccuugcacugaaagaauuuaaggauuucgcugccggacgcaaaucgaucgcacucgacuugguaacugagauuggcagagugccaagccaccuggcccauaggacacggaacgcucuagauaaucugguuaugcuccacacgucagaacacggugggcgugcguaucgccaugccgucgaggagcuuccugaaaccauggagacucuguuauugcugggccucaugauccugcuuacaggaggcgcaaugcuguuucucauauccgggaagggaaucgguaaaaccaguauuggcuugaucugugugauugcuucuagcgggaugcuguggauggccgaaauccccuuacaguggauagccuccgcaauugugcuagaguucuuuaugaugguccugcucaucccagagccugaaaagcaacgaaccccgcaggacaaccagcuugcuuacguugugauuggaauccugacauuggccgcgauaaucgcugccaaugagaugggccugcucgaaacuacgaagagagaucuggguaugucaaaagagcccgggguagugucuccaaccagcuaucuugacgucgaucuccacccugcaagugccuggacacuguacgcuguggcaacuaccguuauuacacccauguugaggcauaccaucgaaaacuccacugccaacgugagccuggcggcuauugccaaucaagcagucguauuaaugggccuagacaagggauggccaaucucuaaaauggaccugggcgugccucuccuugcccuggggugcuacucacagguuaaccccuugacgcugacagcugccgugcuccugcuuauaacccacuaugcaauuaucggaccgggcuuacaggcuaaggccacucgggaggcgcagaaacgcaccgccgcagguaucaugaagaauccaacagucgaugggauuaugacuaucgaccuggauccugugauauacgacuccaaguucgagaaacaacucggacaggucauguugcuggugcuaugugcuguucagcugcuccuuaugagaaccaguugggcccugugcgaagcauugacacuggcuacgggccccauuaccacucucugggaggguagcccaggcaaguuuuggaacacaaccaucgccgugucgauggccaauauuuucagggggucuuaucuggcgggagcuggcuuagcauuuuccaucaugaaaagcguagggacuggaaagcggggcacagguucacagggggaaacccuuggagagaaauggaagaagaaacugaaccaacucagucgaaaggaauucgaucuauacaaaaagucuggcauaacggagguggacagaaccgaggccaaagaaggucugaagcgcggcgagaucacacaucacgcugucuccagggggagcgccaaauugcagugguuuguugaacggaauauggugauucccgagggacgugucaucgaucugggcugugggagaggaggcuggucauauuacugcgcaggucucaagaaggugacugaaguaaggggguauaccaaaggaggcccuggccacgaggagccggugcccaugaguacauacggguggaacauuguuaagcuuaugagcggaaaagacguguucuaccugccaccugaaaagugugauacuuugcugugcgacaucggugaguccucucccagcccuaccgucgaagagucccgcacaauucgggugcucaaaauggucgagccaugguuaaagaauaaccaguucuguaucaaggugcugaaucccuauaugccuaccguuauagaacaucuugagcgacugcagagaaaacacggcgggaugcuaguaaggaacccacucucacgcaauucuacucaugaaauguacuggauuaguaacggaacgggcaauaucguggccucggucaacauggugagccggcuguugcugaacagauuuacaaugacccaccguaggcccacuaucgagaaggauguugaccucggugcugggacccggcacgugaaugcggaaccggagacaccuaacauggaugucauuggagagcgcauaaaacgaaucaaggaagagcauaauuccacguggcacuaugacgaagagaacccauacaaaaccugggccuaucauggcucuuacgaagugaaggcaacuggcucagcuagcuccaugauuaaugggguagugaagcuucugacaaaacccugggacguugucccuauggugacccaaauggccaugacugauacaaccccauucggacagcagagaguguuuaaggagaaagucgacacaaggacuccccggaguaugccggguacccgcagaguuaugggcaucacggcagagugguuauggaggacccuggggcgaaacaagaaaccucgguugugcacacgugaagaguucacuaagaaggugagaaccaaugccgcuaugggagccguauuuacagaagagaaccaaugggauucugcgaaagcagccguggaagacgaggauuucuggaagcucgucgaccgcgagagggaacugcacaaacuaggcaagugugguagcugcguguauaauaugauggggaaacgggagaagaaacuuggagaauuuggcaaggcuaagggcucaagagccauuugguacauguggcugggggcacgcuaccucgaguucgaggcucugggauuuuugaacgaagaucauugguucuccagggagaauaguuauagcgguguugaaggcgaggggcugcacaaacucggauacauccuucgagacauaucuaagauccccggcggugccauguaugcugaugacacugccgggugggauacccggauuacggaagacgaccugcacaacgaggagaaaaucacacagcagauggauccagaacauagacaguuagcaaaugcgauuuuuaagcugaccuaccaaaacaaaguggucaaggugcagaggccuacucccacaggaaccguaauggacaucauaucccgcaaggaucagcguggcucaggccagguugggacuuauggauugaauaccuucacaaacauggaggcccaacucauucggcagauggaaggugagggcgugcugagcaaagcugaccuagaaaacccacaccuucccgagaagaaaaucacgcaguggcuggagaccaagggggucgaaagacucaaaaggauggccaucucgggagaugacugcguggugaagccuauugaugaccgcuuugcaaaugcucuguuggccuuaaacgauaugggcaagguccgaaaagacauaccacaguggcaaccgucuaaggguuggcaugauuggcagcagguucccuucuguagucaccacuuccaugagcugaucaugaaagacgggcggaagcucgugguaccuugcagaccacaggaugaacuuauuggaagggcacgcaucucccaaggcgccggcuggagccugagagagacugcgugucuagggaaagcuuacgcccagauguggucacugauguauuuucaccggagggaccuccguuuggcauccaaugccauuugcucugcugugcccguccauugggugccuacaagccgaaccacuuggaguauccacgcccaucaccaguggaugacaaccgaagacaugcugacgguuuggaaccgcguguggauagaggauaauccauggauggaggacaagacacccgucaccacuugggaagaugugccuuaccuuggaaagagagaggaccaauggugugguucccugaucggccucaccagccgggcaacaugggcucagaacauuccgacugccauccagcagguaaggucuuuaauugggaaugaagaguuccuggauuacaugccaucaaugaaacgcuuuagaaaggaggaagagagugaaggagcgaucugguga

SEQ ID NO: 15378 - RNA, 9873 nt, Artificial Sequence
  derived and/or modified CDS sequence (opt3) from DENV-3__KJ189301__SS-prME
accagccugugccucaugaugauccuucccgccgcucuggcauuccacuugacauccagagacggcgagccuaggaugauuguggggaagaacgaacggggaaaaucuuuacuguuuaagacugccucagguacgaauauguguacccuaauagcgauggaucucggcgagaugugcgacgauacagucacuuacaaauguccacauaucaccgaaguugagccggaagacauugauugcugguguaaccugacaaguaccugggugacuuaugggacaugcaaucaggcuggagagcaccgccgagacaagcguagcguagcccuugcaccccaugugggcaugggucuggauaccagaacgcaaacuuggauguccgccgagggggcuuggaggcaggucgaaaaaguggagaccugggcauugcggcacccuggauucacaauccucgcccuguuucuggcucauuacauuggcacuucucucacccagaagguugugaucuucauauuacugaugcuugucacaccaucgaugaccaugcgcugugugggcguagggaacagagacuuuguugaaggauugucaggugccacguggguggaugucgugcuggagcacggcgggugcgugacuacaauggcgaagaauaaacccacccuagacaucgagcuccagaagacugaagcaacacaacuggccacccuuaggaaacuguguauugagggaaagaucacgaacauuaccacagauagccggugcccuacucagggcgaagcugucuugccagaggaacaggaccagaauuauguuuguaaacacaccuacguggaucgcgguugggggaacggaugcggccucuucggcaaggggagucugguaacaugcgccaaguuucaauguuuagagcccaucgagggaaaagugguccaguaugaaaaucugaaguacacugugauaauuaccguucauacaggugaccagcaccaggugggcaacgagacccaaggggucacugcagaaaucacgccucaggcuuccacaaccgaggccacucucccagaauauggaacccuuggccuggagugcucuccgcgaacagguuuggacuucaaugagaugauucuacugaccaugaaaaacaaggcguggauggugcauagacagugguuuuucgaucucccccugccuuggacuagcggggccacaacggaaaccccaacuuggaauaggaaagagcuucugguaacauuuaagaacgcacacgcuaaaaagcaagaaguuguggucuugggcucccaggagggagccaugcacaccgcucucacaggcgccacugaaauccagaauucagggggaaccaguaucuucgcaggucaucugaagugucgguuaaaaauggacaagcuggagcuaaaaggcaugagcuacgccaugugcacgaacaccuuugugcucaagaaagaggucucugaaacacagcacgggacuauucugauaaagguggaguacaagggagaagaugcucccuguaaaaucccuuucuccaccgaggacggccaugguaaggcgcacaacgggcgucuuauuacagcaaauccaguugugacuaaaaaggaggaacccguaaacaucgaggccgaaccgccuuucggcgagucaaauauagucauuggaaucggcgauaacgcuuugaaaaucaauugguauaagaaggggagcaguauuggaaaaauguuugaagccaccgcacgcggugccagaaggauggcuauccugggcgacacggccugggauuucgggucugugggaggcguucucaacucccuggguaagauggugcaucaaauuuuugggagcgcauacacagcgcuuuucucgggcgucucuugggugaugaaaauaggaaucggcguacuguugaccuggauugggcucaauuccaagaacacuucaaugaguuuuagcugcaucgcuaucggaauuauaacacuguauuuaggcgccgugguucaggcagacauggguugugucaucaauuggaaagggaaggagcugaagugcggauccggcauuuucgugaccaacgaggugcacacuuggaccgaacaguacaaauuucaggccgauucucccaagcggcuagcuacagccaucgcaggugcuugggagaauggcgucugugggauucgaagcacgacccgcauggaaaaccuccuguggaaacaaaucgccaaugagcuuaacuauauauugugggaaaauaacguuaagcugacuguggugguaggagacaucauuggcguccucgagagagggaaaaggacacugaccccacagccuauggaguuaaaguacucauggaaaacauggggaaaggcgaagaucgugacugccgaaacccagaacaguuccuucauuaucgauggccccaauacgccagagugccccagcgcuucucgggcauggaacguuugggaaguggaggacuaugguuuuggggucuucacaaccaauauauggcugcgccuuagagaagccuacacucaguugugugaccacaggcucaugucagcugccgugaaagaugagcgugcaguucaugcggacaugggauacuggauugagagucaaaagaacggcagcuggaaacuggaaaaggccucccuaaucgaggugaaaaccugcacauggccuaagucucacacucuguggucgaaugguguacucgaaagcgauaugauuaucccaaagucccuggcuggcccgauaucacagcauaaccaccggcccggguaucacacccagacagccggaccuuggcaucuuggcaaauuggagcuggacuuuaauuacugcgaggggacgaccgucgugaucacugaaaacuguggaacacgaggcccaaguuuaagaaccacuacagugucugguaagcucauucacgaguggugcuguaggagcugcacccugcccccucuucgcuauaugggggaagauggauguugguacggcauggagauccggccaauuuccgaaaaagaggagaauauggucaagucacugguuagcgcagguucuggcaaaguggacaacuucacgauggggguauugugccucgcuauccuguuugaagaggugaugagaggaaaguucggcaagaaacauaugauagccggggucuucuuuacuuucgugcuacugcucuccggacagauuaccuggagggauauggcacacacacugaucaugaucggcaguaaugccagcgaccgcauggguauggggguuaccuaucuugcuuugauugcgacuuuuaagauccaacccuuccuggccuuaggauuuuuccuccgaaaacugacaucucgggaaaaccuucugcuaggcgugggccucgcaauggcuaccacacugcaguugccggaggauauugaacagauggccaaugggauagcccugggauuaauggcucucaagcugaucacucaauuugagaccuaccagcuuuggacggcacugauuuccuugacauguucaaacaccaucuucacucucaccgucgccuggcguacagcgacucugauucuagcuggugugagucugcuuccuguuugccagagcucguccaugagaaaaaccgacuggcucccaauggccguggcagccaugggcguccccccucugcccuuguuuaucuucucucugaaggauacguuaaagaggcgcagcuggccacucaaugaggggguaauggcugugggacugguuucaauacuugcaaguucccuguugcggaacgacgugccuauggccggcccccucgucgcgggugggcugcuaaucgcuuguuaugugauuacaggaaccucugccgaucugacuguagaaaaagcagccgacaucacaugggaggaagaggcugaacagaccggcgugagccauaaccuuaugauuacugucgacgaugacggcacaaugagaaucaaggaugacgagaccgagaauauacucacgguucuguugaaaacugccuuacugauuguguccgggaucuuuccauacucaaucccggcaacccuccugguguggcacacauggcaaaagcagacccagaggagcggaguccuuugggaugugccuagucccccagaaacacagaaagcugagcuggaagaggguguuuaccgaauuaagcaacagggcauauucgggaaaacucagguaggagugggcguccagaaggaggguguguuucacaccauguggcauguuacgcgcggggccguguugacauauaacggaaagcggcuagaacccaauugggcgucugucaaaaaggaccugaucuccuacggcggcggguggagacucagcacucaauggcagaaaggagaggaagugcagguaauugccgucgagccugguaagaacccaaaaaauuuccaaaccaugcccggcacauuccagaccacuaccggggaaaucggagcaauugcucuggauuuuaagccuggcacaucggguucaccgaucauaaacagggaggggaaggugguuggacuuuauggcaauggcguggucacgaaaaacgggggauacgugucugguaucgcccagacuaaugcugagccagacggccccaccccugaauuagaggaagagauguucaagaaacguaaccugacaauuauggaucuccacccagggaguggaaagacccgcaaauauuugcccgcaaucguucgggaagccauuaagagaaggcugcgaacucucauccuggccccuacacggguggucgcugcggagauggaggaagcacuuaagggccugccgauacgcuaccagaccacggccacuaaauccgagcauacagguagagaaauuguggacuugaugugccacgcuaccuuuaccaugaggcuacugagccccguacgggugccaaauuauaaccucaucaucauggaugaggcccauuucacugacccugcaucuauugccgcucgaggguacaucagcacaagaguuggaaugggcgaagcggccgcaauauuuaugaccgcuacacccccaggcacugccgaugcauucccucaauccaaugcccccauucaggacgaggagcgcgacaucccagaaaggucauggaacagugggaaugaguggauuacggauuuugcuggaaagaccgucugguucgugccgagcaucaaagccgguaacgacauagcgaacuguuuacguaagaauggcaaaaaggugauucagcugucucggaagacauuugauacugaauaccagaaaaccaagcuuaacgacugggauuucgucguaacaaccgacaucuccgagaugggggcaaauuuuaaagccgauagagugaucgacccuaggcgcugccugaagcccguuauucucacugauggaccagagcgagugaucuuggcuggccccaugccugucacggccgcuucagcagcccaaagacgggguaggguggggcgcaacccacagaaagaaaaugaccaguauauuuucaccggccagccccugaacaaugaugaggaccacgcucacuggacagaagccaagaugcuccuggacaacauaaauacuccugagggaaucauuccggcacuuuucgaaccagagcgugagaagagugcggccaucgauggcgaauacagacuaaaaggggagagccggaagaccuuuguugaacugaugaggcgcggagacuugcccgugugguuagcucauaaagucgccuccgaggguaucaaguauacagaucgaaaauggugcuucgacggccaaagaaacaaucagauucuggaagagaacauggauguggagauauggaccaaggaaggggagaaaaagaagcuccggccuagguggcuggacgcacgcacuuacucugauccccuugcucugaaagaauuuaaggacuucgccgcaggaagaaaaucgaucgcccucgauuugguaacagagauuggcagggugccaagccaccuggcucaucggacgcguaaugcgcuagacaaccugguuaugcuccacaccucagaacacggugggcgcgccuaucgacaugcagucgaggagcuuccugaaacuauggagacacuguuauugcugggccucaugauccugcuuaccggaggcgcuaugcuguuucucauuuccgggaagggaaucgguaaaaccaguauaggcuugaucugugugauugccucuagcgggaugcuguggauggccgaaauccccuuacaguggauugcauccgcuaucgugcuagaguucuuuaugaugguccugcucguuccagagccugaaaagcagagaacaccgcaagauaaucagcuugccuacgugguaauaggaauucugacuuuggcggcuaucauugccgcaaacgagaugggccugcucgaaacgaccaagagggaccuggguaugucaaaagagcccgggguggucucuccaacaagcuaucuugauguggaccuccacccugccagugcuuggacucuguacgcaguugccaccacagugaucacccccauguugcggcauacuauagaaaauuccacggcgaacgucagccuggcugccaucgcaaaccaggccguaguguuaaugggccuagacaagggauggccaauuucuaaaauggaucugggcguuccucuccuugcucuggggugcuacucacaagugaaucccuugacacugaccgccgcaguccuccugcuuaucacucacuaugcuauuaucggaccgggcuuacaggccaaggcgacccgcgaggcccagaaaagaacagcagcugguauaaugaagaacccaacuguggacgggauuaugaccaucgaucuggacccugucaucuacgauuccaaguucgagaaacagcucggacaagugauguugcugguucuaugugccgugcagcugcuccuuaugaggacaaguugggcacugugcgaagcuuugacgcuggccaccggccccauuacuacacucugggaggguagcccaggcaaguuuuggaauaccacuaucgccguaucgauggcgaacauauuccgggggucuuaucuggcuggagcaggcuuagccuuuuccauuaugaaaagcguggggacaggaaagcgaggcaccgguucacagggggaaacgcuuggagagaaauggaagaagaaacugaaucagcucaguagaaaggaauucgaccuauacaaaaagucuggcaucaccgaggucgaucgcacagaggcuaaagaaggucugaagaggggcgagauuacucaucacgccguuucccgggggagcgcaaaauugcaaugguuuguggaacguaacauggucauccccgagggaagagugauagaccugggcugugggaggggaggcuggucauauuacugcgccggucucaagaagguaaccgaagugcgcggguauacaaaaggaggcccuggccacgaggagccgguucccaugaguacuuacggguggaauaucgugaagcuuaugagcggaaaagaugucuucuaccugccaccugaaaagugugacaccuugcugugcgauauuggugaguccucucccagcccuacaguggaagagucccggaccauccgaguccucaaaaugguggagccaugguuaaagaacaaucaguucuguauuaagguucugaaccccuauaugccuacuguaaucgaacaucuugagagacugcagaggaaacacggcgggaugcuagugcgcaauccacucucacggaacucuacgcaugaaauguacuggauuaguaauggaacaggcaacaucgucgcuucggugaauaugguuagcagacuguugcugaaccguuuuaccaugacucacaggcggcccaccauagagaaggacguggaucucggugcggggacacgccacgucaacgccgaaccggagacgccuaauauggacgugauuggagagcgaaucaaaagaaucaaggaagagcauaacuccaccuggcacuaugacgaugaaaauccauacaaaacuugggcauaucauggcucuuacgagguaaaggcuacaggcucagccagcuccaugauuaacggggugguuaagcuucugaccaaacccugggacgucgugccuauggugacucagauggcaaugacagauaccacaccauucggacaacagagggucuuuaaggaaaaaguugacacucggaccccccgcaguaugccggguacgagaagggugaugggcauaaccgccgagugguuauggcgaacacuggggcggaauaagaaaccucguuugugcacuagagaggaauucaccaagaagguacgcacaaacgcugccaugggagcgguguuuacugaggaaaaucagugggauucugcaaaagccgcugucgaggacgaagauuucuggaagcucguggacagggagcgggagcugcacaaacuaggcaagugugguagcugcguuuauaacaugauggggaaaagagaaaagaaacuuggagaguuuggcaaggccaagggcucacgcgcaaucugguacauguggcugggggcuagguaccucgaauucgaggcccugggauuuuugaaugaggaucauugguucucccgagaaaacaguuauagcgguguggagggcgaagggcugcacaaacucggauacauucuucgggacaucucuaagauucccggcggugcuauguaugccgaugacaccgcagggugggacacgagaaucacagaggaugaccugcacaaugaagagaaaauaacccaacagauggauccagagcauaggcaguuagcgaacgccaucuuuaagcugacuuaccagaauaaagucgugaagguacaacgcccuacacccaccggaacuguuauggacauuaucucccguaaggaucagcggggcucaggccagguggggaccuauggauugaacacauucacgaauauggaagcucagcucauuagacaaauggagggugaaggcguccugagcaaagccgaccuagagaacccacaccuucccgaaaagaaaaucacccaguggcuggagacuaaggggguggagaggcucaaacgcauggcaauaucgggagaugacugcguggucaagccuauugaugaccgauuugcuaacgcccuguuggcauuaaaugauaugggcaagguucggaaagacaucccacaguggcagccgucuaaggguuggcaugauuggcaacaggugcccuucuguagucaccacuuccaugaacugaucaugaaagacgggagaaagcucguagugccuugcaggccacaggacgagcuuauuggacgcgccagaauaucccagggcgcgggcuggagccugcgggaaacagcuugucuagggaaagccuacgcacaaauguggucacugauguauuuucacaggcgugaucuccgauuggccuccaacgcuaucugcucugccguccccgugcauuggguuccuaccagccgcacuacauggaguauucacgcacaucaccaguggaugaccacggaggacaugcugacaguguggaauagagucuggaucgaagauaacccauggauggaggacaagacccccgugacuaccugggaggauguaccuuaccuuggaaagcgggaagaccaguggugugguucccugauuggccucacaagcagggcuacuugggcccaaaauaucccgaccgcgauacagcagguucgcucuuuaaucgggaacgaggaauuccuggauuacaugccaucaaugaaaagauuucggaaggaggaggaaagugagggagcuauuugguga

SEQ ID NO: 15379 - RNA, 9873 nt, Artificial Sequence
  derived and/or modified CDS sequence (opt3) from DENV-3__KF955456__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauugcugaaguugagccggaagacaucgauugcugguguaaccugacuaguaccugggugacauaugggaccugcaaucaggccggagagcaccgccgagacaagcguagcguagcacuugccccccaugugggcaugggucuggauacuagaacacaaaccuggauguccgcugagggggcauggaggcaggucgaaaaaguggagacgugggccuugcggcacccuggauucacuauucucgcucuguuucuggcccauuacaucggcaccucucucacacagaagguugugauauucgucuuacugaugcuugugacuccaucgaugaccaugcgcuguguaggcguugggaacagagacuuuguggaaggauugucaggugcgacaugggucgauguggugcuggagcacggcgggugcgucaccacgauggcaaagaauaaacccacucuagacaucgagcuccagaagacagaagccacccaacuggcuacucuuaggaaacuguguauugagggaaagaucacaaacauuaccacggauagccggugcccuacccagggcgaagccguuuugccagaggaacaggaccagaauuauguguguaaacacacauacguagaucgcgguugggggaacggaugcggccucuucggcaaggggagucuggugacuugcgcaaaguuucaauguuuagagcccaucgagggaaaagucgugcaguaugaaaaucugaaguacaccguuauaauuacagugcauacuggugaccagcaccaggucggcaacgagacccaaggggugacagcugaaaucaccccucaggccuccacuacggaggcgauucucccagaauauggaacacuuggccuggagugcucuccgcgaaccgguuuggacuucaaugagaugauccuacugacuaugaaaaacaaggccuggaugguacauagacagugguuuuucgaucucccccugccuuggaccagcggggcaacaaccgaaacuccaacauggaauaggaaagagcuucugguuacguuuaagaacgcucacgccaaaaagcaagaaguggucguguugggcucccaggagggagcuaugcacaccgcccucacuggcgcaacagaaauccagaauucagggggaaccaguauuuucgccggucaucugaagugucgguuaaaaauggacaagcuggagcuaaaaggcaugagcuacgcuaugugcacaaacacuuuuguccucaagaaagaggugucugaaacccagcacgggacgauacugaucaagguugaguacaagggagaagaugcgcccuguaaaauuccuuucuccaccgaggacggccaagguaaggcacauaacgggcgucuuaucacagccaauccagugguaacuaaaaaggaggaacccgucaacauagaggcugaaccgccuuucggcgagucaaauauugugaucggaaucggcgauaacgccuugaaaauuaauugguauaagaaggggagcaguaucggaaaaauguuugaagcaaccgcccgcggugcuagaaggauggccauucugggcgacacagcaugggauuucgggucuguuggaggcgugcucaacucccuggguaagaugguccaccagauauuugggagcgcguacacugcucuuuucucgggcgugucuuggguaaugaaaaucggaauuggcgugcuguugaccuggaucgggcucaauuccaagaacacgucaaugaguuuuagcugcaucgccauuggaauaaucacacuguauuuaggcgcaguuguccaggccgacaccgguugugugauuaauuggaaagggaaggagcugaagugcggauccggcaucuucgugacuaacgagguccauacauggaccgaacaguacaaauuucaagcugauucucccaagcggcuagccacugcaauugcuggugccugggagaauggcguuugugggauccgaagcaccacacgcauggaaaaccuccuguggaaacagguggcgaaugagcuuaacuauauauugugggaaaauaacaucaagcugacggugguagucggagacauuaucggcgugcucgagcaggggaaaagaacccugacuccacagccuauggaguuaaaguacucauggaaaacauggggaaaggccaagauuguuaccgcugaaacacaaaacaguuccuucaucauagauggccccaauacuccagagugccccagcgcaucuagggccuggaacgugugggaagucgaggacuaugguuuugggguguucaccacgaauauuuggcugaaacuucgggaaguuuacacacaguugugugaccaccgccucaugucagcugccgugaaggaugagagagcaguacacgcggacaugggauacuggaucgagagucagaaaaacggcagcuggaagcuggaaaaagccucccuaauugaggucaagaccugcacuuggccuaagucucauacccuguggucgaauggugugcucgaaagcgauaugaucauaccaaaaucccuggcuggcccgaucucacagcacaacuauaggcccggguaccauacacaaacugccggaccuuggcaccuuggcaaguuggagcuggacuuuaauuauugcgaggggaccacaguggucauuacggaaaacuguggaacccguggcccaaguuuacggacuacaaccguuucugguaaacucauccacgaguggugcugucgaagcugcacucugcccccucuuagauacaugggggaagauggauguugguauggcauggagauuaggccaaucuccgaaaaggaggagaauauggugaaaucacugguaagcgcagguucuggcaagguggacaacuucacaaugggggucuugugccucgcuauacuguuugaagaggugaugcgcggaaaguucggcaaaaagcauaugauugccgggguuuucuuuaccuucgugcuacugcucuccggacagaucacguggcgggauauggcacacacucuggucaugaucggcaguaaugccagcgacagaauggguaugggggugaccuaccuugcuuugauugcgacauuuaaaauccagcccuuccuggccuuaggauuuuuccucaggaagcugaccucucgcgaaaaccuucugcuaggcguuggccucgcaauggcuacuacacugcaauugccggaggauauugaacagauggccaaugggauagcccugggauuaauggcucucaaacugaucacccaguuugagacauaucagcuuuggacugcacugauuuccuugaccuguucaaacacgaucuucacacucaccguggccuggcgaacugcgacccugauucuagcuggugucagucugcuuccuguaugccaaagcucguccaugcggaagucugacuggcucccaaugacaguggccgcaaugggcguucccccucugcccuuguuuaucuucagccugaaggauacuuuaaaacguagaucauggccacucaaugagggggugauggccgucggacuggugaguauacuugcuuccucucuguugaggaacgacguaccuauggcaggcccccucguggccggugggcugcuaaucgcguguuacgucauuaccggaacgagcgcugaucugacaguugaaaaggccgcagacgugaccugggaggaagaggccgaacagacuggcgugucccauaaccuuaugaucacagucgacgaugacggcaccaugcgcauuaaagaugacgagacugagaauauccucacagugcuguugaagaccgcuuuacugauaguuucagggauuuuuccauacagcaucccggccacgcuccugguauggcacacuuggcagaaacagacccggagaaguggagugcuuugggaugucccuucucccccagaaacacaaaaggcagagcuggaagaggguguguauaggaucaaacagcagggcauuuucgggaagacccagguuggagugggcguccaaaaggaggguguguuucauacaauguggcacguaacucgaggggcugucuugaccuacaacggaaaacgccuagaacccaauugggccuccgugaagaaagaccugauaagcuauggcggcggguggcggcucucggcgcaguggcagaagggagaggaaguucaagugaucgccgucgagccugguaaaaacccaaagaauuuccagacgaugcccggcacauuccagacuaccacaggggaaauuggagcaaucgcucuggauuuuaagccuggcaccucagguucuccgauuaucaacagagaggggaaagugguuggacuuuacggcaauggcguggucacuaagaacgggggauaugugagugguauagcccagaccaaugcugagccagacggccccacaccugaauuagaggaagagauguucaaaaagaggaaccugacgaucauggaucuccacccaggguccggaaaaacucguaaguacuugcccgcaauuguacgcgaagccaucaagcggagacugaggacccucauucuggccccuacacgagugguugcugcggagauggaggaagcacuuaaaggccugccgauccgguaucaaaccacugccacaaagagcgagcauaccggucgcgaaauagucgacuugaugugccacgcuacguuuacuaugagacuacugucucccgugagggugccaaauuacaaccucauuaucauggaugaggcccauuucacagacccugcaagcaucgccgcucggggguacauuuccacccgagucggaaugggcgaagcggccgcaaucuuuaugaccgcuacucccccaggcacagccgaugcauucccucagucaaaugcccccauacaggacgaggagagagacauuccagaacgcaguuggaacagcgggaaugaguggaucaccgauuuugcuggaaaaacaguaugguucgugccgucuauuaaggccgguaacgacaucgcgaacuguuuaaggaaaaauggcaagaagguuauacagcugucccguaaaacuuuugauacggaauaucaaaagaccaaacuuaacgacugggauuucguggucacaacugacauuucagagaugggggcaaauuuuaaggccgaucgggugaucgacccuagaaggugccugaaacccguuauccucaccgauggaccagagcgcgugauuuuggcuggccccaugccugucacagccgcuagugcagcccagcgaagaggucggguggggaggaacccacagaaggaaaaugaccaguacaucuucaccggccaaccccugaacaaugaugaggaccacgcucauuggacugaagccaagaugcuccuggacaacauuaauacgccugagggaauaaucccggcacuuuucgaaccagagcgcgagaaaagcgcggccauugauggcgaauaucgucuaaagggggaguccagaaaaaccuuuguagaacugaugcggaggggagacuugcccgugugguuagcucacaagguugccucugaggguaucaaauacacagaucgcaaguggugcuucgacggccagcgaaacaaucagauccuggaagagaacauggaugucgagauuuggacuaaagaaggggagaagaagaaacucagaccucgguggcuggacgcaaggaccuauucggauccccuugcucugaaggaauuuaaagacuucgccgcaggacgcaagagcauagcccucgauuuggugacagagaucggcagagugccaucacaccuggcucauaggacccggaaugcgcuagacaaccuggucaugcuccacacuuccgaacauggugggaaagccuaccgucacgcaguugaggagcuuccugaaacaauggagacgcuguuauugcugggccucaugauucugcuuaccggaggcgcuaugcuguuucucaucagugggaagggaauugguaagacuucuaucggcuugauaugugugaucgccagcuccgggaugcuguggauggccgaaauucccuuacaguggaucgcaucagcuauuguacuagaguucuuuaugauggugcugcucaucccagagccugaaaaacaacgcacaccgcaggauaaucagcuugccuaugucgugauaggaauucugaccuuggcggcuaucauugccgcaaacgagaugggccugcucgaaaccacaaagcgagaccuggguaugucuaaagagcccgggguugugagcccaacuaguuaccuugaugucgaccuccacccugccuccgcuuggacgcuguacgcaguagccaccacagugaucacucccauguugagacauaccauagaaaauagcacagcgaacguuucucuggcugccaucgcaaaccaagccguggucuuaaugggccuagacaagggauggccaauuucaaaaauggaucugggcgugccucuccuugcucuggggugcuauucccaggucaaucccuugacccugacugccgcagugcuccugcuuaucacgcacuacgcuauuaucggaccgggcuuacaggccaaggcgacaagggaggcccagaagcggaccgcagcugguauaaugaaaaacccaacuguugacgggauuaugaccaucgaucuggacccugugaucuaugauaguaaguucgagaaacaacucggacagguaauguugcuggugcuaugugccauucagcugcuccuuaugcgcacaagcugggcacugugcgaagcuuugacucuggccaccggccccaucacaacgcucugggaggguucgccaggcaaguuuuggaauaccacuauagccgucucuauggcgaacauuuucagaggguccuaccuggcuggagcaggcuuagccuuuagcaucaugaaaucaguugggacaggaaagaggggcaccgguagucagggggaaacucuuggagagaaguggaaaaagaaacugaaucaacucucucggaaggaauucgaccuauauaaaaaguccggcauuacagagguggaucgaaccgaggcuaaagaaggucugaagagaggcgagaucacgcaucacgccgucagccgcgggucagcaaaguugcagugguuuguggaaaggaacaugguaauacccgagggacgggugaucgaccugggcugugggcguggaggcuggaguuacuauugcgccggucucaaaaagguuaccgaagugagaggguacacaaaaggaggcccuggccaugaggagccgguccccaugagcacuuacggguggaauauugugaagcuuauguccggaaaagaugucuucuaucugccaccugaaaagugugacaccuugcugugcgauaucggugagucuagccccuccccuacaguggaagagucaaggacuauucgcguucucaagaugguagagccaugguuaaaaaacaaucaguucuguaucaaggugcugaaccccuacaugccuaccgucauugaacaccuugagcggcugcagcgaaaauauggcgggaugcuagugagaaauccacucucuaggaacaguacacacgaaauguacuggaucucgaauggaaccggcaacauaguugcuagcgugaauauggucucccgccuguugcugaaccgguuuacuaugacgcauagacgucccacaauugagaaggacguggaucucggugcggggaccaggcacguaaacgccgaaccggagacuccuaauauggacgugaucggagagcggaucaaacgcauuaaggaagagcauaacucuaccuggcacuaugacgaugaaaauccauacaagacaugggcauaucacggcucauacgagguuaaagcuacgggcagcgccuccaguaugauaaacggggucgugaagcuucugaccaaacccugggacguggucccuaugguuacucaaauggcaaugacagauaccacuccauucggacagcagcgaguguuuaaggaaaaaguagacacaagaacccccaggucuaugccggguacacggcgcgugaugggcaucacugccgagugguuauggagaacccuggggaggaauaagaagccucgauugugcacgcgggaggaauucaccaaaaagguccguacaaacgcugccaugggagcgguguuuacugaggaaaaucaaugggauagcgcaaaagccgcuguugaggacgaagauuucuggaagcucguggacagagagcgcgagcugcauaaacuaggcaagugugguucaugcgucuacaacaugauggggaaaagggaaaagaagcuuggagaguuuggcaaagccaagggcucccgggcaauuugguauauguggcugggggcuagauaccucgaauucgaggcccugggauuuuugaaugaggaucacugguucagucgcgaaaacagcuauucugguguggagggcgaagggcugcauaaacucggauacauccuuagggacauuuccaagauccccggcggugcuauguaugccgaugacaccgcagggugggacacacgaauaacugaggaugaccugcacaaugaagagaaaaucacccagcagauggauccagagcaucggcaguuagcgaacgccauuuuuaagcugacguaccaaaauaagguaguuaaagugcagagaccuacacccaccggaacugucauggacaucauuucaaggaaggaucagcgcggcagcggccagguggggacauauggauugaacaccuucacuaauauggaagcucaacucauccgucagauggagggugaaggcgugcugaccaaagccgaccuagagaacccacaccuuucggaaaagaaaauaacacaguggcuggagacgaagggggucgagcggcucaagagaauggcaauuucuggagaugacugcguugugaaacccaucgaugacagguuugcuaacgcccuguuggcauuaaaugauaugggcaagguacgcaaagacaucccucaguggcaaccaaguaaggguuggcacgauuggcagcaggugccguucuguucccaucacuuccaugaacugauuaugaaagacgggcgaaagcucgucgugcccugccggccucaggacgagcuuauaggaagagccaggaucagccaaggcgcgggcuggucacugcgcgaaaccgcuugucuagggaaggccuacgcacagauguggucccugauguacuuucacagacgggaucucagguuggccucuaacgcuauuugcagcgccguuccagugcacuggguccccacuagucguacaaccugguccauccaugcacaccaucaguggaugacuacagaggacaugcugaccguguggaaucgaguauggauugaagauaacccuuggauggaggacaaaacgccaguuacaaccugggagaaugugcccuaucuuggaaagcgcgaagaucaauggugugguagccugaucggccucacuucuagagcuaccugggcccagaacauaccuacagcgauccagcagguccggucauuaauugggaaugaggaauuccuggacuacaugccgaguaugaaaagguuucgcaaggaggaggaauccgagggagcuaucugguga

SEQ ID NO: 15380 - RNA, 9873 nt, Artificial Sequence
  derived and/or modified CDS sequence (opt3) from DENV-3__KF955465__SS-prME
accagccugugcaucaugaugauucuccccgccgcucuugcauuccaccugacauccagagacggcgagccuaggaugauaguggggaagaacgaacggggaaaaucuuuguuauuuaagacugccucagguaucaauauguguacgcugauugcgauggaucuaggcgagaugugcgacgauaccgucacauacaaauguccacauaucacugaaguugagccggaagacauugauugcugguguaaccucaccaguacaugggugaccuaugggacuugcaaucaggcuggagagcaccgccgagacaagcguagcguagcccuggcaccccaugugggcaugggucuugauacaagaacccaaacguggauguccgccgagggggcuuggaggcaggucgaaaaaguggagacuugggcacugcggcacccuggauucaccaucuuggcccucuuucuggcucauuacauaggcacaucucugacucagaagguugugaucuucauucucuuaaugcuggucaccccaucgaugacaaugcgcugugugggcguagggaacagagacuuuguugaaggacuuucaggugccaccuggguggaugucguguuggagcacggcgggugcgugacgacuauggcgaagaauaaacccacacuggacaucgagcuacagaagaccgaagcaacucaacucgccacacugaggaaacuuuguauugagggaaagaucaccaacauaacgaccgauagccggugcccuacacagggcgaagcuguccugccagaggaacaggaccagaauuauguuuguaaacacacuuacguggaucgcgguugggggaacggaugcggcuuguucggcaaggggagucucguaaccugcgccaaguuucaaugucuggagcccauugagggaaaagugguccaguaugaaaauuuaaaguacacagugaucauuacuguucauaccggugaccagcaccaggugggcaacgagacacaaggggucaccgcagaaaucacuccucaggcuuccacgacagaggccauccugccagaauauggaacccucggccuugagugcucuccgcgaacuggucuggacuucaaugagaugguguugcuaaccaugaaaaacaaggcguggaugguacauagacagugguuuuucgaucugccccucccuuggacaagcggggccaccacugaaacaccaacguggaauaggaaagagcugcuuguuaccuuuaagaacgcacacgcuaaaaagcaagaaguggucgugcugggcucccaggagggagccaugcacacugcuuugacaggcgccaccgaaauucagaauucagggggaacaaguauauucgcaggucaucucaagugucggcugaaaauggacaaguuagagcugaaaggcaugagcuacgccaugugcacuaacaccuuuguccuaaagaaagaggugucugaaacgcagcacgggaccauccucauuaagguugaguacaagggagaagaugugcccuguaaaaucccuuucuccacagaggacggccaagguaaggcucauaacgggcgucugauaacugcgaauccaguagucaccaaaaaggaggaacccgugaacauugaggcagaaccgccuuucggcgagucaaauaucguuaucggaauuggcgauaacgcccuuaaaaucaauugguauaagaaggggagcaguauuggaaaaauguuugaagcuacagcccgcggugcaagaaggauggccauauugggcgacacugcuugggauuucgggucugugggaggcguccugaacucccucgguaagauggugcaccagaucuuugggagcgccuacaccgcacuguucucgggcguaucuugggugaugaaaauuggaaucggcguucuucugacguggaucggguugaauuccaagaacacaucaaugaguuuuagcugcauugucauaggaaucauuacccucuaucugggcgcgguggugcaggcugacauggguugugucaucaauuggaaagggaaggaguuaaagugcggauccggcauuuucguuacuaacgaggugcauacauggaccgaacaguacaaauuucaagccgauucucccaagcggcuggcaacugccaucgcuggugccugggagaauggcgugugugggauacgaagcaccacacgcauggaaaaccuacucuggaaacagaucgcaaaugagcugaacuauauucuuugggaaaauaacaucaaguugacgguagucgugggagacauuaucggcguucuggagcaggggaaaagaacccucacuccacagccuauggagcugaaguacucauggaaaacauggggaaaggcuaagauagugaccgccgaaacacaaaacaguuccuucauuaucgauggccccaauacuccagagugccccagcgcgucuagggccuggaacgucugggaaguggaggacuaugguuuugggguuuucaccacgaauauuugguuaaaacugcgggaaguguacacacagcuuugugaccaccgcuugaugucagcugcaguaaaggaugagagagccguccacgcugacaugggauacuggaucgagagucagaaaaacggcagcuggaagcucgaaaaagccucccugauagaggugaagaccugcacuuggccuaagucucauacccuauggucgaauggugugcuggaaagcgauaugaucauuccaaaaucccucgcaggcccgaucucacagcacaacuauaggcccggguaccauacacaaacugcgggaccuuggcaccugggcaagcuugaguuggacuuuaauuauugcgaggggaccacagucguuauuacggaaaacuguggaacccguggcccaagucugcggacuacaaccgugucugguaaauuaauccacgaguggugcugucgaagcugcacucuccccccucugagauacaugggggaagauggauguugguauggcauggagauaaggccaauuuccgaaaaggaggagaauaugguaaaaucacuugugagcgccgguucuggcaaggucgacaacuucacaaugggggugcugugcuuggcuauccucuuugaagagguuaugcgcggaaaguucggcaaaaagcauaugaucgccgggguguucuuuaccuucguccugcuacuguccggacagauuacguggcgggauauggcacacacucucaucaugauuggcaguaaugcuagcgacagaauggguaugggggugaccuaccuggcccuuauagcaacauuuaaaauccagcccuucuuggcccugggauuuuucuuaaggaagcucaccucucgcgaaaaccugcuucugggcguuggccuagcuauggcgacuacacuccaacugccggaggauauugaacagauggccaaugggaucgcauugggacugauggcuuuaaaacucauuacccaguuugagacauaucagcuguggacugcccuuaucucccugaccuguucaaacacgauauucacauugaccguggccuggcgaacugcuacccucauccuggcaggugucagucuacugccuguaugccaaagcucguccaugcggaagacagacuggcuuccaaugacuguggccgcgaugggcguucccccucucccccuguuuauuuucucuuugaaggauacccugaaacguagaagcuggccauuaaaugagggggugauggcugucggacucgugucaauccuggccaguucccuucugaggaacgacguaccuauggcaggccccuugguggccggugggcuccugauugcuuguuacgucaucacgggaacaucugcagaucuaaccguugaaaaggccgcggacgugacuugggaggaagaggcugaacagacaggcgugagccauaaccugaugauaaccgucgacgaugacggcacuaugcgcauuaaagaugacgagacagagaauauccuuaccgugcuccugaagacggccuuguuaaucguuuccgggauuuuuccauacucaauaccggcaacucugcucguauggcacaccuggcagaaacagacacaacggagcggagugcugugggaugucccuagucccccagaaacccagaaggccgagcuugaagaggguguguauagaaucaaacagcagggcauuuucgggaagacacaaguuggagugggcguccagaaggaggguguguuucauacuauguggcacguaaccaggggggcuguccugacguacaacggaaaacgauuggaacccaauugggccucugugaagaaagaccuaaucuccuauggcggcggguggcgccugagcgcacaguggcaaaagggagaggaaguucaggugauugcugucgagccugguaaaaacccaaagaauuuccagacaaugcccggcacuuuccagaccacaaccggggaaaucggagccauagcgcucgauuuuaagccuggcacuucggguucaccgaucauuaaccgggaggggaaagugguuggacuguacggcaauggcguggucaccaagaacgggggauaugugucugguaucgcccaaacaaaugcagagccagacggccccacgccugaacuugaggaagagauguucaaaaagagaaacuuaacuauuauggaucugcacccagggaguggaaaaaccaggaaguaccuccccgcuaucguacgugaagccauaaagcgccgguugagaacacugauucucgcuccuaccagggugguugcagccgagauggaggaagcccugaaaggccuuccgauccgauaucagacuacagcuaccaaguccgagcauacgggucgggaaaucgucgaccugaugugccacgcgacuuuuacaaugcgcuugcuaagccccgugagagugccaaauuacaaccugauuaucauggaugaggcacauuucaccgacccugccucuauagcugccaggggguacauuagcacccgggucggaaugggcgaagcagccgcuaucuuuaugacugcgacacccccaggcaccgccgaugcauucccucaguccaaugcucccauucaggacgaggagcgagacaucccagaaagaucauggaacagugggaaugaguggauaacagauuuugccggaaaaacuguaugguucgugccgagcauuaaggcagguaacgacaucgccaacugucuccgcaaaaauggcaagaagguuauccaauuaucuaggaaaacguuugauaccgaauaucagaagacaaaacugaacgacugggauuucguggucacuaccgacauuuccgagaugggggcuaauuuuaaggccgaucgugugaucgacccucggagaugccuuaaacccguuauucugacagauggaccagagagggugauacucgcgggccccaugccugucaccgcagccucagcugcccagcgccgagguagaguggggcggaacccacagaaggaaaaugaccaauacaucuucacuggccagcccuugaacaaugaugaggaccacgcucauuggacggaagcaaagaugcugcucgacaacauuaauaccccugagggaaucaucccggcccuguucgaaccagagagggagaaaagugcugccauugauggcgaauaucgccuuaagggggagagccguaaaacauuuguagaacuaaugagacggggagaccugcccgugugguuggcacacaagguugcguccgaggguauaaaauacacugauaggaaguggugcuucgacggccagcgcaacaaucagaucuuagaagagaacauggaugucgagauuuggaccaaagaaggggagaagaagaaacugcgaccuagauggcucgacgcccggacauauucugauccccuggcucuuaaggaauuuaaagacuucgccgcaggaaggaagucgaucgcucuggaucucgugaccgagauuggccgcgugccaagccacuuggcccauagaacuaggaaugcacuggacaaccuagucaugcugcacacaucagaacauggugggaaagccuaccggcacgcuguugaggagcucccugaaacgauggagacccuucuguuauugggccugaugauccuccugacuggaggcgcgaugcuuuuucugauauccgggaagggaaucgguaagacaaguauuggccucaucugugugauugccucuagcgggauguuguggauggcagaaaucccccugcaauggauagcuuccgccauuguauuagaguucuuuaugauggugcuacugaucccagagccugaaaaacagcguaccccgcaggauaaucaacucgccuaugucgugauuggaauccuuacccuggcagcuauaaucgccgcgaacgagaugggcuugcuggaaacaacuaagcgcgaccucgguaugucaaaagagcccgggguugugucuccaacgagcuaccuggaugucgaccuucacccugcuagugccuggacccucuacgcaguagccacaacugugauuacccccaugcugcgacauacaaucgaaaauuccaccgcuaacguuagcuuggcagccauugcgaaccaggcugugguccugaugggcuuagacaagggauggccaaucucuaaaauggaucuaggcgugccucugcucgcccuugggugcuauucacaggucaauccccugacuuugacggcagccgugcugcuccugauaacacacuacgcuauuaucggaccgggccuucaggccaaggcaaccagagaggcucaaaagaggacugccgcggguaucaugaaaaacccaaccguugacgggauuaugacaaucgauuuagacccugugauauaugauuccaaguucgagaaacagcugggacagguaaugcucuuggugcugugugccguccagcuacugcucaugcggacuaguugggcacuuugcgaagcucugaccuuggccacaggccccauuacgacccugugggaggguagcccaggcaaguuuuggaauacuacaaucgcaguuucgauggcuaacauuuuccgcgggucuuaccucgccggagccggccuggcguuuuccaucaugaaaagcguggggaccggaaagagaggcacugguucacaaggggaaacauuaggagagaaguggaaaaagaaacuuaaucagcugaguaggaaggaauucgaccucuauaaaaagucuggcauaaccgaggucgaucggacggaggcuaaagaaggucuaaagcgaggcgagaucacccaucacgcaguguccagagggagcgccaagcugcagugguuuguagaacgcaacauggugauucccgagggaaggguuaucgacuugggcugugggcggggaggcuggucauacuauugcgcuggucugaaaaaggugacagaaguccguggguacacuaaaggaggcccuggccaugaggagccggugcccaugaguaccuacggguggaauauugucaagcucaugagcggaaaagauguguucuaucuuccaccugaaaagugugacacacuguugugcgauaucggugaguccucucccagcccuacuguugaagaguccagaaccauuaggguacugaagaugguggagccauggcucaaaaacaaucaguucuguaucaaggucuuaaaccccuacaugccuacagugauagaacaccuggagcgccuucaacggaaacacggcgggaugcugguucgaaauccacuaucaagaaacucuacccaugaaauguauuggauuaguaauggaacuggcaacaucguggccucggucaauauggugagcaggcuccuguugaaccgcuuuacgaugacacaccggagacccaccaucgagaaggacguagaucugggugcagggacucgucaugugaacgccgaaccggagaccccuaauauggacguuauuggagagaggauaaaacggaucaaggaagagcacaacuccacauggcacuacgacgaugaaaauccauauaagacgugggcuuaccauggcucuuaugaggucaaagcgaccggcucagccagcuccaugauuaacgggguggugaagcuccuuacuaaacccugggacgucguuccuauggugacacagauggcaaugaccgauacuacaccauucggacagcaacgcguauuuaaggaaaaaguggacacccgaacacccagaaguaugccggguacuaggcgggucaugggcaucaccgcugaguggcuguggcgcacguuagggagaaauaagaagccuaggcugugcacccgagaggaauucacaaaaaaggugcggacuaacgccgcaaugggagccguuuuuaccgaggaaaaucagugggauucugcuaaagccgcgguggaggacgaagauuucuggauuuuggucgaccgugagagagagcuccacaagcugggcaaaugugguagcugcguguacaacaugauggggaagcgcgaaaaaaagcuaggagaguuuggcaaggcaaaaggcucaagggccaucugguacauguggcuuggggcucgguaucuggaauucgaggcccucggauuucugaaugaggaucauugguucuccagagaaaacaguuacagcgguguagagggcgaaggguugcacaagcugggauauauacuccgcgacaucucuaaaauucccggcggugcaauguacgcugaugacacagccgggugggacacuaggaucaccgaggaugaccuucauaaugaagagaagauuacgcagcagauggauccagagcaccgacaacuggcuaacgccaucuuuaaauuaacauaucagaauaagguugugaagguccagcggccuacccccacuggaacagugauggacauaauuuccagaaaagaucagaggggcucaggccaaguggggaccuacggacugaacacuuucaccaauauggaagcacaguugauccgccagauggagggugaaggcguccucagcaaggcggaccuggagaacccacaccuacccgaaaaaaagaucacacaguggcuugagacgaaagggguugagcgucugaagcggauggccauuucgggagaugacugcgugguaaagccuauagaugacagauuugcuaacgcccuccuggcauugaaugauaugggcaaagugaggaaggacaucccacaauggcagccgucuaaagguuggcaugauuggcagcagguccccuucuguagucaccauuuccacgaauuaauuaugaaggacgggcgcaaacuggugguuccuugccgaccacaagacgagcucaucggacgggcuagaauuucccagggcgccggcuggagccuuagggaaaccgcaugucuggggaaggccuaugcgcagauguggucacuaauguacuuucaccgcagagaucugcggcucgcuuccaacgccaucugcucugcagugcccguccauugggugccuacuagcaggacaaccuggaguauacacgcccaucaccaauggaugacuacagaggacauguugaccguauggaaucguguuuggaucgaagauaacccauggauggaggacaagacgcccgugacaaccugggagaaugucccuuaccugggaaaacgagaagaucaguggugugguucccuuauuggccugacuagccgcgcuaccugggcccagaacaucccgacagcaauucagcaagugagaucucucaucgggaaugaggaauucuuagacuauaugccaucaaugaagcgguuuaggaaagaggaggaaagugagggagcuauuugguga

SEQ ID NO: 15381 - RNA, 9873 nt, Artificial Sequence
  derived and/or modified CDS sequence (opt3) from DENV-3__KF955466__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauuguuauaggaaucauuacccuguauuuaggcgcggucgugcaggcugacauggguugugugaucaauuggaaagggaaggagcugaagugcggauccggcauuuucgucacuaacgagguucauacauggaccgaacaguacaaauuucaagccgauucucccaagcggcuagcaacugccaucgcuggugccugggagaauggcgugugugggauacgaagcaccacacgcauggaaaaccuccuguggaaacagaucgcaaaugagcuuaacuauauuuugugggaaaauaacaucaagcugacggugguagucggagacauuaucggcgugcucgagcaggggaaaagaacccugacuccacagccuauggaguuaaaguacucauggaaaacauggggaaaggcuaagauaguuaccgccgaaacacaaaacaguuccuucauuaucgauggccccaauacuccagagugccccagcgcgucuagggccuggaacgugugggaagucgaggacuaugguuuugggguguucaccacgaauauuuggcugaaacuucgggaaguuuacacacaguugugugaccaccgccucaugucagcugcagugaaggaugagagagccguacacgcugacaugggauacuggaucgagagucagaaaaacggcagcuggaagcuggaaaaagccucccuaauagaggucaagaccugcacuuggccuaagucucauacccuguggucgaauggugugcucgaaagcgauaugaucauuccaaaaucccuggcaggcccgaucucacagcacaacuauaggcccggguaccauacacaaacugcgggaccuuggcaccuuggcaaguuggagcuggacuuuaauuauugcgaggggaccacaguggucauuacggaaaacuguggaacccguggcccaaguuuacggacuacaaccguuucugguaaacucauccacgaguggugcugucgaagcugcacucugcccccucuuagauacaugggggaagauggauguugguauggcauggagauaaggccaauuuccgaaaaggaggagaauauggugaaaucacugguaagcgccgguucuggcaagguggacaacuucacaaugggggucuugugccucgcuauccuguuugaagaggugaugcgcggaaaguucggcaaaaagcauaugaucgccgggguuuucuuuaccuucgugcuacugcucuccggacagauuacguggcgggauauggcacacacucugaucaugauuggcaguaaugcuagcgacagaauggguaugggggucaccuaccuugccuugauagcaacauuuaaaauccagcccuuccuggccuuaggauuuuuccucaggaagcugaccucucgcgaaaaccuucugcuaggcgugggccucgcuauggcgacuacacugcaauugccggaggauauugaacagauggccaaugggaucgcacugggauuaauggcucucaaacugauuacccaguuugagacauaucagcuuuggacugcccugaucuccuugaccuguucaaacacgauauucacacucaccguugccuggcgaacugcuacccugauccuagcaggugugagucugcuuccugucugccaaagcucguccaugcggaagacagacuggcucccaaugacuguagccgcgaugggcgugcccccucugcccuuguuuauuuucucucugaaggauaccuuaaaacguagaagcuggccacucaaugaggggguuauggcugugggacuggucucaauccuugccaguucccuguugaggaacgacgugccuauggcaggcccccucguagccggugggcugcuaauugcuuguuacgugaucacgggaacaucugcagaucugaccgucgaaaaggccgcggacguuacuugggaggaagaggcugaacagacaggcgugagccauaaccuuaugauaaccguggacgaugacggcacuaugcgcauuaaagaugacgagacagagaauauccucaccguccuguugaagacggccuuacugaucguguccgggauuuuuccauacucaauaccggcaacucuccugguuuggcacaccuggcagaaacagacacaacggagcggaguacuuugggaugugccuagucccccagaaacccagaaggccgagcuggaagagggugucuauagaaucaaacagcagggcauuuucgggaagacacaagugggaguuggcgugcagaaggagggugucuuucauacuauguggcacgugaccaggggggcuguauugacguacaacggaaaacgacuagaacccaauugggccucugucaagaaagaccugaucuccuauggcggcggguggcgccucagcgcacaguggcaaaagggagaggaagugcagguuauugcuguggagccugguaaaaacccaaagaauuuccagacaaugcccggcacuuuccagaccacaaccggggaaaucggagccauagcgcuggauuuuaagccuggcacuucggguucaccgaucauuaaccgggaggggaaagucgugggacuuuacggcaauggcguugugaccaagaacgggggauaugucucugguaucgcccaaacaaaugcagagccagacggccccacgccugaauuagaggaagagauguucaaaaagagaaaccugacuauuauggaucuccacccagggaguggaaaaaccaggaaguacuugcccgcuaucgugcgugaagccauaaagcgccggcugagaacacucauucuggcuccuaccaggguaguggcagccgagauggaggaagcccuuaaaggccugccgauccgauaucagacuacagcuaccaaguccgagcauacgggucgggaaaucguugacuugaugugccacgcgacuuuuacaaugcgccuacugagccccgucagagugccaaauuacaaccucauuaucauggaugaggcacauuucaccgacccugccucuauagcugccaggggguacauuagcacccgggugggaaugggcgaagcagccgcuaucuuuaugacugcgacacccccaggcaccgccgaugcauucccucaguccaaugcucccauucaggacgaggagcgagacaucccagaaagaucauggaacagugggaaugaguggauaacagauuuugccggaaaaacugucugguucguaccgagcauuaaggcagguaacgacaucgccaacuguuuacgcaaaaauggcaagaaggugauccaacugucuaggaaaacguuugauaccgaauaucagaagacaaaacuuaacgacugggauuucguugugacuaccgacauuuccgagaugggggcuaauuuuaaggccgaucgugucaucgacccucggagaugccugaaacccgugauucucacagauggaccagagaggguuauauuggcgggccccaugccugugaccgcagccucagcugcccagcgccgagguagagucgggcggaacccacagaaggaaaaugaccaauacaucuucacuggccagccccugaacaaugaugaggaccacgcucauuggacggaagcaaagaugcuccuggacaacauuaauaccccugagggaaucaucccggcccuuuucgaaccagagagggagaaaagugcugccauugauggcgaauaucgccuaaagggggagagccguaaaacauuuguggaacugaugagacggggagacuugcccguaugguuagcacacaagguggcguccgaggguauaaaauacacugauaggaaguggugcuucgacggccagcgcaacaaucagauccuggaagagaacauggauguugagauuuggaccaaagaaggggagaagaagaaacuccgaccuagauggcuggacgcccggacauauucugauccccuugcucugaaggaauuuaaagacuucgccgcaggaaggaagucgaucgcucucgauuuggucaccgagauuggccgcgugccaagccaccuggcccauagaacuaggaaugcacuagacaaccuggugaugcuccacacaucagaacauggugggaaagccuaccggcacgcugucgaggagcuuccugaaacgauggagacccuguuauugcugggccucaugauccugcuuacuggaggcgcgaugcuguuucucauauccgggaagggaaucgguaagacaaguauuggcuugaucuguguuauugccucuagcgggaugcuguggauggcagaaauccccuuacaauggauagcuuccgccauugugcuagaguucuuuaugaugguacugcucaucccagagccugaaaaacagcguaccccgcaggauaaucaacuugccuauguggucauuggaauccugaccuuggcagcuauaaucgccgcgaacgagaugggccugcucgaaacaacuaagcgcgaccuggguaugucaaaagagcccggggugguuucuccaacgagcuaccuugauguggaccuccacccugcuagugccuggacccuguacgcagucgccacaacuguaauuacccccauguugcgacauacaaucgaaaauuccaccgcuaacgugagccuggcagccauugcgaaccaggcuguuguguuaaugggccuagacaagggauggccaaucucuaaaauggaucugggcgucccucuccuugcccuggggugcuauucacaggugaaucccuugacucugacggcagccguccuccugcuuauaacacacuacgcuauuaucggaccgggcuuacaggccaaggcaaccagagaggcucaaaagaggacugccgcggguaucaugaaaaacccaaccguggacgggauuaugacaaucgaucuggacccuguuauauaugauuccaaguucgagaaacagcucggacaggugauguugcugguacuaugugccgugcagcugcuccuuaugcggacuaguugggcacugugcgaagcuuugacccuggccacaggccccauuacgacccucugggaggguagcccaggcaaguuuuggaauacuacaaucgcagucucgauggcuaacauuuuccgcgggucuuaccuggccggagccggcuuagcguuuuccaucaugaaaagcguugggaccggaaagagaggcacugguucacaaggggaaacacuuggagagaaguggaaaaagaaacugaaucagcucaguaggaaggaauucgaccuauauaaaaagucuggcauaaccgagguggaucggacggaggcuaaagaaggucugaagcgaggcgagaucacccaucacgcagucuccagagggagcgccaaguugcagugguuuguggaacgcaacaugguaauucccgagggaagggugaucgaccugggcugugggcggggaggcuggucauacuauugcgcuggucucaaaaagguuacagaagugcguggguacacuaaaggaggcccuggccaugaggagccgguccccaugaguaccuacggguggaauauugugaagcuuaugagcggaaaagaugucuucuaucugccaccugaaaagugugacacauugcugugcgauaucggugaguccucucccagcccuacuguggaagaguccagaaccauuaggguucucaagaugguagagccaugguuaaaaaacaaucaguucuguaucaaggugcugaaccccuacaugccuacagucauagaacaccuugagcgccugcaacggaaacacggcgggaugcuagugcgaaauccacucucaagaaacucuacccaugaaauguauuggauuaguaauggaacuggcaacaucguugccucggugaauauggucagcaggcuguugcugaaccgcuuuacgaugacacaccggagacccaccaucgagaaggacguggaucucggugcagggacucgucauguaaacgccgaaccggagaccccuaauauggacgugauuggagagaggauaaaacggaucaaggaagagcacaacuccacauggcacuacgacgaugaaaauccauauaagacgugggcuuaccauggcucuuaugagguuaaagcgaccggcucagccagcuccaugauuaacggggucgugaagcuucugacuaaacccugggacguggucccuaugguuacacagauggcaaugaccgauacuacaccauucggacagcaacgcguguuuaaggaaaaaguagacacccgaacacccagaaguaugccggguacuaggcgggugaugggcaucaccgcugagugguuauggcgcacgcuggggagaaauaagaagccuagguugugcacccgagaggaauucacaaaaaagguccggacuaacgccgcaaugggagccguguuuaccgaggaaaaucagugggauucugcuaaagccgcgguugaggacgaagauuucuggaugcucguggaccgugagagagagcugcacaagcuaggcaaaugugguagcugcgucuacaacaugauggggaagcgcgaaaaaaagcuuggagaguuuggcaaggcaaaaggcucaagggccauuugguacauguggcugggggcucgguaucucgaauucgaggcccugggauuuuugaaugaggaucauugguucuccagagaaaacaguuacagcgguguggagggcgaagggcugcacaagcucggauauauccuucgcgacauaucuaaaauccccggcggugcaauguacgcugaugacacagccgggugggacacuaggauuaccgaggaugaccugcauaaugaagagaagaucacgcagcagauggauccagagcaccgacaauuagcuaacgccauuuuuaaacugacauaucagaauaagguaguuaaggugcagcggccuacccccacuggaacagucauggacaucauauccagaaaagaucagaggggcucaggccaaguggggaccuacggauugaacacuuucaccaauauggaagcacagcucauucgccagauggagggugaaggcgugcugagcaaggcggaccuagagaacccacaccuucccgaaaaaaagaucacacaguggcuggagacgaaaggggucgagcgucucaagcggauggccaucucgggagaugacugcguugugaagccuauugaugacagauuugcuaacgcccuguuggcauuaaaugauaugggcaaaguaaggaaggacauaccacaauggcagccgucuaaagguuggcaugauuggcagcaggugcccuucuguagucaccauuuccacgaacugaucaugaaggacgggcgcaaacucgucgugccuugccgaccacaagacgagcuuauuggacgggcuagaaucucccagggcgccggcuggagccugagggaaaccgcaugucuagggaaggccuaugcgcagauguggucacugauguacuuucaccgcagagaucuccgguuggcuuccaacgccauuugcucugcaguucccgugcauugggucccuacuagcaggacaaccuggaguauccacgcccaucaccaauggaugacuacagaggacaugcugaccguguggaaucguguauggauagaagauaacccauggauggaggacaagacgcccguuacaaccugggagaaugugccuuaccuuggaaaacgagaagaucaguggugugguucccugaucggccucacuagccgcgcuaccugggcccagaacauuccgacagcaauccagcaagucagaucuuuaauugggaaugaggaauuccuggacuauaugccaucaaugaagcgguuuaggaaagaggaggaaagugagggagcuaucugguga

SEQ ID NO: 15382 - RNA, 9873 nt, Artificial Sequence
  derived and/or modified CDS sequence (opt3) from DENV-3__KF955468__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauuguuauaggaaucauuacccuguauuuaggcgcggucgugcaggcugacauggguugugugaucaauuggaaagggaaggagcugaagugcggauccggcauuuucgucacuaacgagguucauacauggaccgaacaguacaaauuucaagccgauucucccaagcggcuagcaacugccaucgcuggugccugggagaauggcgugugugggauacgaagcaccacacgcauggaaaaccuccuguggaaacagaucgcaaaugagcuuaacuauauuuugugggaaaauaacaucaagcugacggugguagucggagacauuaucggcgugcucgagcaggggaaaagaacccugacuccacagccuauggaguuaaaguacucauggaaaacauggggaaaggcuaagauaguuaccgccgaaacacaaaacaguuccuucauuaucgauggccccaauacuccagagugccccagcgcgucuagggccuggaacgugugggaagucgaggacuaugguuuugggguguucaccacgaauauuuggcugaaacuucgggaaguuuacacacaguugugugaccaccgccucaugucagcugcagugaaggaugagagagccguacacgcugacaugggauacuggaucgagagucagaaaaacggcagcuggaagcuggaaaaagccucccuaauagaggucaagaccugcacuuggccuaagucucauacccuguggucgaauggugugcucgaaagcgauaugaucauuccaaaaucccuggcaggcccgaucucacagcacaacuauaggcccggguaccauacacaaacugcgggaccuuggcaccuuggcaaguuggagcuggacuuuaauuauugcgaggggaccacaguggucauuacggaaaacuguggaacccguggcccaaguuuacggacuacaaccguuucugguaaacucauccacgaguggugcugucgaagcugcacucugcccccucuuagauacaugggggaagauggauguugguauggcauggagauaaggccaauuuccgaaaaggaggagaauauggugaaaucacugguaagcgccgguucuggcaagguggacaacuucacaaugggggucuugugccucgcuauccuguuugaagaggugaugcgcggaaaguucggcaaaaagcauaugaucgccgggguuuucuuuaccuucgugcuacugcucuccggacagauuacguggcgggauauggcacacacucugaucaugauuggcaguaaugcuagcgacagaauggguaugggggucaccuaccuugccuugauagcaacauuuaaaauccagcccuuccuggccuuaggauuuuuccucaggaagcugaccucucgcgaaaaccuucugcuaggcgugggccucgcuauggcgacuacacugcaauugccggaggauauugaacagauggccaaugggaucgcacugggauuaauggcucucaaacugauuacccaguuugagacauaucagcuuuggacugcccugaucuccuugaccuguucaaacacgauacucacacugaccguugccuggcgaacugcuacccuaauccuggcaggugugagucuucucccugucugccaaagcucguccaugcggaagacagacuggcugccaaugacuguagccgcgaugggcgugcccccuuugccccuguucauuuuuucuuuaaaggauacccucaaacguagaagcuggccacugaaugaggggguuauggcugugggacuugucucaauccuggccaguuccuugcucaggaacgacgugccuauggcaggcccccugguagccggugggcuacugauugcuuguuacgugaucacgggaacaucugcagaucuuaccgucgaaaaggccgcggacguuacuugggaggaagaggcugaacagacaggcgugagccauaaccucaugauaaccguggacgaugacggcacuaugcgcauuaaagaugacgagacagagaauauccugaccgucuuguuaaagacggcccugcucaucguguccgggauuuucccauacucaauaccggcaacucugcuuguuuggcacaccuggcagaaacagacacaacggagcggaguacugugggaugugccuagucccccagaaacccagaaggccgaguuggaagagggugucuauagaaucaaacagcagggcauuuuugggaagacacaagugggaguuggcgugcagaaggagggugucuuccauacuauguggcacgugaccaggggggcuguacuaacguacaacggaaaacgacuggaacccaauugggccucugucaagaaagaccucaucuccuauggcggcggguggcgccugagcgcacaguggcaaaagggagaggaagugcagguuauugcuguggagccugguaaaaacccaaagaauuuucagacaaugcccggcacuuuccagaccacaaccggggaaaucggagccauagcgcuugauuucaagccuggcacuucggguucaccgaucauuaaccgggaggggagagucgugggauuauacggcaauggcguugugaccaaaaacgggggauaugucucugguaucgcccaaacaaaugcagagccagacggccccacgccugaacuggaggaagagauguuuaagaaaaggaaccucacuauuauggauuugcacccagggaguggaaagacccguaaauaccugcccgcuaucgugcgcgaagccauaaagcggagacucaggacacugauucuugcuccuacccgaguaguggcagccgagauggaggaagcccugaagggcuugccgauccgguaucagacuacagcuaccaaauccgagcauacgggucgcgaaaucguugaccuaaugugccacgcgacuuucacaaugagacugcucagccccgucagggugccaaauuacaacuuaauuaucauggaugaggcacauuuuaccgacccugccucuauagcugcccggggguacauuagcacccgagugggaaugggcgaagcagccgcuaucuucaugacugcgacacccccaggcaccgccgaugcauuuccucaguccaaugcucccauucaggacgaggagagagacaucccagaacgcucauggaacagugggaaugaguggauaacagauuucgccggaaagacugucugguuuguaccgagcauuaaagcagguaacgacaucgccaacugucugaggaagaauggcaaaaaggugauccaacuuucucguaagacguucgauaccgaauaucagaaaacaaagcugaacgacugggauuuuguugugacuaccgacauuuccgagaugggggcuaauuucaaagccgaucgggucaucgacccuagaaggugccucaagcccgugauuuugacagauggaccagagcgcguuauacuggcgggccccaugccugugaccgcagccucagcugcccagcgaagaggucgggucgggaggaacccacagaaagaaaaugaccaauacaucuuuacuggccagccccucaacaaugaugaggaccacgcucauuggacggaagcaaagaugcugcuugacaacauuaauaccccugagggaaucaucccggcccuauucgaaccagagcgcgagaagagugcugccauugauggcgaauaucgucugaaaggggagagcagaaagacauucguggaauugaugcggaggggagacuuacccguauggcuggcacacaaaguggcguccgaggguauaaaguacacugaucgcaaauggugcuuugacggccagcgaaacaaucagauccucgaagagaacauggauguugagauuuggaccaaggaaggggagaaaaagaagcugagaccucgguggcuugacgccaggacauauucugauccccuggcucucaaagaauucaaggacuuugccgcaggacgcaaaucgaucgcuuuggaucuggucaccgagauuggcagagugccaagccaccuagcccauaggacucggaaugcacuggacaaccucgugaugcuucacacaucagaacauggugggaaggccuaccgucacgcugucgaggagcugccugaaacgauggagaccuuauugcugcucggccugaugauccuucugacuggaggcgcgaugcucuucuugauauccgggaaaggaaucgguaagacaaguauuggccugaucuguguuauugccucuagcgggauguuauggauggcagaaaucccccuacaauggauagcuuccgccauugugcuggaguuuuucaugaugguacuccuuaucccagagccugaaaagcagcgcaccccgcaggauaaucaacuggccuauguggucauuggaaucuugacccuggcagcuauaaucgccgcgaacgagaugggccuccuggaaacaacuaaacgagaccuugguaugucaaaggagcccggggugguuucuccaacgagcuaccucgauguggaccugcacccugcuagugccuggaccuuguacgcagucgccacaacuguaauuacccccaugcugagacauacaaucgaaaauuccaccgcuaacgugagcuuagcagccauugcgaaccaggcuguugugcuaaugggccuggacaaaggauggccaaucucuaagauggaucucggcgucccucuucuggccuuggggugcuauucacaggugaauccccugacucucacggcagccguccugcuuuuaauaacacacuacgcuauuaucggaccgggccugcaggccaaagcaaccagggaggcucaaaagcggacugccgcggguaucaugaagaacccaaccguggacgggauuaugacaaucgaucucgacccuguuauauaugauuccaaauuugagaagcaguugggacaggugaugcugcuaguacugugugccgugcagcuccuucugaugcgcacuaguugggcauugugcgaagcucugacccucgccacaggccccauuacgacccugugggaggguagcccaggcaaauucuggaauacuacaaucgcagucucgauggcuaacauuuuuagagggucuuacuuagccggagccggccuugcguucuccaucaugaagagcguugggaccggaaaaaggggcacugguucacaaggggaaacacugggagagaaguggaagaaaaagcucaaucagcuaagucggaaagaauuugaccuguauaagaaaucuggcauaaccgagguggaucgaacggaggcuaaggaagguuugaaaagaggcgagaucacccaucacgcagucucccgcgggagcgccaagcugcagugguucguggaaaggaacaugguaauucccgagggacgggugaucgaccucggcugugggcguggaggcuggucauacuauugcgcuggucuuaagaaaguuacagaagugagaggguacacuaagggaggcccuggccaugaggagccgguccccaugaguaccuacggguggaauauugugaaacugaugagcggaaaggaugucuuuuauuugccaccugaaaaaugugacacacugcucugcgauaucggugaguccucucccagcccuacuguggaagaguccaggaccauucgcguuuuaaagaugguagagccauggcugaagaacaaucaguucuguaucaaagugcuuaaccccuacaugccuacagucauagaacaccuggagcggcuacaacgaaagcacggcgggaugcucgugagaaauccacugucaaggaacucuacccaugaaauguauuggauuaguaauggaacuggcaacaucguugccucggugaauauggucagccgcuugcugcucaaccgguucacgaugacacacagacgucccaccaucgagaaagacguggaucuuggugcagggacuaggcauguaaacgccgaaccggagaccccuaauauggacgugauuggagagcggauaaagcgcaucaaagaagagcacaacuccacauggcacuacgacgaugaaaauccauauaagacgugggcuuaccauggcucuuaugagguuaaggcgaccggcucagccagcuccaugauuaacggggucgugaaacuguuaacuaagcccugggacguggucccuaugguuacacagauggcaaugaccgauacuacaccauuuggacagcaacgaguguucaaagaaaagguagacaccagaacacccaggaguaugccggguacucggcgcgugaugggcaucaccgcugaguggcuguggagaacguuggggaggaauaaaaagccucgacucugcacccgggaggaauuuacaaagaaaguccguacuaacgccgcaaugggagccguguucaccgaggaaaaucagugggauucugcuaaggccgcgguugaggacgaagauuuuuggacacugguggacagagagcgcgagcuacacaaacuuggcaagugugguagcugcgucuacaacaugauggggaaaagggaaaagaaacugggagaguucggcaaggcaaagggcucacgggccauuugguacauguggcucggggcuagauaucuggaauuugaggccuugggauuccugaaugaggaucauugguuuucccgcgaaaacaguuacagcgguguggagggcgaagggcuccacaaacuuggauauauccugagggacauaucuaagauccccggcggugcaauguacgcugaugacacugccgggugggacacccgaauuacggaggaugacuuacauaaugaagagaaaaucacacagcagauggauccagagcaccggcaacuggcuaacgccauuuucaaguugaccuaucagaauaaaguaguuaaggugcagagaccuacucccacaggaaccgucauggacaucauauccaggaaggaucagcgcggcucaggccaaguggggacuuacggacucaacaccuuuacaaauauggaagcacagcugauucgucagauggagggugaaggcgugcuaagcaaagcggaccuugagaacccacaccugcccgaaaagaaaaucacgcaguggcucgagaccaagggggucgagcggcugaaaagaauggccaucucgggagaugacugcguugugaagccuauugaugacagguucgcuaacgccuuguuagcacugaaugauaugggcaagguacgcaaagacauaccacaauggcagccgucuaaggguuggcaugauuggcagcaggugcccuuuuguagucaccauuuccacgaacucaucaugaaagacgggcgaaagcuugucgugccuugccggccacaagacgagcugauuggaagagcuaggaucucccagggcgccggcuggagccuacgcgaaacugcaugucuggggaaagccuaugcgcagauguggucacucauguacuuccacagacgggauuugaggcuggcuuccaacgccauuugcucugcaguucccgugcauugggucccuacaagccguaccacuuggaguauccacgcccaucaccaauggaugacaaccgaggacaugcuuacgguguggaaucgaguauggauagaagauaacccauggauggaggacaagacacccguuaccacuugggagaaugugccuuaccugggaaagcgcgaagaucaguggugugguucccucaucggcuuaaccagcagagcuacaugggcccagaacauuccgacugcaauccagcaaguccggucucugauugggaaugaggaauuuuuggacuauaugccaucaaugaaaagguuccgcaaggaggaggaaagugagggagcuaucugguga

SEQ ID NO: 15383 - RNA, 9873 nt, Artificial Sequence
  derived and/or modified CDS sequence (opt3) from DENV-3__FJ744726__SS-prME
accagccugugccucaugaugaugcuucccgccacacuggcuuuccacuugacuuccagagacggcgagccuaggaugaucguggcaaagaacgaacgggggaaaucuuuacuguuuaagacggccucaggaauuaauauguguacccuaauagcgauggaucucggugagaugugcgacgauacagucacuuacaaauguccacugaucgcugaaguugagccggaagacauugauugcugguguaaccuuaccaguacaugggugaccuauggcacuugcaaucaggccggggagcaucgccgagacaagcguagcguagcacuggccccccacgugggaaugggcuuggauacaagaacccaaacguggauguccgcugagggugcauggaggcaggucgaaaaaguggagacuugggcccuccggcauccuggguucaccauccuggcucuguuucucgcccacuacauuggaacaucuuuaacucagaagguugugaucuucauacugcuuauguuggucaccccaucgaugacaaugcgcugugugggcguaggcaacagagacuuuguugaagggcugucaggagcgaccuggguggaugucgugcuagagcaugguggcugcgugacgacuauggcaaagaauaaacccacacucgacaucgagcugcagaagaccgaagccacucaacuugcuacacugaggaaauuguguauugaggggaagaucaccaacauuacgaccgauagccggugcccuacacagggagaagccauccucccagaggaacaggaccagaauuaugucuguaaacacacuuacguugaucgcggcugggguaacgggugcggacuguucggcaagggcaguuuagugaccugcgcaaaguuucaaugucuggagcccauagaggggaaaguagugcagcacgaaaaucucaaguauacagucauuaucacugugcauaccggagaccagcaccagguugguaacgacacacaaggcgugaccgucgagauuacuccucaggcuuccacgguggaagccauccuuccagaguacgggacacugggauuggaaugcucuccgcgaaccggccuagauuucaaugagaugauccugcucacuaugaaaaacaaggcguggaugguacauagacagugguuuuucgaccugccccuuccuuggaccagcggugccacaaccgagacuccaacauggaauaggaaagaacuguugguuacguuuaagaacgcacacgcuaaaaagcaagagguggucgugcucgggucccaggaaggcgccaugcacaccgcucugacuggagccacagagauucagaauucaggcgggaccaguauauucgcaggacauuuaaagugucggcugaaaauggauaagcuagaacucaaagguaugagcuaugccaugugccugaacacauuuguccuuaagaaagaggugucugagacucagcacggcaccaucuugauuaagguugaauacaagggggaggacgcucccuguaaaaucccuuucuccacggaagauggacaaggcaaggcgcauaacggucgucugauaaccgcaaauccagugguaacaaaaaaggaggagcccgucaacauugaagccgagccgccuuucggggaaucaaauaucgugaucggcauuggagacaaagcucucaagaucaacugguacaagaaaggcagcaguauugggaagauguuugaggccacugcacgcggagccagaaggauggcuauacugggugauaccgccugggacuucggcucuguugggggagugcuuaauucccugggcaaaaugguccaccagaucuuugguagcgcauauacagcguuguucucgggggugucuuggauuaugaagaucggcaucggaguacuccugacuuggauuggcuuaaacuccaaaaauaccucaaugaguuuuagcugcauagugaucgggauuaucacgcuguaccuaggagcuguuguccaggccgauaugggcugugugauuaacuggaaggguaaggaacucaaaugcggguccggaaucuucgugacaaaugagguccauaccuggacugagcaguauaaguuucaagcagacucucccaaacggcuggccacagcuauagccggcgcaugggaaaacgguguuuguggcauccgaagcaccacucgcauggagaaucuuuuguggaagcagauugcuaacgaacugaauuacauccucugggagaacaauauuaaacugaccguggugguaggggauaucauaggagucuuagaacagggcaagagaacacugacgccacagccuauggagcuuaaauauucauggaagaccugggggaaggccaaaauugugacugcggagacacaaaacaguuccuucaucauugacggacccaacaccccagaaugccccagcgccucuagggcuuggaauguuugggagguggaagacuacggcuuuggugucuucacaacuaacaucugguugaagcuccgggagguguauacccagucaugugaucaccgccugaugagugcagccauaaaagacgaaagagcuguucacgccgauaugggguacuggaucgagagccagaagaauggauccuggaaacuagagaaggcaucuuuuauugaagugaagacgugcacauggccuaaaucgcauacccuguggagcaacggcguacucgaguccgacaugaucauuccaaagucacuggcggguccgaucagucagcacaaucauaggcccggcuaccacacucaaaccgccgggccuuggcaccuuggaaaauuggaacuggauuucaacuauugcgagggcacaacugucgugauaaccgagaauugugggacacguggaccaucuuuacggacgaccacugugagcggcaagcucauucaugaauggugcugucgauccugcacacugcccccucuuagauacaugggugaggacggguguugguauggaauggaaaucaggccaaucaacgagaaagaagagaauauggucaagucacugguuagcgcuggcucugguaagauggauaacuuuaccaugggcauuuugugccucgccauccuguucgaggaagugaugcgcgggaaauucggaaagaaacacaugauugcaggcguacuauuuacuuucgugcugcuccuguccgggcagauaacauggcgggacauggcucauacccuuaucaugauuggaaguaaugccagcgauagaaugggcaugggugucacguacuuggcacugaucgccacuuuuaagauucagcccuucuuagcucucggguuuuuccugaggaaacuuaccucucgcgagaaccugcuacucggagugggccuggcgauggccacaaccuugcaacugccggaagacaucgagcagauggcaaauggcauagcuuuagggcucaugacucugaagcuuaucacacaguuugaaaccuaucagcuguggacagccuugguuucccucacuuguucaaacaccauuuucacgcugacaguggccuggcgaaccgcuacucuaauccuggcaggagucagucuucucccucugugccaaagcucguccaugcggaagaccgauugguugccaaugacaguggccgcgauggguguucccccucugcccuuauuuauuuucucucucaaagacacuccaaagcguagaagcuggccucugaaugagggcgugauggcugucgggcuuguaucaauccuggccaguuccuugcucaggaacgaugugcccauggcaggaccacugguugccggcggucuacugauagcuuguuacgugauuaccgggacgucugcagaccuuacagucgagaaagccgcggacgugaccugggaagaggaagcugagcagacuggaguaagccacaaccucaugaucacaguggaugacgauggcaccaugcgcaucaaggacgaugaaacugagaauauucugacagucuuguuaaaaaccgcccugcucauaguuuccggcaucuuuccguauucaauuccugcaacgcugcuuguguggcauacuuggcagaagcagacccaacggagcggggugcugugggacguccccaguccacccgagacacagaaagccgaauuggaggaaggaguguacagaaucaagcagcaggguauuuucggcaagacccaaguugggguaggagugcagaaagagggcgucuuucacacaauguggcacgugacuaggggugcuguucuaacccauaacgggaagcgacuggagccuaauugggccucugugaaaaaggaucucaucuccuacggaggcggcuggcgccugagcgcacaguggcaaaaaggggaagagguccaggugauagcuguagaaccaggaaagaaccccaagaauuuccagacgaugccugguaucuuccagacaacuaccggcgagauuggggccaucgcgcuugacuuuaaaccgggaacaucgggcucaccaauuaucaaccgggaagguaaggucgugggguuauauggaaauggcguugugaccaaaaacggcggguacgucucuggaauagcccaaacuaaugcagagcccgaugguccuaccccagagcuggaagaggaaauguucaagaaaagaaaccucacaauuauggacuugcaccccggcagugggaagacgaggaaguaucugccugcuaucgugcgugaggccaucaaacgccggcucagaacucugauucuugcuccgaccaggguuguggcagccgaaauggaggaggcccugaagggauugcccauccgauaccagacaaccgcuauaaaauccgaacauacuggccgggagauugucgaucuaaugugccacgcgacauuuaccaugcgccugcucagcccagugagaguaccuaauuauaacuuaaucauuauggacgaagcacauuucacggaucccgccucuaucgcugccagggguuacauaagcacucggguggggaugggagaggcagccgcuauuuuuaugacagcgaccccaccuggcaccgccgaagcauucccccaguccaaugcuccaauccaggacgaggagaaggacaucccggaacgaucauggaacaguggcaaugaguggauuacugauuuuguugggaaaacagucugguucgugccuagcaucaaggccggaaacgacauugcaaacugucugagaaagaaugguaaaaaggugauacaacuuucucgcaaaaccuuugauacagaauaucagaagacuaggcugaacgacugggauuucgucguaacgaccgacaucuccgagaugggcgccaauuuuaaagcugaucgugugauugacccccggagaugccucaagccaguuaucuugacagaugggcccgagagggugauccuggccggaccuaugccagucacugcggcaucagccgcucagcgccgaggcagagugggucggaacccccagaaggaaaaugaccaauacauuuucaccgggcagccucucaacaaugaugaggaccacgcccacuggacagaagcuaaaaugcugcuugacaacauaaauaccccggagggcaucauuccagcacuauucgaacccgagagggagaagagugccgcuaucgauggagaauaccgccugaaaggcgagagccguaagacuuuuguugaauugaugagacggggggacuuaccuguguggcuggcccauaaagucgcauccgagggaauuaaguauacggauaggaaauggugcuucgacggugaacgcaacaaucagauccucgaggagaacauggauguggaaauauggaccaaggagggcgaacgaaagaaacugagaccccgguggcuugacgcgaggacauacucugauccacuggcccucaaggaguuuaaagacuucgcugccgggcgcaagucgaucgcauuggaucugguaacugaaauuggaagagugccuagccaccuagcucauaggacccggaaugcccuggacaaccucguuaugcuucacacaucagagcacggcggucgugcauaucgccaugccgucgaggaacugcccgagaccauggaaacuuuauugcugcucgggcugaugauccuucugacaggcggagcuaugcucuuuuugauuuccggcaaagggaucggaaagacgaguauaggucugauuugugugaucgugucuagcggcauguuauggauggcggaugucccacuacaguggauugccuccgcaaucguucuggaguucuuuaugauggugcuccuuauaccugagccggaaaagcaacgaaccccccaggacaaucagcuggcuuacguagugaucgggauuuugacucuggccgccaucgucacagcaaacgagaugggacuccuggaaaccaccaaaagagaucuuggcaugucaaaggagccaggugugguuucuccuacaagcuaucucgacguggaccugcaccccgcuagugccuggacuuuguacgcggucgcuacgaccguaauuacaccaaugcugaggcauacuaucgaaaauuccaccgccaacgugagcuuagcagccauagcuaaccaagcaguugugcuaauggggcuggauaaaggcuggccuauuucuaagauggaccucggagucccccuucuggccuugggcugcuauucacaggugaauccgcugacacucaccgcggcuguccugcuuuuagugacucacuacgccaucaucgggccaggacugcaggcaaaagccacgcgggaggcucagaagcgcacagccgcaggcauuaugaagaacccuaccguugaugguaucaugacuauagaccucgaucccgugauuuacgacuccaaauucgagaagcaauuggggcagguaaugcugcuagugcugugugcuguccagcuccuucugaugagaaccaguugggccuugugcgaagcgcugacacucgccacuggaccaaucaccacacugugggagggcagccccgguaaauuuuggaauacgaccauugcaguuucgauggcuaacaucuucaggggcucuuauuuagccggggcaggacuugcuuuuuccauaaugaagagcgugggcacugggaaacggggaacaggcucacagggugaaacccugggggagaaguggaagaaaaagcucaaucaacuaagucgaaaagaauucgaucuguacaagaaaucuggaaucacugaggucgacagaacagaggccaaggaaggcuugaaacgcggugagaccacgcaucacgccguguccaggggcagcgcgaagcugcagugguuuguagaacggaacauggugauuccugaggggcguguuaucgaucucggauguggcagagggggauggucauauuacugcgcuggccuuaagaaagugaccgaagucagggguuauacaaaggggggaccgggccacgaggagcccgugccaaugaguacuuacggcuggaauauugucaaacugaugagcgggaaggacguguucuauuugccucccgaaaaaugugauacccugcucugcgacaucggagaguccucuccuagcccaacaguugaagagucccgcacuauucggguauuaaagaugguggagcccuggcugaagaacaaucaguucuguaucaaaguccuuaacccuuacaugccaaccgugauagaacaucuggagcgacuacagagaaagcacgguggcaugcucguuaggaauccccugucacgcaacucuacacaugaaauguacuggauuaguaaugggaccggaaacaucgugucgagcgucaauauggugucccgguugcugcucaacagauuuacuaugacgcaccguaggccgacaaucgagaaagauguagaccuuggcgcagguacccggcacgugaacgccgaaccugagacuccaaauauggacguuauuggggagcgcauaaagcgaaucaaagaagagcauucuucaaccuggcacuaugaugacgaaaaccccuacaagacaugggcuuaucauggaagcuacgaggucaaggccacgggcuccgcaaguucuaugauuaauggcguggugaaacuguuaaccaagccuugggaugucguuccaauggugacucaaauggccaugacagacaccacucccuucgggcagcagagaguauuuaaagaaaagguggauacaaggaccccgcggccuaugcccggaacacgcaaagucauggagaucacugcugaguggcuguggagaaccuuggguaggaacaagcgaccacggcucugcacgcgugaagaguucaccaagaaagugagaacaaaugcggccaugggcgcaguuuuuacugaagagaaccaaugggacagcgcucgcgccgcaguggaagaugaggaguucuggaagcuggucgacagggaacgggagcuacacaaacuugggaaguguggaucaugcguguauaauaugaugggcaaaagagaaaagaaacugggugaguuugggaaggccaagggaucccgcgcuauuugguacauguggcucggcgccagguaucuggaguucgaagcguugggcuuucugaacgaggaucauugguucagucgagaaaauagcuacucugggguagagggagaaggucuccacaaacuuggcuacauccugcgggacauauccaagaucccugggggagcaauguaugccgaugacaccgcuggcugggacacaagaauuacugaggaugacuuacacaacgaggaaaaaaucacccagcagauggaucccgagcauaggcagcuggccaaugcaauuuuuaaguugacguaccaaaacaaaguugugaagguccagcgcccaacacccaaggguaccgugauggacaucauaucacguaaagaucagcgggggagcggacaggugggcacuuauggccucaauacauucaccaacauggaagcucaacuggucagacagauggagggggaaggaguucuaucgaagguggaccuugagaauccucaccugcucgagaaaaagauuacucaguggcuggaaaccaaagguguagagagguugcgccgaauggccaucucuggcgaugacugcguggucaagccaaucgaugaccgguuugcuaacgccuuacuggcacucaacgauauggggaaggugagaaaagacauuccgcaguggcaacccaguaagggauggcaugauuggcagcagguuccuuucuguucccaccacuuccaugaacuuauaaugaaagacggcaggaagcugguggucccaugccgcccccaggacgagcuaaucgguagagcgcggauuagccaaggggccggauggucacugaaagaaacagcuugucucggcaaggccuacgcacagaugugguccuugauguauuuucacaggcgugaucugcgacuugcuucuaaugccaucugcagcgcagugccuguacauuggguuccaacgagucgcaccacuugguccauucacgcccaucaccaguggaugacaaccgaggacaugcugacuguguggaacagagucuggaucgaggauaaucccuggauggaagacaagacaccugugaccacgugggaggauguuccguaccucggcaaacgggaagaccaauggugugggagcuuaauaggacugacaucuagggcgaccugggcucagaacaucuugacugccauucagcaggugcgcucacugaucggugaugaggaguuccucgacuauaugccaaguaugaagagauuucggaaagaagaggaauccgagggcgcaauuugguga

SEQ ID NO: 15384 - RNA, 9873 nt, Artificial Sequence
  derived and/or modified CDS sequence (opt3) from DENV-3__FJ744729__SS-prME
accagccugugccucaugaugaugcuucccgccacacuggcuuuccacuugacuuccagagacggcgagccuaggaugaucguggcaaagaacgaacgggggaaaucuuuacuguuuaagacggccucaggaauuaauauguguacccuaauagcgauggaucucggugagaugugcgacgauacagucacuuacaaauguccacugaucgcugaaguugagccggaagacauugauugcugguguaaccuuaccaguacaugggugaccuauggcacuugcaaucaggccggggagcaucgccgagacaagcguagcguagcacuggccccccacgugggaaugggcuuggauacaagaacccaaacguggauguccgcugagggugcauggaggcaggucgaaaaaguggagacuugggcccuccggcauccuggguucaccauccuggcucuguuucucgcccacuacauuggaacaucuuuaacucagaagguugugaucuucauacugcuuauguuggucaccccaucgaugacaaugcgcugugugggcguaggcaacagagacuuuguugaagggcugucaggagcgaccuggguggaugucgugcuagagcaugguggcugcgugacgacuauggcaaagaauaaacccacacucgacaucgagcugcagaagaccgaagccacucaacuugcuacacugaggaaauuguguauugaggggaagaucaccaacauuacgaccgauagccggugcccuacacagggagaagccauccucccagaggaacaggaccagaauuaugucuguaaacacacuuacguugaucgcggcugggguaacgggugcggacuguucggcaagggcaguuuagugaccugcgcaaaguuucaaugucugaaacccauagaggggaagguagugcagcacgagaaucucaaauauacagucauuaucacugugcauaccggagaccagcaccagguugguaacgacacacaaggcgugaccgucgaaauuacuccucaggcuuccacgguggaggccauccuuccagaauacgggacacugggauuggagugcucuccgcgaaccggccuagauuucaaugaaaugauccugcucacuaugaagaacaaagcguggaugguacauagacagugguuuuucgaccugccccuuccuuggaccagcggugccacaaccgagacuccaacauggaauaggaaggagcuguugguuacguuuaaaaacgcacacgcuaagaagcaagaaguggucgugcucgggucccaggagggcgccaugcacaccgcucugacuggagccacagaaauucagaauucaggcgggaccaguauauucgcaggacauuuaaaaugucggcugaagauggauaaacuagagcucaaggguaugagcuaugccaugugccugaacacauuuguccuuaaaaaggaagugucugagacucagcacggcaccaucuugauuaagguugaguacaaaggggaagacgcucccuguaagaucccuuucuccacggaggauggacaaggcaaagcgcauaacggucgucugauaaccgcaaauccagugguaacaaagaaagaagagcccgucaacauugaggccgaaccgccuuucggggagucaaauaucgugaucggcauuggagacaaggcucucaagaucaacugguacaaaaagggcagcaguauugggaaaauguuugaagccacugcacgcggagccagaaggauggcuauacugggugauaccgccugggacuucggcucuguugggggagugcuuaauucccugggcaagaugguccaccagaucuuugguagcgcauauacagcguuguucucgggggugucuuggauuaugaaaaucggcaucggaguacuccugacuuggauuggcuuaaacuccaagaauaccucaaugaguuuuagcugcauagugaucgggauuaucacgcuguaccuaggagcuguuguccaggccgauaugggcugugugauuaacuggaaggguaaagagcucaagugcggguccggaaucuucgugacaaaugaaguccauaccuggacugagcaguauaaauuucaagcagacucucccaagcggcuggccacagcuauagccggcgcaugggagaacgguguuuguggcauccgaagcaccacucgcauggaaaaucuuuuguggaaacagauugcuaacgagcugaauuacauccucugggaaaacaauauuaagcugaccguggugguaggggauaucauaggagucuuagagcagggcaaaagaacacugacgccacagccuauggaacuuaaguauucauggaagaccugggggaaagccaagauugugacugcggagacacaaaacaguuccuucaucauugacggacccaacaccccagagugccccagcgccucuagggcuuggaauguuugggaaguggaggacuacggcuuuggugucuucacaacuaacaucugguugaaacuccgggaaguguauacccagucaugugaucaccgccugaugagugcagccauaaaggacgagagagcuguucacgccgauaugggguacuggaucgaaagccagaaaaauggauccuggaagcuagagaaggcaucuuuuauugaggugaaaacgugcacauggccuaagucgcauacccuguggagcaacggcguacucgaauccgacaugaucauuccaaaaucacuggcggguccgaucagucagcacaaucauaggcccggcuaccacacucaaaccgccgggccuuggcaccuuggaaaguuggagcuggauuucaacuauugcgaaggcacaacugucgugauaaccgagaauugugggacacguggaccaucuuuacggacgaccacugugagcggcaaacucauucaugaguggugcugucgauccugcacacugcccccucuuagauacaugggugaagacggguguugguauggaauggagaucaggccaaucaacgaaaaggaggaaaauauggucaagucacugguuagcgcuggcucugguaaaauggauaacuuuaccaugggcauuuugugccucgccauccuguucgaggaggugaugcgcgggaaguucggaaaaaagcacaugauugcaggcguacuauuuacuuucgugcugcuccuguccgggcagauaacauggcgggacauggcucauacccuuaucaugauuggaaguaaugccagcgauagaaugggcaugggugucacguacuuggcacugaucgccacuuuuaaaauucagcccuucuuagcucucggguuuuuccugaggaagcuuaccucucgcgaaaaccugcuacucggagugggccuggcgauggccacaaccuugcaacugccggaggacaucgaacagauggcaaauggcauagcuuuagggcucaugacucugaagcuuaucacacaguuugagaccuaucagcuguggacagccuugguuucccucacuuguucaaacaccauuuucacgcugacaguggccuggcgaaccgcuacucuaauccuggcaggagucagucuucucccucugugccaaagcucguccaugcggaaaaccgauugguugccaaugacaguggccgcgauggguguucccccucugcccuuauuuauuuucucucucaaggacacuccaaaacguagaagcuggccucugaaugaaggcgugauggcugucgggcuuguaucaauccuggccaguuccuugcucaggaacgaugugcccauggcaggaccacugguugccggcggucuacugauagcuuguuacgugauuaccgggacgucugcagaccuuacagucgagaaggccgcggacgugaccugggaggaagaggcugaacagacuggaguaagccacaaccucaugaucacaguggaugacgauggcaccaugcgcaucaaagacgaugagacugaaaauauucugacagucuuguuaaagaccgcccugcucauaguuuccggcaucuuuccguauucaauuccugcaacgcugcuuguguggcauacuuggcagaaacagacccaacggagcggggugcugugggacguccccaguccacccgagacacagaaggccgaguuggaagagggaguguacagaaucaagcagcaggguauuuucggcaaaacccaaguugggguaggagugcagaaggaaggcgucuuucacacaauguggcacgugacuaggggugcuguucuaacccauaacgggaaacgacuggagccuaauugggccucugugaagaaagaucucaucuccuacggaggcggcuggcgccugagcgcacaguggcaaaagggggaggaaguccaggugauagcuguagagccaggaaagaaccccaaaaauuuccagacgaugccugguaucuuccagacaacuaccggcgaaauuggggccaucgcgcuugacuuuaagccgggaacaucgggcucaccaauuaucaaccgggaggguaaagucgugggguuauauggaaauggcguugugaccaagaacggcggguacgucucuggaauagcccaaacuaaugcagaacccgaugguccuaccccagagcuggaggaagagauguucaaaaagagaaaccucacaauuauggacuugcaccccggcagugggaagacgaggaaauaucugccugcuaucgugcgugaagccaucaagcgccggcucagaacucugauucuugcuccgaccaggguuguggcagccgagauggaagaggcccugaaaggauugcccauccgauaccagacaaccgcuauaaaguccgagcauacuggccgggaaauugucgaucuaaugugccacgcgacauuuaccaugcgccugcucagcccagugagaguaccuaauuauaacuuaaucauuauggacgaggcacauuucacggaucccgccucuaucgcugccagggguuacauaagcacucggguggggaugggagaagcagccgcuauuuuuaugacagcgaccccaccuggcaccgccgaggcauucccccaguccaaugcuccaauccaggacgaagagcgagacaucccggagagaucauggaacaguggcaaugaauggauuacugauuuuguugggaaaacagucugguucgugccuagcaucaaggccggaaacgacauugcaaacugucugcgcaagaaugguaaaaaggugauacaacuuucuaggaaaaccuuugauacagaguaucagaagacucgucugaacgacugggauuucgucguaacgaccgacaucuccgaaaugggcgccaauuuuaaagcugaucgggugauugaccccagaaggugccucaagccaguuaucuugacagaugggcccgagcgcgugauccuggccggaccuaugccagucacugcggcaucagccgcucagcgaagaggccggguggguaggaacccccagaaggagaaugaccaauacauuuucaccgggcagccucucaacaaugaugaagaccacgcccacuggacagaggcuaaaaugcugcuugacaacauaaauaccccggaaggcaucauuccagcacuauucgagcccgaacgcgagaagagugccgcuaucgauggagaguaccgucugaaaggcgaaagcagaaagacuuuuguugaguugaugcggaggggggacuuaccuguguggcuggcccauaaagucgcauccgaaggaauuaaguauacggaucgcaaauggugcuucgacggugagcgaaacaaucagauccucgaagagaacauggauguggagauauggaccaaggaaggcgagagaaagaaacugcggcccagguggcuugacgcgcgcacauacucugauccacuggcccucaaggaauuuaaagacuucgcugccgggagaaagucgaucgcauuggaucugguaacugagauuggaagggugccuagccaccuagcucaucggacccguaaugcccuggacaaccucguuaugcuucacacaucagaacacggcggucgcgcauaucgacaugccgucgaggagcugcccgaaaccauggagacuuuauugcugcucgggcugaugauccuucugacaggcggagcuaugcucuuuuugauuuccggcaaagggaucggaaagacgaguauaggucugauuugugugaucgugucuagcggcauguuauggauggcggaugucccacuacaguggauugccuccgcaaucguucuggaauucuuuaugauggugcuccuuauaccugagccggagaagcaaagaaccccccaggacaaucagcuggcuuacguagugaucgggauuuugacucuggccgccaucgucacagcaaacgaaaugggacuccuggagaccaccaaaagggaucuuggcaugucaaaggaaccaggugugguuucuccuacaagcuaucucgacguggaccugcaccccgcuagugccuggacuuuguacgcggucgcuacgaccguaauuacaccaaugcugcggcauacuaucgagaauuccaccgccaacgugagcuuagcagccauagcuaaccaagcaguugugcuaauggggcuggauaaaggcuggccuauuucuaagauggaccucggagucccccuucuggccuugggcugcuauucacaggugaauccgcugacacucaccgcggcuguccugcuuuuagugacucacuacgccaucaucgggccaggacugcaggcaaaagccacgcgcgaagcucagaagagaacagccgcaggcauuaugaagaacccuaccguugaugguaucaugacuauagaccucgaucccgugauuuacgacuccaaauucgagaagcaauuggggcagguaaugcugcuagugcugugugcuguccagcuccuucugaugaggaccaguugggccuugugcgaggcgcugacacucgccacuggaccaaucaccacacugugggaaggcagccccgguaaauuuuggaauacgaccauugcaguuucgauggcuaacaucuuccggggcucuuauuuagccggggcaggacuugcuuuuuccauaaugcgaagcgugggcacugggaagagaggaacaggcucacagggugagacccugggggaaaaauggaagaagaaacucaaucaacuaagucgcaaggaguucgaucuguacaaaaagucuggaaucacugaagucgacaggacagaggccaaagagggcuugaagcggggugaaaccacgcaucacgccgugucccguggcagcgcgaaacugcagugguuuguagagagaaacauggugauuccugaagggaggguuaucgaucucggauguggccgcgggggauggucauauuacugcgcuggccuuaagaaggugaccgagguccgggguuauacaaaagggggaccgggccacgaagagcccgugccaaugaguacuuacggcuggaauauugucaagcugaugagcgggaaagacguguucuauuugccucccgagaagugugauacccugcucugcgacaucggagaauccucuccuagcccaacaguugaggaaucccgaacuauuagaguauuaaaaaugguggagcccuggcugaagaacaaucaguucuguaucaagguccuuaacccuuacaugccaaccgugauagagcaucuggaaaggcuacagcgcaaacacgguggcaugcucguucggaauccccugucaagaaacucuacacaugagauguacuggauuaguaaugggaccggaaacaucgugucgagcgucaauauggugucccguuugcugcucaacagguuuacuaugacgcaccggcgcccgacaaucgaaaaggauguagaccuuggcgcagguacccgacacgugaacgccgagccugaaacuccaaauauggacguuauuggggagagaauaaaaaggaucaaggaggaacauucuucaaccuggcacuaugaugacgagaaccccuacaaaacaugggcuuaucauggaagcuacgaagucaaggccacgggcuccgcaaguucuaugauuaauggcguggugaagcuguuaaccaaaccuugggaugucguuccaauggugacucaaauggccaugacagacaccacucccuucgggcagcagcggguauuuaaggagaaaguggauacacgcaccccgagaccuaugcccggaacaaggaaggucauggaaaucacugcugaguggcuguggcgaaccuugggucggaacaaacguccaagacucugcacgcgcgaggaauucaccaagaaggugaggacaaaugcggccaugggcgcaguuuuuacugaggaaaaccaaugggacagcgcucgggccgcaguggaggaugaagaguucuggaaacuggucgacagagagcgcgaacuacacaagcuugggaaauguggaucaugcguguauaauaugaugggcaagagggagaaaaagcugggugaauuugggaaagccaagggaucccgagcuauuugguacauguggcucggcgcccgguaucuggaguucgaggcguugggcuuucugaacgaagaucauugguucaguagagagaauagcuacucugggguagaaggagagggucuccacaagcuuggcuacauccugagggacauauccaaaaucccugggggagcaauguaugccgaugacaccgcuggcugggacacacgcauuacugaagaugacuuacacaacgaggagaagaucacccagcagauggaucccgaacaucgucagcuggccaaugcaauuuuuaaauugacguaccaaaacaagguugugaaaguccagcggccaacacccaaggguaccgugauggacaucauaucaagaaaggaucagagggggagcggacaggugggcacuuauggccucaauacauucaccaacauggaggcucaacugguccgccagauggaaggggagggaguucuaucgaaaguggaccuugaaaauccucaccugcucgagaagaaaauuacucaguggcuggagaccaaggguguagaacgauugcggagaauggccaucucuggcgaugacugcguggucaaaccaaucgaugacagguuugcuaacgccuuacuggcacucaacgauauggggaaggugcgcaaggacauuccgcaguggcaacccaguaaaggauggcaugauuggcagcagguuccuuucuguucccaccacuuccaugagcuuauaaugaaggacggcagaaaacugguggucccaugccggccccaggacgaacuaaucgguagggcgcguauuagccaaggggccggauggucacugaaggagacagcuugucucggcaaagccuacgcacagaugugguccuugauguauuuucaccgacgcgaucugagacuugcuucuaaugccaucugcagcgcagugccuguacauuggguuccaacgagucggaccacuugguccauucacgcccaucaccaguggaugacaaccgaagacaugcugacuguguggaacagggucuggaucgaggauaaucccuggauggaggacaagacaccugugaccacgugggaagauguuccguaccucggcaagcgcgaggaccaauggugugggagcuuaauaggacugacaucuagagcgaccugggcucagaacaucuugacugccauucagcaggugcggucacugaucggugaugaagaguuccucgacuauaugccaaguaugaaaagguuucgaaaggaggaagaguccgaaggcgcaauuugguga

SEQ ID NO: 15385 - RNA, 9873 nt, Artificial Sequence
  derived and/or modified CDS sequence (opt3) from DENV-3__FJ687448__SS-prME
accagccugugccucaugaugaugcuucccgccacacuggcuuuccacuugacuuccagagacggcgagccuaggaugaucguggcaaagaacgaacgggggaaaucuuuacuguuuaagacggccucaggaauuaauauguguacccuaauagcgauggaucucggugagaugugcgacgauacagucacuuacaaauguccacugaucgcugaaguugagccggaagacauugauugcugguguaaccuuaccaguacaugggugaccuauggcacuugcaaucaggccggggagcaucgccgagacaagcguagcguagcacuggccccccacgugggaaugggcuuggauacaagaacccaaacguggauguccgcugagggugcauggaggcaggucgaaaaaguggagacuugggcccuccggcauccuggguucaccauccuggcucuguuucucgcccacuacauuggaacaucuuuaacucagaagguugugaucuucauacugcuuauguuggucaccccaucgaugacaaugcgcugugugggcguaggcaacagagacuuuguugaagggcugucaggagcgaccuggguggaugucgugcuagagcaugguggcugcgugacgacuauggcaaagaauaaacccacacucgacaucgagcugcagaagaccgaagccacucaacuugcuacacugaggaaauuguguauugaggggaagaucaccaacauuacgaccgauagccggugcccuacacagggagaagccauccucccagaggaacaggaccagaauuaugucuguaaacacacuuacguugaucgcggcugggguaacgggugcggacuguucggcaagggcaguuuagugaccugcgcaaaguuucaaugucuggagcccauagaggggaaaguagugcagcacgaaaaucucaaguauacagucauuaucacugugcauaccggagaccagcaccagguugguaacgacacacaaggcgugaccgucgagauuacuccucaggcuuccacgguggaagccauccuuccagaguacgggacacugggauuggaaugcucuccgcgaaccggccuagauuucaaugagaugauccugcucacuaugaaaaacaaggcguggaugguacauagacagugguuuuucgaccugccccuuccuuggaccagcggugccacaaccgagacuccaacauggaauaggaaagaacuguugguuacguuuaagaacgcacacgcuaaaaagcaagagguggucgugcucgggucccaggaaggcgccaugcacaccgcucugacuggagccacagagauucagaauucaggcgggaccaguauauucgcaggacauuuaaagugucggcugaaaauggauaagcuagaacucaaagguaugagcuaugccaugugccugaacacauuuguccuuaagaaagaggugucugagacucagcacggcaccaucuugauuaagguugaauacaagggggaggacgcucccuguaaaaucccuuucuccacggaagauggacaaggcaaggcgcauaacggucgucugauaaccgcaaauccagugguaacaaaaaaggaggagcccgucaacauugaagccgagccgccuuucggggaaucaaauaucgugaucggcauuggagacaaagcucucaagaucaacugguacaagaaaggcagcaguauugggaagauguuugaggccacugcacgcggagccagaaggauggcuauacugggugauaccgccugggacuucggcucuguugggggagugcuuaauucccugggcaaaaugguccaccagaucuuugguagcgcauauacagcguuguucucgggggugucuuggauuaugaagaucggcaucggaguacuccugacuuggauuggcuuaaacuccaaaaauaccucaaugaguuuuagcugcauagugaucgggauuaucacgcuguaccuaggagcuguuguccaggccgauaugggcugugugauuaacuggaaggguaaggaacucaaaugcggguccggaaucuucgugacaaaugagguccauaccuggacugagcaguauaaguuucaagcagacucucccaaacggcuggccacagcuauagccggcgcaugggaaaacgguguuuguggcauccgaagcaccacucgcauggagaaucuuuuguggaagcagauugcuaacgaacugaauuacauccucugggagaacaauauuaaacugaccguggugguaggggauaucauaggagucuuagaacagggcaagagaacacugacgccacagccuauggagcuuaaauauucauggaagaccugggggaaggccaaaauugugacugcggagacacaaaacaguuccuucaucauugacggacccaacaccccagaaugccccagcgccucuagggcuuggaauguuugggagguggaagacuacggcuuuggugucuucacaacuaacaucugguugaagcuccgggagguguauacccagucaugugaucaccgccugaugagugcagccauaaaagacgaaagagcuguucacgccgauaugggguacuggaucgagagccagaagaauggauccuggaaacuagagaaggcaucuuuuauugaagugaagacgugcacauggccuaaaucgcauacccuguggagcaacggcguacucgaguccgacaugaucauuccaaagucacuggcggguccgaucagucagcacaaucauaggcccggcuaccacacucaaaccgccgggccuuggcaccuuggaaaauuggaacuggauuucaacuauugcgagggcacaacugucgugauaaccgagaauugugggacacguggaccaucuuuacggacgaccacugugagcggcaagcucauucaugaauggugcugucgauccugcacacugcccccucuuagauacaugggugaggacggguguugguauggaauggaaaucaggccaaucaacgagaaagaagagaauauggucaagucacugguuagcgcuggcucugguaagauggauaacuuuaccaugggcauuuugugccucgccauccuguucgaggaagugaugcgcgggaaauucggaaagaaacacaugauugcaggcguacuauuuacuuucgugcugcuccuguccgggcagauaacauggcgggacauggcucauacccuuaucaugauuggaaguaaugccagcgauagaaugggcaugggugucacguacuuggcacugaucgccacuuuuaagauucagcccuucuuagcucucggguuuuuccugaggaaacuuaccucucgcgagaaccugcuacucggagugggccuggcgauggccacaaccuugcaacugccggaagacaucgagcagauggcaaauggcauagcuuuagggcucaugacucugaagcuuaucacacaguuugaaaccuaucagcuguggacagccuugguuucccucacuuguucaaacaccauuuucacgcugacaguggccuggcgaaccgcuacucuaauccuggcaggagucagucuucucccucugugccaaagcucguccaugcggaagaccgauugguugccaaugacaguggccgcgauggguguucccccucugcccuuauuuauuuucucucucaaagacacuccaaagcguagaagcuggccucugaaugagggcgugauggcugucgggcuuguaucaauccuggccaguuccuugcucaggaacgaugugcccauggcaggaccacugguugccggcggucuacugauagcuuguuacgugauuaccgggacgucugcagaccuuacagucgagaaagccgcggacgugaccugggaagaggaagcugagcagacuggaguaagccacaaccucaugaucacaguggaugacgauggcaccaugcgcaucaaggacgaugaaacugagaauauucugacagucuuguuaaaaaccgcccugcucauaguuuccggcaucuuuccguauucaauuccugcaacgcugcuuguguggcauacuuggcagaagcagacccaacggagcggggugcugugggacguccccaguccacccgagacacagaaagccgaauuggaggaaggaguguacagaaucaagcagcaggguauuuucggcaagacccaaguugggguaggagugcagaaagagggcgucuuucacacaauguggcacgugacuaggggugcuguucuaacccauaacgggaagcgacuggagccuaauugggccucugugaaaaaggaucucaucuccuacggaggcggcuggcgccugagcgcacaguggcaaaaaggggaagagguccaggugauagcuguagaaccaggaaagaaccccaagaauuuccagacgaugccugguaucuuccagacaacuaccggcgagauuggggccaucgcgcuugacuuuaaaccgggaacaucgggcucaccaauuaucaaccgggaagguaaggucgugggguuauauggaaauggcguugugaccaaaaacggcggguacgucucuggaauagcccaaacuaaugcagagcccgaugguccuaccccagagcuggaagaggaaauguucaagaaaagaaaccucacaauuauggacuugcaccccggcagugggaagacgaggaaguaucugccugcuaucgugcgugaggccaucaaacgccggcucagaacucugauucuugcuccgaccaggguuguggcagccgaaauggaggaggcccugaagggauugcccauccgauaccagacaaccgcuauaaaauccgaacauacuggccgggagauugucgaucuaaugugccacgcgacauuuaccaugcgccugcucagcccagugagaguaccuaauuauaacuuaaucauuauggacgaagcacauuucacggaucccgccucuaucgcugccagggguuacauaagcacucggguggggaugggagaggcagccgcuauuuuuaugacagcgaccccaccuggcaccgccgaagcauucccccaguccaaugcuccaauccaggacgaggagcgagacaucccggaaagaucauggaacaguggcaaugaguggauuacugauuuuguugggaagacagucugguucgugccuagcaucaaagccggaaacgacauugcaaacugucugcgcaagaaugguaagaaagugauacaacuuucuaggaagaccuuugauacagaauaucagaaaacucgucugaacgacugggauuucgucguaacgaccgacaucuccgagaugggcgccaauuuuaaggcugaucgggugauugaccccagaaggugccucaaaccaguuaucuugacagaugggcccgagcgcgugauccuggccggaccuaugccagucacugcggcaucagccgcucagcgaagaggccggguggguaggaacccccagaaggaaaaugaccaauacauuuucaccgggcagccucucaacaaugaugaggaccacgcccacuggacagaagcuaagaugcugcuugacaacauaaauaccccggagggcaucauuccagcacuauucgaacccgagcgcgagaaaagugccgcuaucgauggagaauaccgucugaagggcgagagcagaaaaacuuuuguugaauugaugcggaggggggacuuaccuguguggcuggcccauaaggucgcauccgagggaauuaaauauacggaucgcaaguggugcuucgacggugaacgaaacaaucagauccucgaggagaacauggauguggaaauauggaccaaagagggcgaaagaaagaagcugcggcccagguggcuugacgcgcgcacauacucugauccacuggcccucaaagaguuuaaggacuucgcugccgggagaaaaucgaucgcauuggaucugguaacugaaauuggaagggugccuagccaccuagcucaucggacccguaaugcccuggacaaccucguuaugcuucacacaucagagcacggcggucgcgcauaucgacaugccgucgaggaacugcccgagaccauggaaacuuuauugcugcucgggcugaugauccuucugacaggcggagcuaugcucuuuuugauuuccggcaaggggaucggaaaaacgaguauaggucugauuugugugaucgugucuagcggcauguuauggauggcggaugucccacuacaguggauugccuccgcaaucguucuggaguucuuuaugauggugcuccuuauaccugagccggaaaagcaaagaaccccccaggacaaucagcuggcuuacguagugaucgggauuuugacucuggccgccaucgucacagcaaacgagaugggacuccuggaaaccaccaagagggaucuuggcaugucaaaagagccaggugugguuucuccuacaagcuaucucgacguggaccugcaccccgcuagugccuggacuuuguacgcggucgcuacgaccguaauuacaccaaugcugcggcauacuaucgaaaauuccaccgccaacgugagcuuagcagccauagcuaaccaagcaguugugcuaauggggcuggauaagggcuggccuauuucuaaaauggaccucggagucccccuucuggccuugggcugcuauucacaggugaauccgcugacacucaccgcggcuguccugcuuuuagugacucacuacgccaucaucgggccaggacugcaggcaaaggccacgcgcgaggcucagaaaagaacagccgcaggcauuaugaagaacccuaccguugaugguaucaugacuauagaccucgaucccgugauuuacgacuccaaguucgagaaacaauuggggcagguaaugcugcuagugcugugugcuguccagcuccuucugaugaggaccaguugggccuugugcgaagcgcugacacucgccacuggaccaaucaccacacugugggagggcagccccgguaaguuuuggaauacgaccauugcaguuucgauggcuaacaucuuccggggcucuuauuuagccggggcaggacuugcuuuuuccauaaugaaaagcgugggcacugggaagcgaggaacaggcucacagggugaaacccugggggagaaauggaagaagaaacucaaucaacuaaguagaaaggaauucgaucuguacaaaaagucuggaaucacugaggucgaccgcacagaggccaaagaaggcuugaagaggggugagaccacgcaucacgccgugucccggggcagcgcgaaacugcagugguuuguagaacguaacauggugauuccugaggggagaguuaucgaucucggauguggcagggggggauggucauauuacugcgcuggccuuaagaaggugaccgaaguccgcgguuauacaaaagggggaccgggccacgaggagcccgugccaaugaguacuuacggcuggaauauugucaagcugaugagcgggaaagacguguucuauuugccucccgaaaagugugauacccugcucugcgacaucggagaguccucuccuagcccaacaguugaagagucccggacuauucgaguauuaaaaaugguggagcccuggcugaagaacaaucaguucuguaucaagguccuuaacccuuacaugccaaccgugauagaacaucuggagagacuacagaggaaacacgguggcaugcucguucgcaauccccugucacggaacucuacacaugaaauguacuggauuaguaaugggaccggaaacaucgugucgagcgucaauaugguguccagauugcugcucaaccguuuuacuaugacgcacaggcggccgacaaucgagaaggauguagaccuuggcgcagguacccgccacgugaacgccgaaccugagacuccaaauauggacguuauuggggagcgaauaaaaagaaucaaggaagagcauucuucaaccuggcacuaugaugacgaaaaccccuacaaaacaugggcuuaucauggaagcuacgaggucaaggccacgggcuccgcaaguucuaugauuaauggcguggugaagcuguuaaccaaaccuugggaugucguuccaauggugacucaaauggccaugacagacaccacucccuucgggcagcagaggguauuuaaggaaaaaguggauacacggaccccgcgcccuaugcccggaacaagaaaggucauggagaucacugcugaguggcuguggaggaccuugggucgaaacaaacggccacgucucugcacgagagaagaguucaccaagaaggugcgcacaaaugcggccaugggcgcaguuuuuacugaagagaaccaaugggacagcgcuagggccgcaguggaagaugaggaguucuggaaacuggucgaccgggaaagagagcuacacaagcuugggaaauguggaucaugcguguauaauaugaugggcaagcgcgaaaaaaagcugggugaguuugggaaagccaagggauccagggcuauuugguacauguggcucggcgcccgauaucuggaguucgaagcguugggcuuucugaacgaggaucauugguucagucgggaaaauagcuacucugggguagagggagaaggucuccacaagcuuggcuacauccugagagacauauccaaaaucccugggggagcaauguaugccgaugacaccgcuggcugggacacaaggauuacugaggaugacuuacacaacgaggaaaagaucacccagcagauggaucccgagcaucgccagcuggccaaugcaauuuuuaaauugacguaccaaaacaagguugugaaaguccagcguccaacacccaaggguaccgugauggacaucauaucacggaaggaucagagagggagcggacaggugggcacuuauggccucaauacauucaccaacauggaagcucaacuggucaggcagauggagggggaaggaguucuaucgaaaguggaccuugagaauccucaccugcucgagaagaaaauuacucaguggcuggaaaccaaggguguagagcgcuugcgacggauggccaucucuggcgaugacugcguggucaaaccaaucgaugacagauuugcuaacgccuuacuggcacucaacgauauggggaaggugaggaaggacauuccgcaguggcaacccaguaaaggauggcaugauuggcagcagguuccuuucuguucccaccacuuccaugaacuuauaaugaaggacggccgcaaacugguggucccaugcagaccccaggacgagcuaaucggucgggcgaggauuagccaaggggccggauggucacugaaggaaacagcuugucucggcaaagccuacgcacagaugugguccuugauguauuuucaccgucgagaucugcgccuugcuucuaaugccaucugcagcgcagugccuguacauuggguuccaacgaguagaaccacuugguccauucacgcccaucaccaguggaugacaaccgaggacaugcugacuguguggaaccgggucuggaucgaggauaaucccuggauggaagacaagacaccugugaccacgugggaggauguuccguaccucggcaagagggaagaccaauggugugggagcuuaauaggacugacaucucgcgcgaccugggcucagaacaucuugacugccauucagcaggugagaucacugaucggugaugaggaguuccucgacuauaugccaaguaugaaacgguuuaggaaggaagaggaauccgagggcgcaauuugguga

SEQ ID NO: 15386 - RNA, 9873 nt, Artificial Sequence
  derived and/or modified CDS sequence (opt3) from DENV-3__FJ744732__SS-prME
accagccugugccucaugaugaugcuucccgccacacuggcuuuccacuugacuuccagggacggcgaaccuaggaugaucguggccaagaacgaacgggggaagucuuuacuguuuaagacggccucaggaauuaauauguguacccuaauagcgauggaucucggugagaugugcgacgauacaguaacuuacaaauguccacugaucgcugaaguugagccggaagacauugauugcugguguaaccuuaccaguacaugggugaccuauggcacuugcaaucaggccggggagcaucgccgagacaagcguagcguagcacuggcaccccacgugggaaugggcuuggauacaagaacccagacguggauguccgcugagggugcauggaggcaggucgaaaaaguggagacuugggcccuccggcauccuggguucaccauccuggcucuguuucucgcccacuacauuggaacaucuuuaacucagaagguugugaucuucauacugcuuauguuggucaccccaucgaugacaaugcgcugugugggcguaggcaacagggacuuuguugaagggcugucaggagcgaccuggguggaugucgugcuagagcaugguggcugcgugacgacuauggcaaagaauaaacccacacucgacaucgagcugcagaagaccgaagccacucagcuugcuacacugaggaaauuguguauugaggggaagaucaccaacauuacgaccgauagccggugcccuacacagggagaagccauccucccagaggaacaggaccagaauuaugucuguaaacacacuuacguugaucgcggcugggguaacgggugcggacuguucggcaagggcaguuuagugaccugcgcaaaguuucaaugucuggagcccauagaggggaaaguagugcagcacgaaaaucucaaguauacagucauuaucacugugcauaccggagaccagcaccagguugguaacgacacacaaggcgugaccgucgagauuacuccucaggcuuccacgguggaagccauccuuccagaguacgggacacugggauuggaaugcucuccgcgaaccggccuagauuucaaugagaugauccugcucacuaugaaaaacaaggcguggaugguacauagacagugguuuuucgaccugccccuuccuuggaccagcggugccacaaccgagacuccaacauggaauaggaaagaacuguugguuacguuuaagaacgcacacgcuaaaaagcaagagguggucgugcucgggucccaggaaggcgccaugcacaccgcucugacuggagccacagagauucaaaauucaggcgggaccaguauauucgcaggacauuuaaagugucggcugaaaauggauaagcuagaacucaaagguaugagcuaugccaugugccugaacacauuuguccuuaagaaagaggugucugagacucagcacggcaccaucuugauuaagguugaauacaagggggaggacgcucccuguaaaaucccuuucuccacggaagauggacaaggcaaggcgcauaacggucgucugauaaccgcaaauccagugguaaccaagaaggaggagcccgucaacauugaagccgagccgccuuucggggaaucaaauaucgugaucggcauuggagacaaagcucucaagaucaacugguacaagaaaggcagcaguauugggaagauguuugaggccacugcacgcggagccagaaggauggcuauacugggugauaccgccugggacuucggcucuguugggggagugcuuaauucccugggcaaaaugguccaccagaucuuugguagcgcauauacagcguuguucucgggggugucuuggauuaugaagaucggcaucggaguacuccugacuuggauuggcuuaaacuccaaaaauaccucaaugaguuuuagcugcauagugaucgggauuaucacgcuguaccuaggagcuguuguccaggccgauaugggcugugugauuaacuggaaggguaaggaacucaaaugcggguccggaaucuucgugacaaaugagguccauaccuggacugagcaguauaaguuucaagcagacucucccaaacggcuggccacagcuauagccggcgcaugggaaaacgguguuuguggcauccgaagcaccacucgcauggagaaucuuuuguggaagcagauugcuaacgaacugaauuacauccucugggagaacaauauuaaacugaccguggugguaggggauaucauaggagucuuagaacagggcaagagaacacugacgccacagccuauggagcuuaaauauucauggaagaccugggggaaggccaaaauugugacugcggagacacaaaacaguuccuucaucauugacggacccaacaccccagaaugccccagcgccucuagggcuuggaauguuugggagguggaagacuacggcuuuggugucuucacaacuaacaucugguugaagcuccgggagguguauacccagucaugugaucaccgccugaugagugcagccauaaaagacgaaagagcuguucacgccgauaugggguacuggaucgagagccagaagaauggauccuggaaacuagagaaggcaucuuuuauugaagugaagacgugcacauggccuaaaucgcauacccuguggagcaacggcguacucgaguccgacaugaucauuccaaagucacuggcggguccgaucagucagcacaaucauaggcccggcuaccacacucaaaccgccgggccuuggcaccuuggaaaauuggaacuggauuucaacuauugcgagggcacaacugucgugauaaccgagaauugugggacacguggaccaucuuuacggacgaccacugugagcggcaagcucauucaugaauggugcugucgauccugcacacugcccccucuuagauacaugggugaggacggguguugguauggaauggaaaucaggccaaucaacgagaaagaagagaauauggucaagucacugguuagcgcuggcucugguaagauggauaacuuuaccaugggcauuuugugccucgccauccuguucgaggaagugaugcgcgggaaauucggaaagaaacacaugauugcaggcguacuauuuacuuucgugcugcuccuguccgggcagauaacauggcgggacauggcucauacccuuaucaugauuggaaguaaugccagcgauagaaugggcaugggugucacguacuuggcacugaucgccacuuuuaagauucagcccuucuuagcucucggguuuuuccugaggaaacuuaccucucgcgagaaccugcuacucggagugggccuggcgauggccacaaccuugcaacugccggaagacaucgagcagauggcaaauggcauagcuuuagggcucaugacucugaaacuuaucacacaguuugaaaccuaucagcuguggacagccuugguuucccucacuuguucaaacaccauuuucacgcugacaguggccuggcgaaccgcuacucuaauccuggcaggagucagucuucucccucugugccaaagcucguccaugcggaagaccgauugguugccaaugacaguggccgcgauggguguucccccucugcccuuauuuauuuucucucucaaagacacuccaaagcguagaagcuggccucugaaugagggcgugauggcugucgggcuuguaucaauccuggccaguuccuugcucaggaacgaugugcccauggcaggaccacugguugccggcggucuacugauagcuuguuacgugauuaccgggacgucugcagaccuuacagucgagaaagccgcggacgugaccugggaagaggaagcugagcagacuggaguaagccacaaccucaugaucacaguggaugacgauggcaccaugcgcaucaaggacgaugaaacugagaauauucugacagucuuguuaaaaaccgcccugcucauaguuuccggcaucuuuccguauucaauuccugcaacgcugcuuguguggcauacuuggcagaagcagacccaacggagcggggugcugugggacguccccaguccacccgagacacagaaagccgaauuggaggaaggaguguacagaaucaagcagcaggguauuuucggcaagacccaaguugggguaggagugcagaaagagggcgucuuucacacaauguggcacgugacuaggggugcuguucuaacccauaacgggaagcgacuggagccuaauugggccucugugaaaaaggaucucaucuccuacggaggcggcuggcgccugagcgcacaguggcaaaaaggggaagagguccaggugauagcuguagaaccaggaaagaaccccaagaauuuccagacgaugccugguaucuuccagacaacuaccggcgagauuggggccaucgcgcuugacuuuaaaccgggaacaucgggcucaccaauuaucaaccgggaagguaaggucgugggguuauauggaaauggcguugugaccaaaaacggcggguacgucucuggaauagcccaaacuaaugcagagcccgaugguccuaccccagagcuggaagaggaaauguucaagaaaagaaaccucacaauuauggacuugcaccccggcagugggaagacgaggaaguaucugccugcuaucgugcgugaggccaucaaacgccggcucagaacucugauucuugcuccgaccaggguuguggcagccgaaauggaggaggcccugaagggauugcccauccgauaccagacaaccgcuauaaaauccgaacauacuggccgggagauugucgaucuaaugugccacgcgacauuuaccaugcgccugcucagcccagugagaguaccuaauuauaacuuaaucauuauggacgaagcacauuucacggaucccgccucuaucgcugccagggguuacauaagcacucggguggggaugggagaggcagccgcuauuuuuaugacagcgaccccaccuggcaccgccgaagcauucccccaguccaaugcuccaauccaggacgaggagcgagacaucccggaaagaucauggaacaguggcaaugaguggauuacugauuuugccgggaagacaguuugguucgucccuagcaucaaagcaggaaacgacauugccaacugucugcgcaagaaugguaagaaagugauacaacuuucuaggaagaccuuugauacagaauaucagaaaacucgucugaacgacugggauuucguggucacgaccgacaucuccgagaugggcgcuaauuuuaaggccgaucggguaauugaccccagaaggugccucaaaccagugaucuugacagaugggcccgagcgcguuauccuggcgggaccuaugccagugacugcagccucagcugcccagcgaagaggccgggucgguaggaacccccagaaggaaaaugaccaauacauuuucaccgggcagccucucaacaaugaugaggaccacgcucacuggacagaagcaaagaugcugcuugacaacauaaauaccccggagggcaucauuccagcccuauucgaacccgagcgcgagaaaagugcugccaucgauggagaauaccgucugaagggcgagagcagaaaaacuuuuguggaauugaugcggagaggggacuuaccuguuuggcuggcacauaagguggcguccgagggaauuaaauauacggaucgcaaguggugcuucgacggugaacgaaacaaucagauccucgaggagaacauggaugucgaaauauggaccaaagagggcgaaagaaagaagcugcggcccagguggcuugacgcccgcacauacucugauccacuggcucucaaagaguuuaaggacuucgccgcagggagaaaaucgaucgcuuuggaucuggugacugaaauuggaaggguaccuagccaccuagcccaucggacccguaaugcacuggacaaccucgugaugcuucacacaucagagcacggcggucgcgccuaucgacaugcuguugaggaacugcccgagaccauggaaacuuuauugcugcucgggcugaugauccuucugacaggcggagcgaugcucuuuuugauuuccggcaaggggaucggaaaaacgaguauaggucugauuugugucaucgugucuagcggcauguuauggauggccgaugugccacuacaguggauugcauccgcuaucguccuggaguucuuuaugaugguucuccuuauaccugagccggaaaagcaaagaacaccccaggacaaucagcuggccuacgugguaaucgggauuuugacucuggccgcaaucgugacagcuaacgagaugggacuccuggaaaccaccaagagggaucuuggcaugucaaaagagccaggugucgugucuccuacaagcuaucucgacguugaccugcaccccgccagugcguggacuuuguacgcuguggccacgaccgucauuacaccaaugcugcggcauacuaucgaaaauuccaccgcaaacgucagcuuagccgcuauagcaaaccaagccgugguucuaauggggcuggauaagggcuggccuauuucuaaaauggaccucggagugccccuucuggcguugggcugcuauucacaggucaauccgcugacacucaccgcugccgugcugcuuuuagucacucacuacgcaaucaucgggccaggacugcaggccaaggcuacgcgcgaggcccagaaaagaacagcagcuggcauuaugaagaacccuaccguggaugguaucaugacuauagaccucgaucccguuauuuacgacuccaaguucgagaaacaauugggacaggugaugcugcuaguacugugugccgugcagcuccuucugaugaggaccaguugggcguugugcgaagcccugacacucgcaacuggaccaaucaccacacugugggagggcagccccgguaaguuuuggaauacgaccauugcugucucgauggccaacaucuuccggggcucuuauuuagcaggggcuggacuugccuuuuccauaaugaaaagcguuggcacugggaagcgaggaacaggcucacagggugaaacccugggggagaaauggaagaagaaacucaaucaacuaaguagaaaggaguucgaucuguacaaaaagucuggaaucacugagguggaccgcacagaggccaaagaaggcuugaagaggggugagaccacgcaucacgcggucucccggggcagcgcuaaacugcagugguuuguggaacguaacaugguaauuccugaggggagagugaucgaucucggauguggcagaggcggguggucauauuacugcgcagggcuuaagaagguuaccgaagugcgcgguuauacaaaagggggaccgggccacgaggagcccgucccaaugaguacuuacggcuggaauauugugaagcugaugagcgggaaagacgucuucuauuugccucccgaaaagugugauacccugcucugcgacaucggagaguccucuccuagcccaacaguggaagagucccggacuauucgaguuuuaaaaaugguagagcccuggcugaagaacaaucaguucuguaucaaggugcuuaacccuuacaugccaaccgucauagaacaucuggagagacuacagaggaaacacgguggcaugcucgugcgcaauccccugucacggaacucuacacaugaaauguacuggauuaguaaugggaccggaaacaucguuucgagcgugaauauggucuccagauugcugcucaaccguuuuacuaugacgcacaggcggccgacaaucgagaaggauguggaccuuggcgccgguacccgccacguaaacgcugaaccugagacuccaaauauggacgugauuggggagcgaauaaaaagaaucaaggaagaacacucuucaaccuggcacuaugaugacgaaaaccccuacaaaacaugggccuaucauggaagcuacgagguuaaggcaacgggcuccgccaguucuaugauuaauggcgucgugaagcuguuaaccaaaccuugggauguggucccaaugguuacucaaauggcuaugacagacaccacucccuucgggcagcagaggguguuuaaggaaaaaguagauacacggaccccgcgcccuaugcccggaacaagaaaggugauggagaucacugcggaguggcuguggaggaccuugggucgaaacaaacggccacgucucugcacgagagaagaguucaccaagaagguccgcacaaaugccgcaaugggcgcuguguuuacugaagagaaccaaugggacagcgccagggcagccguugaagaugaggaguucuggaaacugguggaccgggaaagagagcuacacaaacuugggaaauguggaucaugcgucuauaauaugaugggcaagcgcgagaagaagcugggugaguuugggaaagcuaagggauccagggccauuugguacauguggcucggcgcgcgauaucuggaguucgaagcauugggcuuucugaacgaggaucauugguucagucgggaaaauagcuacucugggguggagggagaaggucuccacaaacuuggcuacauccugagagacauauccaaaaucccugggggagccauguaugcugaugacaccgccggcugggacacaaggauuacugaggaugacuuacacaacgaggaaaagaucacccagcagauggaucccgagcaucgccagcuggcaaaugcuauuuuuaaauugacguaccaaaacaagguaguuaaagugcagcguccaacacccaaggguaccgucauggacaucauaucacggaaggaucagagagggagcggacaggugggcacuuauggccucaauacauucaccaacauggaagcccaacuggugaggcagauggagggggaaggaguccuaucgaaaguugaccuugagaauccucaucugcucgagaagaaaauuacucaguggcuggaaaccaaggguguggagcgcuugcgacggauggcuaucucuggcgaugacugcguagugaaaccaaucgaugacagauuugccaacgcauuacuggcgcucaacgauauggggaaggucaggaaggacauuccgcaguggcaacccaguaaaggauggcaugauuggcaacaggugccuuucuguucccaccacuuccaugaacuuauaaugaaggacggccgcaaacugguugugccaugcagaccccaggacgagcuaaucggucgggccaggauuagccaaggggcuggauggucacugaaggaaacagccugucucggcaaagcauacgcucagaugugguccuugauguauuuucaccgucgagaucugcgccuugccucuaaugcaaucugcagcgccgucccugugcauuggguaccaacgaguagaaccacuugguccauucacgcgcaucaccaguggaugacaaccgaggacaugcugacuguuuggaaccggguguggaucgaggauaaucccuggauggaagacaagacaccugucaccacgugggaggaugugccguaccucggcaagagggaagaccaauggugugggagcuuaauaggacugacaucucgcgcuaccugggcccagaacaucuugacugcaauucagcagguuagaucacugaucggugaugaggaguuccucgacuauaugccaaguaugaaacgguuuaggaaggaagaggaauccgagggcgccauuugguga

SEQ ID NO: 15387 - RNA, 9873 nt, Artificial Sequence
  derived and/or modified CDS sequence (opt3) from DENV-3__FJ810414__SS-prME
accagccugugccucaugaugaugcuucccgccacacuggcuuuccacuugacuuccagggacggcgaaccuaggaugaucguggccaagaacgaacgggggaagucuuuacuguuuaagacggccucaggaauuaauauguguacccuaauagcgauggaucucggugaaaugugcgacgauacaguaacuuacaaauguccacugaucgcugaaguugagccggaagacauugauugcugguguaaccuuaccaguacaugggugaccuauggcacuugcaaucaggccggggagcaucgccgagacaagcguagcguagcacuggcaccccacgugggaaugggcuuggauacaagaacccagacguggauguccgcugagggugcauggaggcaggucgaaaaaguggagacuugggcccuccggcauccuggguucaccauccuggcucuguuucucgcccacuacauuggaacaucuuuaacucagaagguugugaucuucauacugcuuauguuggucaccccaucgaugacaaugcgcugugugggcguaggcaacagggacuuuguugaagggcugucaggagcgaccuggguggaugucgugcuagagcaugguggcugcgugacgacuauggcaaagaauaaacccacacucgacaucgagcugcagaagaccgaagccacucagcuugcuacacugaggaaauuguguauugaggggaagaucaccaacauuacgaccgauagccggugcccuacacagggagaagccauccucccagaggaacaggaccagaauuaugucuguaaacacacuuacguugaucgcggcugggguaacgggugcggacuguucggcaagggcaguuuagugaccugcgcaaaguuucaaugucuggagcccauagaggggaaaguagugcagcacgaaaaucucaaguauacagucauuaucacugugcauaccggagaccagcaccagguugguaacgacacacaaggcgugaccgucgagauuacuccucaggcuuccacgguggaagccauccuuccagaguacgggacacugggauuggaaugcucuccgcgaaccggccuagauuucaaugagaugauccugcucacuaugaaaaacaaggcguggaugguacauagacagugguuuuucgaccugccccuuccuuggaccagcggugccacaaccgagacuccaacauggaauaggaaagaacuguugguuacguuuaagaacgcacacgcuaaaaagcaagagguggucgugcucgggucccaggaaggcgccaugcacaccgcucugacuggagccacagagauucaaaauucaggcgggaccaguauauucgcaggacauuuaaagugucggcugaaaauggauaagcuagaacucaaagguaugagcuaugccaugugccugaacacauuuguccuuaagaaagaggugucugagacucagcacggcaccaucuugauuaagguugaauacaagggggaggacgcucccuguaaaaucccuuucuccacggaagauggacaaggcaaggcgcauaacggucgucugauaaccgcaaauccagugguaaccaagaaggaggagcccgucaacauugaagccgagccgccuuucggggaaucaaauaucgugaucggcauuggagacaaagcucucaagaucaacugguacaagaaaggcagcaguauugggaagauguuugaggccacugcacgcggagccagaaggauggcuauacugggugauaccgccugggacuucggcucuguugggggagugcuuaauucccugggcaaaaugguccaccagaucuuugguagcgcauauacagcguuguucucgggggugucuuggauuaugaagaucggcaucggaguacuccugacuuggauuggcuuaaacuccaaaaauaccucaaugaguuuuagcugcauagugaucgggauuaucacgcuguaccuaggagcuguuguccaggccgauaugggcugugugauuaacuggaaggguaaggaacucaaaugcggguccggaaucuucgugacaaaugagguccauaccuggacugagcaguauaaguuucaagcagacucucccaaacggcuggccacagcuauagccggcgcaugggaaaacgguguuuguggcauccgaagcaccacucgcauggagaaucuuuuguggaagcagauugcuaacgaacugaauuacauccucugggagaacaauauuaaacugaccguggugguaggggauaucauaggagucuuagaacagggcaagagaacacugacgccacagccuauggagcuuaaauauucauggaagaccugggggaaggccaaaauugugacugcggagacacaaaacaguuccuucaucauugacggacccaacaccccagaaugccccagcgccucuagggcuuggaauguuugggagguggaagacuacggcuuuggugucuucacaacuaacaucugguugaagcuccgggagguguauacccagucaugugaucaccgccugaugagugcagccauaaaagacgaaagagcuguucacgccgauaugggguacuggaucgagagccagaagaauggauccuggaaacuagagaaggcaucuuuuauugaagugaagacgugcacauggccuaaaucgcauacccuguggagcaacggcguacucgaguccgacaugaucauuccaaagucacuggcggguccgaucagucagcacaaucauaggcccggcuaccacacucaaaccgccgggccuuggcaccuuggaaaauuggaacuggauuucaacuauugcgagggcacaacugucgugauaaccgagaauugugggacacguggaccaucuuuacggacgaccacugugagcggcaagcucauucaugaauggugcugucgauccugcacacugcccccucuuagauacaugggugaggacggguguugguauggaauggaaaucaggccaaucaacgagaaagaagagaauauggcuaagucacuggucagcgccggcucugguaagauggauaacuuuaccaugggcauuuugugccucgcaauccuguucgaggaaguuaugcgcgggaaauucggaaagaaacacaugauugcuggcgugcuauuuacuuucguacugcuccuguccgggcagauaacauggcgggacauggcccauacccuuaucaugauuggaaguaaugcaagcgauagaaugggcaugggugugacguacuuggcccugaucgcuacuuuuaagauucagcccuucuuagcgcucggguuuuuccugaggaaacuuaccucucgcgagaaccugcuacucggagucggccuggccauggcaacaaccuugcaacugccggaagacaucgagcagauggcuaauggcauagccuuagggcucaugacucugaaacuuaucacacaguuugaaaccuaucagcuguggacagccuuggugucccucacuuguucaaacaccauuuucacgcugacaguugcuuggcgaaccgcaacucuaauccuggccggagugagucuucucccucugugccaaagcucguccaugcggaagaccgauugguugccaaugacagucgcggcuaugggugugcccccucugcccuuauuuauuuucucucucaaagacacuccaaagcguagaagcuggccucugaaugagggcguuauggccguggggcuugucucaauccuggcaaguuccuugcucaggaacgauguacccauggccggaccacugguggcuggcggucuacugauagcauguuacguuauuaccgggacgucugccgaccuuacaguggagaaagcggcugacgucaccugggaagaggaagccgagcagacuggagugagccacaaccucaugaucacaguagaugacgauggcaccaugcgcaucaaggacgaugaaacugagaauauucugacaguguuguuaaaaaccgcacugcucauagucuccggcaucuuuccguauucaauuccugccacgcugcuuguuuggcauacuuggcagaagcagacccaacggagcggggugcugugggacgugcccaguccacccgagacacagaaagcugaauuggaggaaggagucuacagaaucaagcagcaggguauuuucggcaagacccaaguggggguuggaguacagaaagagggcguguuucacacaauguggcacgucacuaggggugccgugcuaacccauaacgggaagcgacuggagccuaauugggcaucuguuaaaaaggaucucaucuccuacggaggcggcuggcgccugagcgcucaguggcaaaaaggggaagaggugcaggucauagccguggaaccaggaaagaaccccaagaauuuccagacgaugccugguaucuuccagacaacuaccggcgagauuggggcgaucgcccuugacuuuaaaccgggaacaucgggcucaccaauuaucaaccgggaagguaagguagucggguuauauggaaauggcgugguuaccaaaaacggcggguacgugucuggaauagcacaaacuaaugcugagcccgaugguccuaccccagagcuggaagaggaaauguucaagaaaagaaaccucacaauuauggacuugcaccccggcagugggaagacgaggaaguaucugccugccaucguccgugaggcuaucaaacgccggcucagaacucugauucuugcaccgaccagggugguugccgccgaaauggaggaggcucugaagggauugcccauccgauaccagacaaccgcgauaaaauccgaacauacuggccgggagauuguggaucuaaugugccacgcaacauuuaccaugcgccugcucagcccagucagagugccuaauuauaacuuaaucauuauggacgaagcccauuucacggaucccgcuucuaucgccgcaagggguuacauaagcacucggguagggaugggagaggccgcugcgauuuuuaugacagccaccccaccuggcaccgcagaggcuuucccccaguccaaugccccaauccaggacgaggagcgagacaucccggaaagaucauggaacaguggcaaugaguggauuacugauuuuguggggaagacaguuugguucgucccuagcaucaaagcaggaaacgacauugccaacugucugcgcaagaaugguaagaaagugauacaacuuucuaggaagaccuuugauacagaauaucagaaaacucgucugaacgacugggauuucguggucacgaccgacaucuccgagaugggcgcuaauuuuaaggccgaucggguaauugaccccagaaggugccucaaaccagugaucuugacagaugggcccgagcgcguuauccuggcgggaccuaugccagugacugcagccucagcugcccagcgaagaggccgggucgguaggaacccccagaaggaaaaugaccaauacauuuucaccgggcagccucucaacaaugaugaggaccacgcucacuggacagaagcaaagaugcugcuugacaacauaaauaccccggagggcaucauuccagcccuauucgaacccgagcgcgagaaaagugcugccaucgauggagaauaccgucugaagggcgagagcagaaaaacuuuuguggaauugaugcggagaggggacuuaccuguuuggcuggcacauaagguggcguccgagggaauuaaauauacggaucgcaaguggugcuucgacggugaacgaaacaaucagauccucgaggagaacauggaugucgaaauauggaccaaagagggcgaaagaaagaagcugcggcccagguggcuugacgcccgcacauacucugauccacuggcucucaaagaguuuaaggacuucgccgcagggagaaaaucgaucgcuuuggaucuggugacugaaauuggaaggguaccuagccaccuagcccaucggacccguaaugcacuggacaaccucgugaugcuucacacaucagagcacggcggucgcgccuaucgacaugcuguugaggaacugcccgagaccauggaaacuuuauugcugcucgggcugaugauccuucugacaggcggagcgaugcucuuuuugauuuccggcaaggggaucggaaaaacgaguauaggucugauuugugucaucgugucuagcggcauguuauggauggccgaugugccacuacaguggauugcauccgcuaucguccuggaguucuuuaugaugguucuccuuauaccugagccggaaaagcaaagaacaccccaggacaaucagcuggccuacgugguaaucgggauuuugacucuggccgcaaucgugacagcuaacgagaugggacuccuggaaaccaccaagagggaucuuggcaugucaaaagagccaggugucgugucuccuacaagcuaucucgacguugaccugcaccccgccagugcguggacuuuguacgcuguggccacgaccgucauuacaccaaugcugcggcauacuaucgaaaauuccaccgcaaacgucagcuuagccgcuauagcaaaccaagccgugguucuaauggggcuggauaagggcuggccuauuucuaaaauggaccucggagugccccuucuggcguugggcugcuauucacaggucaauccgcugacacucaccgcugccgugcugcuuuuagucacucacuacgcaaucaucgggccaggacugcaggccaaggcuacgcgcgaggcccagaaaagaacagcagcuggcauuaugaagaacccuaccguggaugguaucaugacuauagaccucgaucccguuauuuacgacuccaaguucgagaaacaauugggacaggugaugcugcuaguacugugugccgugcagcuccuucugaugaggaccaguugggcguugugcgaagcccugacacucgcaacuggaccaaucaccacacugugggagggcagccccgguaaguuuuggaauacgaccauugcugucucgauggccaacaucuuccggggcucuuauuuagcaggggcuggacuugccuuuuccauaaugaaaagcguuggcacugggaagcgaggaacaggcucacagggugaaacccugggggagaaauggaagaagaaacucaaucaacuaaguagaaaggaguucgaucuguacaaaaagucuggaaucacugagguggaccgcacagaggccaaagaaggcuugaagaggggugagaccacgcaucacgcggucucccggggcagcgcuaaacugcagugguuuguggaacguaacaugguaauuccugaggggagagugaucgaucucggauguggcagaggcggguggucauauuacugcgcagggcuuaagaagguuaccgaagugcgcgguuauacaaaagggggaccgggccacgaggagcccgucccaaugaguacuuacggcuggaauauugugaagcugaugagcgggaaagacgucuucuauuugccucccgaaaagugugauacccugcucugcgacaucggagaguccucuccuagcccaacaguggaagagucccggacuauucgaguuuuaaaaaugguagagcccuggcugaagaacaaucaguucuguaucaaggugcuuaacccuuacaugccaaccgucauagaacaucuggagagacuacagaggaaacacgguggcaugcucgugcgcaauccccugucacggaacucuacacaugaaauguacuggauuaguaaugggaccggaaacaucguuucgagcgugaauauggucuccagauugcugcucaaccguuuuacuaugacgcacaggcggccgacaaucgagaaggauguggaccuuggcgccgguacccgccacguaaacgcugaaccugagacuccaaauauggacgugauuggggagcgaauaaaaagaaucaaggaagaacacucuucaaccuggcacuaugaugacgaaaaccccuacaaaacaugggccuaucauggaagcuacgagguuaaggcaacgggcuccgccaguucuaugauuaauggcgucgugaagcuguuaaccaaaccuugggauguggucccaaugguuacucaaauggcuaugacagacaccacucccuucgggcagcagaggguguuuaaggaaaaaguagauacacggaccccgcgcccuaugcccggaacaagaaaggugauggagaucacugcggaguggcuguggaggaccuugggucgaaacaaacggccacgucucugcacgagagaagaguucaccaagaagguccgcacaaaugccgcaaugggcgcuguguuuacugaagagaaccaaugggacagcgccagggcagccguugaagaugaggaguucuggaaacugguggaccgggaaagagagcuacacaaacuugggaaauguggaucaugcgucuauaauaugaugggcaagcgcgagaagaagcugggugaguuugggaaagcuaagggauccagggccauuugguacauguggcucggcgcgcgauaucuggaguucgaagcauugggcuuucugaacgaggaucauugguucagucgggaaaauagcuacucugggguggagggagaaggucuccacaaacuuggcuacauccugagagacauauccaaaaucccugggggagccauguaugcugaugacaccgccggcugggacacaaggauuacugaggaugacuuacacaacgaggaaaagaucacccagcagauggaucccgagcaucgccagcuggcaaaugcuauuuuuaaauugacguaccaaaacaagguaguuaaagugcagcguccaacacccaaggguaccgucauggacaucauaucacggaaggaucagagagggagcggacaggugggcacuuauggccucaauacauucaccaacauggaagcccaacuggugaggcagauggagggggaaggaguccuaucgaaaguugaccuugagaauccucaucugcucgagaagaaaauuacucaguggcuggaaaccaaggguguggagcgcuugcgacggauggcuaucucuggcgaugacugcguagugaaaccaaucgaugacagauuugccaacgcauuacuggcgcucaacgauauggggaaggucaggaaggacauuccgcaguggcaacccaguaaaggauggcaugauuggcaacaggugccuuucuguucccaccacuuccaugaacuuauaaugaaggacggccgcaaacugguugugccaugcagaccccaggacgagcuaaucggucgggccaggauuagccaaggggcuggauggucacugaaggaaacagccugucucggcaaagcauacgcucagaugugguccuugauguauuuucaccgucgagaucugcgccuugccucuaaugcaaucugcagcgccgucccugugcauuggguaccaacgaguagaaccacuugguccauucacgcgcaucaccaguggaugacaaccgaggacaugcugacuguuuggaaccggguguggaucgaggauaaucccuggauggaagacaagacaccugucaccacgugggaggaugugccguaccucggcaagagggaagaccaauggugugggagcuuaauaggacugacaucucgcgcuaccugggcccagaacaucuugacugcaauucagcagguuagaucacugaucggugaugaggaguuccucgacuauaugccaaguaugaaacgguuuaggaaggaagaggaauccgagggcgccauuugguga

SEQ ID NO: 15388 - RNA, 9873 nt, Artificial Sequence
  derived and/or modified CDS sequence (opt3) from DENV-3__FJ744734__SS-prME
accagccugugccucaugaugaugcuucccgccacacuggcuuuccacuugacuuccagagacggcgagccuaggaugaucguggcaaagaacgaacgggggaaaucuuuacuguuuaagacggccucaggaauuaauauguguacccuaauagcgauggaucucggugagaugugcgacgauacagucacuuacaaauguccacugaucgcugaaguugagccggaagacauugauugcugguguaaccuuaccaguacaugggugaccuauggcacuugcaaucaggccggggagcaucgccgagacaagcguagcguagcacuggccccccacgugggaaugggcuuggauacaagaacccaaacguggauguccgcugagggugcauggaggcaggucgaaaaaguggagacuugggcccuccggcauccuggguucaccauccuggcucuguuucucgcccacuacauuggaacaucuuuaacucagaagguugugaucuucauacugcuuauguuggucaccccaucgaugacaaugcgcugugugggcguaggcaacagagacuuuguugaagggcugucaggagcgaccuggguggaugucgugcuagagcaugguggcugcgugacgacuauggcaaagaauaaacccacacucgacaucgagcugcagaagaccgaagccacucaacuugcuacacugaggaaauuguguauugaggggaagaucaccaacauuacgaccgauagccggugcccuacacagggagaagccauccucccagaggaacaggaccagaauuaugucuguaaacacacuuacguugaucgcggcugggguaacgggugcggacuguucggcaagggcaguuuagugaccugcgcaaaguuucaaugucuggagcccauagaggggaaaguagugcagcacgaaaaucucaaguauacagucauuaucacugugcauaccggagaccagcaccagguugguaacgacacacaaggcgugaccgucgagauuacuccucaggcuuccacgguggaagccauccuuccagaguacgggacacugggauuggaaugcucuccgcgaaccggccuagauuucaaugagaugauccugcucacuaugaaaaacaaggcguggaugguacauagacagugguuuuucgaccugccccuuccuuggaccagcggugccacaaccgagacuccaacauggaauaggaaagaacuguugguuacguuuaagaacgcacacgcuaaaaagcaagagguggucgugcucgggucccaggaaggcgccaugcacaccgcucugacuggagccacagagauucagaauucaggcgggaccaguauauucgcaggacauuuaaagugucggcugaaaauggauaagcuagaacucaaagguaugagcuaugccaugugccugaacacauuuguccuuaagaaagaggugucugagacucagcacggcaccaucuugauuaagguugaauacaagggggaggacgcucccuguaaaaucccuuucuccacggaagauggacaaggcaaggcgcauaacggucgucugauaaccgcaaauccagugguaacaaaaaaggaggagcccgucaacauugaagccgagccgccuuucggggaaucaaauaucgugaucggcauuggagacaaagcucucaagaucaacugguacaagaaaggcagcaguauugggaagauguuugaggccacugcacgcggagccagaaggauggcuauacugggugauaccgccugggacuucggcucuguugggggagugcuuaauucccugggcaaaaugguccaccagaucuuugguagcgcauauacagcguuguucucgggggugucuuggauuaugaagaucggcaucggaguacuccugacuuggauuggcuuaaacuccaaaaauaccucaaugaguuuuagcugcauagugaucgggauuaucacgcuguaccuaggagcuguuguccaggccgauaugggcugugugauuaacuggaaggguaaggaacucaaaugcggguccggaaucuucgugacaaaugagguccauaccuggacugagcaguauaaguuucaagcagacucucccaaacggcuggccacagcuauagccggcgcaugggaaaacgguguuuguggcauccgaagcaccacucgcauggagaaucuuuuguggaagcagauugcuaacgaacugaauuacauccucugggagaacaauauuaaacugaccguggugguaggggauaucauaggagucuuagaacagggcaagagaacacugacgccacagccuauggagcuuaaauauucauggaagaccugggggaaggccaaaauugugacugcggagacacaaaacaguuccuucaucauugacggacccaacaccccagaaugccccagcgccucuagggcuuggaauguuugggagguggaagacuacggcuuuggugucuucacaacuaacaucugguugaagcuccgggagguguauacccagucaugugaucaccgccugaugagugcagccauaaaagacgaaagagcuguucacgccgauaugggguacuggaucgagagccagaagaauggauccuggaaacuagagaaggcaucuuuuauugaagugaagacgugcacauggccuaaaucgcauacccuguggagcaacggcguacucgaguccgacaugaucauuccaaagucacuggcggguccgaucagucagcacaaucauaggcccggcuaccacacucaaaccgccgggccuuggcaccuuggaaaauuggaacuggauuucaacuauugcgagggcacaacugucgugauaaccgagaauugugggacacguggaccaucuuuacggacgaccacugugagcggcaagcucauucaugaauggugcugucgauccugcacacugcccccucuuagauacaugggugaggacggguguugguauggaauggaaaucaggccaaucaacgagaaagaagagaauauggucaagucacugguuagcgcuggcucugguaagauggauaacuuuaccaugggcauuuugugccucgccauccuguucgaggaagugaugcgcgggaaauucggaaagaaacacaugauugcaggcguacuauuuacuuucgugcugcuccuguccgggcagauaacauggcgggacauggcucauacccuuaucaugauuggaaguaaugccagcgauagaaugggcaugggugucacguacuuggcacugaucgccacuuuuaagauucagcccuucuuagcucucggguuuuuccugaggaaacuuaccucucgcgagaaccugcuacucggagugggccuggcgauggccacaaccuugcaacugccggaagacaucgagcagauggcaaauggcauagcuuuagggcucaugacucugaagcuuaucacacaguuugaaaccuaucagcuguggacagccuugguuucccucacuuguucaaacaccauuuucacgcugacaguggccuggcgaaccgcuacucuaauccuggcaggagucagucuucucccucugugccaaagcucguccaugcggaagaccgauugguugccaaugacaguggccgcgauggguguucccccucugcccuuauuuauuuucucucucaaagacacuccaaagcguagaagcuggccucugaaugagggcgugauggcugucgggcuuguaucaauccuggccaguuccuugcucaggaacgaugugcccauggcaggaccacugguugccggcggucuacugauagcuuguuacgugauuaccgggacgucugcagaccuuacagucgagaaagccgcggacgugaccugggaagaggaagcugagcagacuggaguaagccacaaccucaugaucacaguggaugacgauggcaccaugcgcaucaaggacgaugaaacugagaauauucugacagucuuguuaaaaaccgcccugcucauaguuuccggcaucuuuccguauucaauuccugcaacgcugcuuguguggcauacuuggcagaagcagacccaacggagcggggugcugugggacguccccaguccacccgagacacagaaagccgaauuggaggaaggaguguacagaaucaagcagcaggguauuuucggcaagacccaaguugggguaggagugcagaaagagggcgucuuucacacaauguggcacgugacuaggggugcuguucuaacccauaacgggaagcgacuggagccuaauugggccucugugaaaaaggaucucaucuccuacggaggcggcuggcgccugagcgcacaguggcaaaaaggggaagagguccaggugauagcuguagaaccaggaaagaaccccaagaauuuccagacgaugccugguaucuuccagacaacuaugggcgagauuggggccaucgcgcuugacuuuaaaccgggaaccucgggcucaccaauuaucaaccgggaagguaaggucgugggguuauauggaaauggcguugugacaaaaaacggcggguacgucucuggaauagcccaaaccaaugcagagcccgaugguccuacuccagagcuggaagaggaaauguucaagaaaagaaaccucaccauuauggacuugcaccccggcagugggaagacaaggaaguaucugccugcuaucgugcgugaggccaucaaacgccggcucagaacgcugauucuugcuccgacuaggguuguggcagccgaaauggaggaggcccugaagggauugcccauccgauaccagaccacagcuauaaaauccgaacauaccggccgggagauugucgaucuaaugugccacgcgacuuuuacaaugcgccugcucagcccagugagaguaccuaauuauaacuuaaucauuauggacgaagcacauuucaccgaucccgccucuaucgcugccagggguuacauaagcacgcggguggggaugggagaggcagccgcuauuuuuaugacugcgacaccaccuggcaccgccgaagcauucccccaguccaaugcuccaauccaggacgaggagcgagacaucccggaaagaucauggaacaguggcaaugaguggauuaccgauuuuguugggaagacugucugguucgugccuagcaucaaagccggaaacgacauugcaaacugucugcgcaagaaugguaagaaagugauacaacuuucuaggaagacauuugauaccgaauaucagaaaacacgucugaacgacugggauuucgucguaacuacggacaucuccgagaugggcgccaauuuuaaggcugaucgggugauugaccccagaaggugccucaaaccaguuaucuugaccgaugggcccgagcgcgugauccuggccggaccuaugccagucacagcggcaucagccgcucagcgaagaggccggguggguaggaacccccagaaggaaaaugaccaauacauuuucacugggcagccucucaacaaugaugaggaccacgcccacuggaccgaagcuaagaugcugcuugacaacauaaauacaccggagggcaucauuccagcacuauucgaacccgagcgcgagaaaagugccgcuaucgauggagaauaccgucugaagggcgagagcagaaaaaccuuuguugaauugaugcggaggggggacuuaccuguguggcuggcccauaaggucgcauccgagggaauuaaauauacugaucgcaaguggugcuucgacggugaacgaaacaaucagauccucgaggagaacauggauguggaaauauggacgaaagagggcgaaagaaagaagcugcggcccagguggcuugacgcgcgcaccuacucugauccacuggcccucaaagaguuuaaggacuucgcugccgggagaaaaucgaucgcauuggaucugguaacagaaauuggaagggugccuagccaccuagcucaucggacucguaaugcccuggacaaccucguuaugcuucacaccucagagcacggcggucgcgcauaucgacaugccgucgaggaacugcccgagacaauggaaaccuuauugcugcucgggcugaugauccuucugacuggcggagcuaugcucuuuuugauuuccggcaaggggaucggaaaaacaaguauaggucugauuugugugaucgugucuagcggcauguuauggauggcggaugucccacuacaguggauugccuccgcaaucguucuggaguucuuuaugauggugcuccuuauaccugagccggaaaagcaaagaacgccccaggacaaucagcuggcuuacguagugaucgggauuuugacccuggccgccaucgucacugcaaacgagaugggacuccuggaaacaaccaagagggaucuuggcaugucaaaagagccaggugugguuucuccuaccagcuaucucgacguggaccugcaccccgcuagugccuggacauuguacgcggucgcuacuacgguaauuaccccaaugcugcggcauacaaucgaaaauuccacugccaacgugagcuuagcagccauagcuaaccaagcaguugugcuaauggggcuggauaagggcuggccuauuucuaaaauggaccucggagucccccuucuggccuugggcugcuauucacaggugaauccgcugacccucacagcggcuguccugcuuuuagugacccacuacgccaucaucgggccaggacugcaggcaaaggccacucgcgaggcucagaaaagaacggccgcaggcauuaugaagaacccuacaguugaugguaucaugaccauagaccucgaucccgugauuuacgacuccaaguucgagaaacaauuggggcagguaaugcugcuagugcugugugcuguccagcuccuucugaugaggacuaguugggccuugugcgaagcgcugacccucgccacaggaccaaucacuacccugugggagggcagccccgguaaguuuuggaauacaacgauugcaguuucgauggcuaacaucuuccggggcucuuauuuagccggggcaggacuugcuuuuuccauaaugaaaagcgugggcaccgggaagcgaggaacuggcucacagggugaaacacugggggagaaauggaagaagaaacucaaucaacuaaguagaaaggaauucgaucuguacaaaaagucuggaaucaccgaggucgaccgcacugaggccaaagaaggcuugaagaggggugagacaacccaucacgccgugucccggggcagcgcgaaacugcagugguuuguagaacguaacauggugauuccugaggggagaguuaucgaucucggauguggcagggggggauggucauauuacugcgcuggccuuaagaaggugacggaaguccgcgguuauaccaaagggggaccgggccacgaggagcccgugccaaugaguacauacggcuggaauauugucaagcugaugagcgggaaagacguguucuauuugccucccgaaaagugugauacucugcucugcgacaucggagaguccucuccuagcccaaccguugaagagucccggacaauucgaguauuaaaaaugguggagcccuggcugaagaacaaucaguucuguaucaagguccuuaacccuuacaugccaacugugauagaacaucuggagagacuacagaggaaacacgguggcaugcucguucgcaauccccugucacggaacucuacccaugaaauguacuggauuaguaaugggacaggaaacaucgugucgagcgucaauaugguguccagauugcugcucaaccguuuuaccaugacucacaggcggccgacgaucgagaaggauguagaccuuggcgcagguacacgccacgugaacgccgaaccugagaccccaaauauggacguuauuggggagcgaauaaaaagaaucaaggaagagcauucuucaacuuggcacuaugaugacgaaaaccccuacaaaaccugggcuuaucauggaagcuacgaggucaaggccacaggcuccgcaaguucuaugauuaauggcguggugaagcuguuaacgaaaccuugggaugucguuccaauggugacccaaauggccaugacugacacaacccccuucgggcagcagaggguauuuaaggaaaaaguggauacucggacaccgcgcccuaugcccggaaccagaaaggucauggagaucacagcugaguggcuguggaggacuuugggucgaaacaaacggccacgucucugcaccagagaagaguucacgaagaaggugcgcaccaaugcggccaugggcgcaguuuuuacagaagagaaccaaugggacagcgcuagggccgcaguggaagaugaggaguucuggaaacuggucgaccgggaaagagagcuacacaagcuugggaaauguggaucaugcguguauaauaugaugggcaagcgcgaaaaaaagcugggugaguuugggaaagccaagggauccagggcuauuugguacauguggcucggcgcccgauaucuggaguucgaagcguugggcuuucugaacgaggaucauugguucagucgggaaaauagcuacucugggguagagggagaaggucuccacaagcuuggcuacauccugagagacauauccaaaaucccugggggagcaauguaugccgaugacacugcuggcugggacaccaggauuacagaggaugacuuacacaacgaggaaaagaucacucagcagauggaucccgagcaucgccagcuggccaaugcaauuuuuaaauugaccuaccaaaacaagguugugaaaguccagcguccaacgcccaaggguacagugauggacaucauaucacggaaggaucagagagggagcggacaggugggcaccuauggccucaauacuuucacaaacauggaagcucaacuggucaggcagauggagggggaaggaguucuaucgaaaguggaccuugagaauccucaccugcucgagaagaaaauuacccaguggcuggaaacuaaggguguagagcgcuugcgacggauggccaucucuggcgaugacugcguggucaaaccaaucgaugacagauuugcuaacgccuuacuggcacucaacgauauggggaaggugaggaaggacauuccgcaguggcaacccaguaaaggauggcaugauuggcagcagguuccuuucuguucccaccacuuccaugaacuuauaaugaaggacggccgcaaacugguggucccaugcagaccccaggacgagcuaaucggucgggcgaggauuagccaaggggccggauggucacugaaggaaaccgcuugucucggcaaagccuacgcacagaugugguccuugauguauuuucaccgucgagaucugcgccuugcuucuaaugccaucugcagcgcagugccuguacauuggguuccaacaaguagaacgaccugguccauucacgcccaucaccaguggaugacuacagaggacaugcugaccguguggaaccgggucuggaucgaggauaaucccuggauggaagacaagacuccugugacaaccugggaggauguuccguaccucggcaagagggaagaccaauggugugggagcuuaauaggacugacgucucgcgcgacaugggcucagaacaucuugaccgccauucagcaggugagaucacugaucggugaugaggaguuccucgacuauaugccaaguaugaaacgguuuaggaaggaagaggaauccgagggcgcaauuugguga

SEQ ID NO: 15389 - RNA, 9873 nt, Artificial Sequence
  derived and/or modified CDS sequence (opt3) from DENV-3__FJ744737__SS-prME
accagccugugccucaugaugaugcuucccgccacacuggcuuuccacuugacuuccagggacggcgaaccuaggaugaucguggccaagaacgaacgggggaagucuuuacuguuuaagacggccucaggaauuaauauguguacccuaauagcgauggaucucggugaaaugugcgacgauacagucacuuacaaauguccacugaucgcugaaguugagccggaagacauugauugcugguguaaccuuaccaguacaugggugaccuauggcacuugcaaucaggccggggagcaucgccgagacaagcguagcguagcacuggcaccccacgugggaaugggcuuggauacaagaacccagacguggauguccgcugagggugcauggaggcaggucgaaaaaguggagacuugggcccuccggcauccuggguucaccauccuggcucuguuucucgcccacuacauuggaacaucuuuaacucagaagguugugaucuucauacugcuuauguuggucaccccaucgaugacaaugcgcugugugggcguaggcaacagggacuuuguugaagggcugucaggagcgaccuggguggaugucgugcuagagcaugguggcugcgugacgacuauggcaaagaauaaacccacacucgacaucgagcugcagaagaccgaagccacucagcuugcuacacugaggaaauuguguauugaggggaagaucaccaacauuacgaccgauagccggugcccuacacagggagaagccauccucccagaggaacaggaccagaauuaugucuguaaacacacuuacguugaucgcggcugggguaacgggugcggacuguucggcaagggcaguuuagugaccugcgcaaaguuucaaugucuggagcccauagaggggaaaguagugcagcacgaaaaucucaaguauacagucauuaucacugugcauaccggagaccagcaccagguugguaacgacacacaaggcgugaccgcugagauuacuccucaggccuccacggucgaagcgauccuuccagaguacgggacacugggauuggaaugcucuccgcgaaccggccuagauuucaaugagaugauccugcucacuaugaaaaacaaggccuggauggugcauagacagugguuuuucgaccugccccuuccuuggaccagcggugcaacaaccgagacuccaacauggaauaggaaagaacuguugguaacguuuaagaacgcucacgccaaaaagcaagagguugugguccucgggucccaggaaggcgcuaugcacaccgcccugacuggagcaacagagauucaaaauucaggcgggaccaguauauucgccggacauuuaaagugucggcugaaaauggauaagcuagaacucaaagguaugagcuaugcuaugugccugaacacauuugugcuuaagaaagaggucucugagacucagcacggcaccaucuugauuaagguggaauacaagggggaggacgcgcccuguaaaaucccuuucuccacggaagauggacaaggcaaggcacauaacggucgucugauaaccgccaauccaguugugaccaagaaggaggagcccguaaacauugaagcugagccgccuuucggggaaucaaauaucgucaucggcauuggagacaaagcccucaagaucaacugguacaagaaaggcagcaguauugggaagauguuugaggcaacugcccgcggagcuagaaggauggccauacugggugauaccgcaugggacuucggcucuguaggcgggguucuuaauucccuggggaaaauggugcaccagaucuuugguagcgcguauacagcuuuguucucgggggucucuuggauuaugaagaucggcaucggagugcuccugacuuggauuggcuuaaacuccaaaaauaccucaaugaguuuuagcugcauaguaaucgggauuaucacgcuguaccuaggagccgugguucaggcagauaugggcugugucauuaacuggaaggguaaggaacucaaaugcggguccggaaucuucgugacaaaugaggugcauaccuggacugagcaguauaaguuucaagccgacucucccaaacggcuggcuacagccauagcaggcgcuugggaaaacggugucuguggcauccgaagcaccacucgcauggagaaucuuuuguggaagcagauugccaacgaacugaauuacauccucugggagaacaauauuaaacugaccguuguggugggggauaucauaggaguauuagaacagggcaagagaacacugacgccacagccuauggagcuuaaauauucauggaagaccugggggaaggcgaaaauugucacugccgagacacaaaacaguuccuucaucauugacggacccaacaccccagaaugccccagcgcuucuagggcauggaaugugugggagguugaagacuacggcuuugguguguucacaacuaacaucugguugaagcuccgggaggucuauacccagucaugugaucaccgccugaugagugccgcuauaaaagacgaaagagccgugcacgcagauaugggguacuggaucgagagccagaagaauggauccuggaaacuagagaaggcgucuuuuauugaaguuaagacgugcacauggccuaaaucgcauacccuguggagcaacggcgugcucgaguccgacaugaucauuccaaagucacuggccgguccgaucagucagcacaaucauaggcccggcuaccacacucaaaccgcugggccuuggcaccuuggaaaauuggaacuggauuucaacuauugcgagggcacaacuguagucauaaccgagaauugugggacacguggaccaucuuuacggacgaccacugugagcggcaagcucauucaugaauggugcugucgauccugcacacugcccccucuuagauacaugggugaggacggguguugguauggaauggaaaucaggccaaucaacgagaaagaagagaauauggugaagucacuggucagcgccggcucugguaagauggauaacuuuaccaugggcauuuugugccucgcaauccuguucgaggaaguuaugcgcgggaaauucggaaagaaacacaugauugcuggcgugcuauuuacuuucguacugcuccuguccgggcagauaacauggcgggacauggcccauacccuuaucaugauuggaaguaaugcaagcgauagaaugggcaugggugugacguacuuggcccugaucgcuacuuuuaagauucagcccuucuuagcgcucggguuuuuccugaggaaacuuaccucucgcgagaaccugcuacucggagucggccuggccauggcaacaaccuugcaacugccggaagacaucgagcagauggcuaauggcauagccuuagggcucaugacucugaaacuuaucacacaguuugaaaccuaucagcuguggacagccuuggugucccucacuuguucaaacaccauuuucacgcugacaguugcuuggcgaaccgcaacucuaauccuggccggagugagucuucucccucugugccaaagcucguccaugcggaagaccgauugguugccaaugacagucgcggcuaugggugugcccccucugcccuuauuuauuuucucucucaaagacacuccaaagcguagaagcuggccucugaaugagggcguuauggccguggggcuugucucaauccuggcaaguuccuugcucaggaacgauguacccauggccggaccacugguggcuggcggucuacugauagcauguuacguuauuaccgggacgucugccgaccuuacaguggagaaagcggcugacgucaccugggaagaggaagccgagcagacuggagugagccacaaccucaugaucacaguagaugacgauggcaccaugcgcaucaaggacgaugaaacugagaauauucugacaguguuguuaaaaaccgcacugcucauagucuccggcaucuuuccguauucaauuccugccacgcugcuuguuuggcauacuuggcagaagcagacccaacggagcggggugcugugggacgugcccaguccacccgagacacagaaagcugaauuggaggaaggagucuacagaaucaagcagcaggguauuuucggcaagacccaaguggggguuggaguacagaaagagggcguguuucacacaauguggcacgucacuaggggugccgugcuaacccauaacgggaagcgacuggagccuaauugggcaucuguuaaaaaggaucucaucuccuacggaggcggcuggcgccugagcgcucaguggcaaaaaggggaagaggugcaggucauagccguggaaccaggaaagaaccccaagaauuuccagacgaugccugguaucuuccagacaacuaccggcgagauuggggcgaucgcccuugacuuuaaaccgggaacaucgggcucaccaauuaucaaccgggaagguaagguagucggguuauauggaaauggcgugguuaccaaaaacggcggguacgugucuggaauagcacaaacuaaugcugagcccgaugguccuaccccagagcuggaagaggaaauguucaagaaaagaaaccucacaauuauggacuugcaccccggcagugggaagacgaggaaguaucugccugccaucguccgugaggcuaucaaacgccggcucagaacucugauucuugcaccgaccagggugguugccgccgaaauggaggaggcucugaagggauugcccauccgauaccagacaaccgcgauaaaauccgaacauacuggccgggagauuguggaucuaaugugccacgcaacauuuaccaugcgccugcucagcccagucagagugccuaauuauaacuuaaucauuauggacgaagcccauuucacggaucccgcuucuaucgccgcaagggguuacauaagcacucggguagggaugggagaggccgcugcgauuuuuaugacagccaccccaccuggcaccgcagaggcuuucccccaguccaaugccccaauccaggacgaggagcgagacaucccggaaagaucauggaacaguggcaaugaguggauuacugauuuuguggggaagacaguuugguucgucccuagcaucaaagcaggaaacgacauugccaacugucugcgcaagaaugguaagaaagugauacaacuuucuaggaagaccuuugauacagaauaucagaaaacucgucugaacgacugggauuucguggucacgaccgacaucuccgagaugggcgcuaauuuuaaggccgaucggguaauugaccccagaaggugccucaaaccagugaucuugacagaugggcccgagcgcguuauccuggcgggaccuaugccagugacugcagccucagcugcccagcgaagaggccgggucgguaggaacccccagaaggaaaaugaccaauacauuuucaccgggcagccucucaacaaugaugaggaccacgcucacuggacagaagcaaagaugcugcuugacaacauaaauaccccggagggcaucauuccagcccuauucgaacccgagcgcgagaaaagugcugccaucgauggagaauaccgucugaagggcgagagcagaaaaacuuuuguggaauugaugcggagaggggacuuaccuguuuggcuggcacauaagguggcguccgagggaauuaaauauacggaucgcaaguggugcuucgacggugaacgaaacaaucagauccucgaggagaacauggaugucgaaauauggaccaaagagggcgaaagaaagaagcugcggcccagguggcuugacgcccgcacauacucugauccacuggcucucaaagaguuuaaggacuucgccgcagggagaaaaucgaucgcuuuggaucuggugacugaaauuggaaggguaccuagccaccuagcccaucggacccguaaugcacuggacaaccucgugaugcuucacacaucagagcacggcggucgcgccuaucgacaugcuguugaggaacugcccgagaccauggaaacuuuauugcugcucgggcugaugauccuucugacaggcggagcgaugcucuuuuugauuuccggcaaggggaucggaaaaacgaguauaggucugauuugugucaucgugucuagcggcauguuauggauggccgaugugccacuacaguggauugcauccgcuaucguccuggaguucuuuaugaugguucuccuuauaccugagccggaaaagcaaagaacaccccaggacaaucagcuggccuacgugguaaucgggauuuugacucuggccgcaaucgugacagcuaacgagaugggacuccuggaaaccaccaagagggaucuuggcaugucaaaagagccaggugucgugucuccuacaagcuaucucgacguugaccugcaccccgccagugcguggacuuuguacgcuguggccacgaccgucauuacaccaaugcugcggcauacuaucgaaaauuccaccgcaaacgugagcuuagccgcuauagcaaaccaagccgugguucuaauggggcuggauaagggcuggccuauuucuaaaauggaccucggagugccccuucuggcguugggcugcuauucacaggucaauccgcugacacucaccgcugccgugcugcuuuuagucacucacuacgcaaucaucgggccaggacugcaggccaaggcuacgcgcgaggcccagaaaagaacagcagcuggcauuaugaagaacccuaccguggaugguaucaugacuauagaccucgaucccguuauuuacgacuccaaguucgagaaacaauugggacaggugaugcugcuaguacugugugccgugcagcuccuucugaugaggaccaguugggcguugugcgaagcccugacacucgcaacuggaccaaucaccacacugugggagggcagccccgguaaguuuuggaauacgaccauugcugucucgauggccaacaucuuccggggcucuuauuuagcaggggcuggacuugccuuuuccauaaugaaaagcguuggcacugggaagcgaggaacaggcucacagggugaaacccugggggagaaauggaagaagaaacucaaucaacuaaguagaaaggaguucgaucuguacaaaaagucuggaaucacugagguggaccgcacagaggccaaagaaggcuugaagaggggugagaccacgcaucacgcggucucccggggcagcgcuaaacugcagugguuuguggaacguaacaugguaauuccugaggggagagugaucgaucucggauguggcagagggggauggucauauuacugcgcaggccuuaagaagguuaccgaagugcgcgguuauacaaaagggggaccgggccacgaggagcccgucccaaugaguacuuacggcuggaauauugugaagcugaugagcgggaaagacgucuucuauuugccucccgaaaagugugauacccugcucugcgacaucggagaguccucuccuagcccaacaguggaagagucccggacuauucgaguuuuaaaaaugguagagcccuggcugaagaacaaucaguucuguaucaaggugcuuaacccuuacaugccaaccgucauagaacaucuggagagacuacagaggaaacacgguggcaugcucgugcgcaauccccugucacggaacucuacacaugaaauguacuggauuaguaaugggaccggaaacaucguuucgagcgugaauauggucuccagauugcugcucaaccguuuuacuaugacgcacaggcggccgacaaucgagaaggauguggaccuuggcgccgguacccgccacguaaacgcugaaccugagacuccaaauauggacgugauuggggagcgaauaaaaagaaucaaggaagaacacucuucaaccuggcacuaugaugacgaaaaccccuacaaaacaugggccuaucauggaagcuacgagguuaaggcaacgggcuccgccaguucuaugauuaauggcgucgugaagcuguuaaccaaaccuugggauguggucccaaugguuacucaaauggcuaugacagacaccacucccuucgggcagcagaggguguuuaaggaaaaaguagauacacggaccccgcgcccuaugcccggaacaagaaaggugauggagaucacugcggaguggcuguggaggaccuugggucgaaacaaacggccacgucucugcacgagagaagaguucaccaagaagguccgcacaaaugccgcaaugggcgcuguguuuacugaagagaaccaaugggacagcgccagggcagccguugaagaugaggaguucuggaaacugguggaccgggaaagagagcuacacaaacuugggaaauguggaucaugcgucuauaauaugaugggcaagcgcgagaagaagcugggugaguuugggaaagcuaagggauccagggccauuugguacauguggcucggcgcgcgauaucuggaguucgaagcauugggcuuucugaacgaggaucauugguucagucgggaaaauagcuacucugggguggagggagaaggucuccacaaacuuggcuacauccugagagacauauccaaaaucccugggggagccauguaugcugaugacaccgccggcugggacacaaggauuacugaggaugacuuacacaacgaggaaaagaucacccagcagauggaucccgagcaucgccagcuggcaaaugcuauuuuuaaauugacguaccaaaacaagguaguuaaagugcagcguccaacacccaaggguaccgucauggacaucauaucacggaaggaucagagagggagcggacaggugggcacuuauggccucaauacauucaccaacauggaagcccaacuggugaggcagauggagggggaaggaguccuaucgaaaguugaccuugagaauccucaucugcucgagaagaaaauuacucaguggcuggaaaccaaggguguggagcgcuugcgacggauggcuaucucuggcgaugacugcguagugaaaccaaucgaugacagauuugccaacgcauuacuggcgcucaacgauauggggaaggucaggaaggacauuccgcaguggcaacccaguaaaggauggcaugauuggcaacaggugccuuucuguucccaccacuuccaugaacuuauaaugaaggacggccgcaaacugguugugccaugcagaccccaggacgagcuaaucggucgggccaggauuagccaaggggcuggauggucacugaaggaaacagccugucucggcaaagcauacgcucagaugugguccuugauguauuuucaccgucgagaucugcgccuugccucuaaugcaaucugcagcgccgucccugugcauuggguaccaacgaguagaaccacuugguccauucacgcgcaucaccaguggaugacaaccgaggacaugcugacuguuuggaaccggguguggaucgaggauaaucccuggauggaagacaagacaccugucaccacgugggaggaugugccguaccucggcaagagggaagaccaauggugugggagcuuaauaggacugacaucucgcgcuaccugggcccagaacaucuugacugcaauucagcagguuagaucacugaucggugaugaggaguuccucgacuauaugccaaguaugaaacgguuuaggaaggaagaggaauccgagggcgccauuugguga

SEQ ID NO: 15390 - RNA, 9873 nt, Artificial Sequence
  derived and/or modified CDS sequence (opt3) from DENV-3__FJ744739__SS-prME
accagccugugccucaugaugaugcuucccgcaacacuggcuuuccacuugacuuccagggacggcgaaccuaggaugaucguggcaaagaacgaacgggggaaaucuuuacuguuuaagacggucucaggaauuaauauguguacccuaauagccauggaucucggugagaugugcgacgauacaguuacuuacaaauguccacugaucgcggaaguggagccggaagacauugauugcugguguaaccuuaccaguacaugggugaccuauggcacuugcaaucaggcuggggagcaucgccgagacaagcguagcguggcccuggcaccccacgucggaaugggcuuggauacaaggacccagacguggauguccgccgagggugcuuggagacagguggaaaaaguugagacuugggcacuccggcauccuggguucaccauccuggcccuguuucucgcucacuacauuggaacaucuuuaacucagaagguggucaucuucauacugcuuauguuggugaccccaucgaugacaaugcgcuguguaggcguuggcaacagggacuuuguggaagggcugucaggagccaccugggucgauguggugcuagagcaugguggcugcgucacgacuauggcgaagaauaaacccacacucgacaucgagcugcagaagaccgaagcaacucagcuugccacacugaggaaauuguguauugaggggaagaucaccaacauuacgaccgauagccggugcccuacacagggagaagcuauccucccagaggaacaggaccagaauuauguuuguaaacacacuuacguggaucgcggcugggguaacgggugcggacuguucggcaagggcaguuuaguaaccugcgccaaguuucaaugucuggagcccauagaggggaaagugguccagcacgaaaaucucaaguauacagugauuaucacuguucauaccggagaccagcaccagguggguaacgacacacaaggcgucaccguggagauuacuccucaggcauccacgguagaagcuauccuuccagaguacgggacacugggauuggaaugcucuccgcgaaccggccuagauuucaaugagaugauccugcucacuaugaaaaacaaggccuggaugguucauagacagugguuuuucgaccugccccuuccuuggaccagcggugcgacaaccgagacuccaacauggaauaggaaagaacuguuggugacguuuaagaacgcccacgccaagaaacaagaggucgugguccucgggucccaggaaggcgcuaugcacaccgcccugacuggagcuacagagauucaaaauucaggcgggaccaguauauucgccggacauuuaaagugucggcugaaaauggauaagcuagaacucaaagguaugagcuaugcaaugugccugaacacauuugugcuuaagaaagagguuucugagacucagcacggcaccaucuugauuaagguggaauacaagggggaggacgcccccuguaaaaucccuuucuccacggaagauggacaaggcaaggcucauaacggucgucugauaaccgcgaauccaguagucaccaagaaggaggagcccgugaacauugaagcagagccgccuuucggggaaucaaauaucguuaucggcauuggagacaaagcccucaagaucaacugguacaagaaaggcagcaguauugggaagauguuugaggcuacugcccgcggagcaagaaggauggccauacugggugauaccgcuugggacuucggcucuguaggcgggguccuuaauucccuggggaaaauggugcaccagaucuuugguagcgccuauacagcauuguucucggggguaucuuggauuaugaagaucggcaucggagugcuccugacuuggauuggcuuaaacuccaaaaauaccucaaugaguuuuagcugcauaguuaucgggauuaucacgcuguaccuaggagcggucgugcaggcugauaugggcugugugauuaacuggaaggguaaggaacucaaaugcggguccggaaucuucgucacaaaugagguucauaccuggacugagcaguauaaguuucaagccgacucucccaaacggcuggcaacagccauagcuggcgccugggaaaacgguguguguggcauccgaagcaccacucgcauggagaaucuuuuguggaagcagauugcaaacgaacugaauuacauccucugggagaacaauauuaaacugaccgugguagucggggauaucauaggaguguuagaacagggcaagagaacacugacgccacagccuauggagcuuaaauauucauggaagaccugggggaaggcuaaaauuguuacugccgagacacaaaacaguuccuucaucauugacggacccaacaccccagaaugccccagcgcgucuagggccuggaaugugugggaggucgaagacuacggcuuugguguguucacaacuaacaucugguugaagcuccgggagguuuauacccagucaugugaucaccgccugaugagugcugcaauaaaagacgaaagagccgugcacgcugauaugggguacuggaucgagagccagaagaauggauccuggaaacuagagaaggccucuuuuauugaaguaaagacgugcacauggccuaaaucgcauacccuguggagcaacggcguccucgaguccgacaugaucauuccaaagucacuggcagguccgaucagucagcacaaucauaggcccggcuaccacacucaaaccgcggggccuuggcaccuuggaaaauuggaacuggauuucaacuauugcgagggcacaacuguggugauaaccgagaauugugggacacguggaccaucuuuacggacgaccacugucagcggcaagcucauucaugaauggugcugucgauccugcacacugcccccucuuagauacaugggugaggacggguguugguauggaauggaaaucaggccaaucaacgagaaagaagagaauaugguuaagucacuggugagcgccggcucugguaagauggauaacuuuaccaugggcauuuugugccucgcuauccuguucgaggaaguaaugcgcgggaaauucggaaagaaacacaugauugccggcgugcuauuuacuuucguccugcuccuguccgggcagauaacauggcgggacauggcacauacccuuaucaugauuggaaguaaugcuagcgauagaaugggcaugggugugacguacuuggcccugaucgcaacuuuuaagauucagcccuucuuagcccucggguuuuuccugaggaaacuuaccucucgcgagaaccugcuacucggaguuggccuggcuauggcgacaaccuugcaacugccggaagacaucgagcagauggccaauggcauagcauuagggcucaugacucugaaacuuaucacacaguuugaaaccuaucagcuguggacagcuuuggugucccucacuuguucaaacaccauuuucacgcugacagucgccuggcgaaccgccacucuaauccuggcuggagugagucuucucccucugugccaaagcucguccaugcggaagaccgauugguugccaaugacaguugcagccaugggugugcccccucugcccuuauuuauuuucucucucaaagacacuccaaagcguagaagcuggccucugaaugagggcgucauggcgguagggcuugugucaauccuggcuaguuccuugcucaggaacgauguucccauggccggaccacugguggcaggcggucuacugauagccuguuacgucauuaccgggacgucugcugaccuuacaguggagaaagcagccgacguaaccugggaagaggaagcggagcagacuggagugagccacaaccucaugaucacagucgaugacgauggcaccaugcgcaucaaggacgaugaaacugagaauauucugacaguuuuguuaaaaaccgcucugcucauaguguccggcaucuuuccguauucaauuccugccacgcugcuuguguggcauacuuggcagaagcagacccaacggagcgggguccugugggacgugcccaguccacccgagacacagaaagcagaauuggaggaaggaguuuacagaaucaagcagcaggguauuuucggcaagacccaaguaggggugggaguccagaaagagggcguguuucacacaauguggcacguuacuaggggugccgugcuaacccauaacgggaagcgacuggagccuaauugggcuucugucaaaaaggaucucaucuccuacggaggcggcuggcgccugagcgcccaguggcaaaaaggggaagaggugcagguaauagcagucgaaccaggaaagaaccccaagaauuuccagacgaugccugguaucuuccagacaacuaccggcgagauuggggcuaucgcccuugacuuuaaaccgggaacaucgggcucaccaauuaucaaccgggaagguaaggugguuggguuauauggaaauggcguggucaccaaaaacggcggguacgugucuggaauagcgcaaacuaaugccgagcccgaugguccuaccccagagcuggaagaggaaauguucaagaaaagaaaccucacaauuauggacuugcaccccggcagugggaagacgaggaaguaucugccugcaaucguucgugaggcuaucaaacgccggcucagaacucugauucuugccccgaccaggguggucgcugcagaaauggaggaggcccugaagggauugcccauccgauaccagacaaccgccauaaaauccgaacauacuggccgggagauuguggaucuaaugugccacgcuacauuuaccaugcgccugcucagcccaguaagagugccuaauuauaacuuaaucauuauggacgaagcgcauuucacggaucccgcaucuaucgccgcuagggguuacauaagcacucggguugggaugggagaggccgcagccauuuuuaugacagcuaccccaccuggcaccgcggaagccuucccccaguccaaugcaccaauccaggacgaggagcgagacaucccggaaagaucauggaacaguggcaaugaguggauuacugauuuugucgggaagacagugugguucgugccuagcaucaaagcuggaaacgacauugccaacugucugcgcaagaaugguaagaaagucauacaacuuucuaggaagaccuuugauacagaauaucagaaaacucgucugaacgacugggauuucguagugacgaccgacaucuccgagaugggcgcaaauuuuaaggccgaucggguuauugaccccagaaggugccucaaaccagugaucuugacagaugggcccgagcgcgucauccuggcuggaccuaugccagugacugccgcgucagcagcccagcgaagaggccggguugguaggaacccccagaaggaaaaugaccaauacauuuucaccgggcagccucucaacaaugaugaggaccacgcucacuggacagaagccaagaugcugcuugacaacauaaauaccccggagggcaucauuccagcucuauucgaacccgagcgcgagaaaagugcagccaucgauggagaauaccgucugaagggcgagagcagaaaaacuuuuguggaauugaugcggagaggggacuuaccugucuggcuggcucauaagguggccuccgagggaauuaaauauacggaucgcaaguggugcuucgacggugaacgaaacaaucagauccucgaggagaacauggauguagaaauauggaccaaagagggcgaaagaaagaagcugcggcccagguggcuugacgcacgcacauacucugauccacuggcgcucaaagaguuuaaggacuucgccgcugggagaaaaucgaucgccuuggaucuggugacugaaauuggaaggguuccuagccaccuagcacaucggacccguaaugcucuggacaaccucgucaugcuucacacaucagagcacggcggucgcgccuaucgacaugcaguggaggaacugcccgagaccauggaaacuuuauugcugcucgggcugaugauccuucugacaggcggagccaugcucuuuuugauuuccggcaaggggaucggaaaaacgaguauaggucugauuugugugaucgucucuagcggcauguuauggauggcugauguuccacuacaguggauugcguccgccaucgugcuggaguucuuuaugaugguacuccuuauaccugagccggaaaagcaaagaacaccccaggacaaucagcuggcauacguggucaucgggauuuugacucuggcugccaucgugacagccaacgagaugggacuccuggaaaccaccaagagggaucuuggcaugucaaaagagccagguguugugucuccuacaagcuaucucgacgucgaccugcaccccgcaagugcuuggacuuuguacgccguagcgacgaccgugauuacaccaaugcugcggcauacuaucgaaaauuccaccgcuaacguuagcuuagccgcaauagccaaccaagcugugguccuaauggggcuggauaagggcuggccuauuucuaaaauggaccucggagugccccuucuggcauugggcugcuauucacaggucaauccgcugacacucaccgccgcggugcugcuuuuaguuacucacuacgcuaucaucgggccaggacugcaggccaaggcaacgcgcgaggcccagaaaagaacagcugccggcauuaugaagaacccuaccguggaugguaucaugacuauagaccucgaucccguaauuuacgacuccaaguucgagaaacaauugggacaggugaugcugcuaguccugugugcaguucagcuccuucugaugaggaccaguugggcuuugugcgaagcccugacacucgcgacuggaccaaucaccacacugugggagggcagccccgguaaguuuuggaauacgaccauugccgugucgauggcaaacaucuuccggggcucuuauuuagcuggggccggacuugcauuuuccauaaugaaaagcgucggcacugggaagcgaggaacaggcucacagggugaaacccugggggagaaauggaagaagaaacucaaucaacuaaguagaaaggaguucgaucuguacaaaaagucuggaaucacugagguggaccgcacagaggcuaaagaaggcuugaagaggggugagaccacgcaucacgccguaucccggggcagcgccaaacugcagugguuuguggaacguaacaugguuauuccugaggggagagugaucgaucucggauguggcagagggggauggucauauuacugcgcgggccuuaagaaggucaccgaagugcgcgguuauacaaaagggggaccgggccacgaggagcccgucccaaugaguacuuacggcuggaauauugugaagcugaugagcgggaaagacguuuucuauuugccucccgaaaagugugauacccugcucugcgacaucggagaguccucuccuagcccaacaguagaagagucccggacuauucgaguguuaaaaauggucgagcccuggcugaagaacaaucaguucuguaucaaggugcuuaacccuuacaugccaaccguuauagaacaucuggagagacuacagaggaaacacgguggcaugcucgugcgcaauccccugucacggaacucuacacaugaaauguacuggauuaguaaugggaccggaaacaucgucucgagcgugaauaugguauccagauugcugcucaaccguuuuacuaugacgcacaggcggccgacaaucgagaaggauguggaccuuggcgcugguacccgccacguuaacgcagaaccugagacuccaaauauggacgucauuggggagcgaauaaaaagaaucaaggaagaacacucuucaaccuggcacuaugaugacgaaaaccccuacaaaacaugggccuaucauggaagcuacgaggugaaggcuacgggcuccgccaguucuaugauuaauggcguggucaagcuguuaaccaaaccuugggauguugugccaaugguaacucaaauggcaaugacagacaccacucccuucgggcagcagaggguguuuaaggaaaaagucgauacacggaccccgcgcccuaugcccggaacaagaaaggugauggagaucacugccgaguggcuguggaggaccuugggucgaaacaaacggccacgucucugcacgagagaagaguucaccaagaagguucgcacaaaugcugcgaugggcgccguguuuacugaagagaaccaaugggacagcgcaagggcugccgucgaagaugaggaguucuggaaacugguggaccgggaaagagagcuacacaaacuugggaaauguggaucaugcguauauaauaugaugggcaagcgcgagaagaagcugggugaguuugggaaagcaaagggauccagggccauuugguacauguggcucggcgcucgauaucuggaguucgaagccuugggcuuucugaacgaggaucauugguucagucgggaaaauagcuacucugggguugagggagaaggucuccacaaacuuggcuacauccugagagacauauccaaaaucccugggggagcgauguaugcagaugacaccgccggcugggacacaaggauuacugaggaugacuuacacaacgaggaaaagaucacccagcagauggaucccgagcaucgccagcuggcuaaugccauuuuuaaauugacguaccaaaacaagguggucaaagugcagcguccaacacccaaggguaccgugauggacaucauaucacggaaggaucagagagggagcggacaggucggcacuuauggccucaauacauucaccaacauggaagcacaacugguuaggcagauggagggggaaggagugcuaucgaaaguagaccuugagaauccucaucugcucgagaagaaaauuacucaguggcuggaaaccaaggguguggagcgcuugcgacggauggcuaucucuggcgaugacugcgucgugaaaccaaucgaugacagauuugccaacgcuuuacuggcccucaacgauauggggaagguuaggaaggacauuccgcaguggcaacccaguaaaggauggcaugauuggcaacaggugccuuucuguucccaccacuuccaugaacuuauaaugaaggacggccgcaaacuggucgugccaugcagaccccaggacgagcuaaucggucgggcaaggauuagccaaggggcgggauggucacugaaggaaacagccugucucggcaaggcuuacgcccagaugugguccuugauguauuuucaccgucgagaucugcgccuugcaucuaaugcuaucugcagcgccguaccuguucauugggugccaacgaguagaaccacuugguccauucacgcacaucaccaguggaugacaaccgaggacaugcugacugucuggaaccggguguggaucgaggauaaucccuggauggaagacaagacaccuguuaccacgugggaggaugugccguaccucggcaagagggaagaccaauggugugggagcuucauaggauuaacaucucgcgccaccugggcgcagaacauccugacugcuauucagcaggucagaucauugaucggugaugaggaguuucuggacuauaugccaaguaugaaacgguucaggaaggaagaggaauccgagggcgccauuugguga

SEQ ID NO: 15391 - RNA, 9873 nt, Artificial Sequence
  derived and/or modified CDS sequence (opt3) from DENV-3__FJ744740__SS-prME
accagccugugccucaugaugaugcuucccgccacacuggcuuuccacuugacuuccagagacggcgagccuaggaugaucguggcaaagaacgaacgggggaaaucuuuacuguuuaagacggccucaggaauuaauauguguacccuaauagcgauggaucucggugagaugugcgacgauacagucacuuacaaauguccacugaucgcugaaguugagccggaagacauugauugcugguguaaccuuaccaguacaugggugaccuauggcacuugcaaucaggccggggagcaucgccgagacaagcguagcguagcacuggccccccacgugggaaugggcuuggauacaagaacccaaacguggauguccgcugagggugcauggaggcaggucgaaaaaguggagacuugggcccuccggcauccuggguucaccauccuggcucuguuucucgcccacuacauuggaacaucuuuaacucagaagguugugaucuucauacugcuuauguuggucaccccaucgaugacaaugcgcugugugggcguaggcaacagagacuuuguugaagggcugucaggagcgaccuggguggaugucgugcuagagcaugguggcugcgugacgacuaucgcaaagaauaaacccacacucgacauugagcugcagaagaccgaagccacucaacuugcuacacugaggaaauuguguaucgaggggaagauuaccaacaucacgaccgauagccggugcccuacacagggagaagccauacucccagaggaacaggaccagaauuaugucuguaaacacacuuacguugaucgcggcugggguaacgggugcggacuguucggcaagggcaguuuagugaccugcgcaaaguuucaaugucuggagcccauugaggggaaaguagugcagcacgaaaaucucaaguauacagucaucauuacugugcauaccggagaccagcaccagguugguaacgacacacaaggcgugaccgucgagaucacuccucaggcuuccacgguggaagccauccuuccagaguacgggacacugggauuggaaugcucuccgcgaaccggccuagauuucaaugagaugauucugcucacuaugaaaaacaaggcguggaugguacauagacagugguuuuucgaccugccccuuccuuggaccagcggugccacaaccgagacuccaacauggaauaggaaagaacuguugguuacguuuaagaacgcacacgcuaaaaagcaagagguggucgugcucgggucccaggaaggcgccaugcacaccgcucugacuggagccacagagauacagaauucaggcgggaccaguaucuucgcaggacauuuaaagugucggcugaaaauggauaagcuagaacucaaagguaugagcuaugccaugugccugaacacauuuguccuuaagaaagaggugucugagacucagcacggcaccauuuugaucaagguugaauacaagggggaggacgcucccuguaaaauaccuuucuccacggaagauggacaaggcaaggcgcauaacggucgucugauuaccgcaaauccagugguaacaaaaaaggaggagcccgucaacaucgaagccgagccgccuuucggggaaucaaauaucgugauuggcguuggagacaaagcucucaagaucaacugguacaagaaaggcagcaguauugggaagauguuugaggccacugcacgcggagccagaaggauggcuauacugggugauaccgccugggacuucggcucuguggggggaguccuuaauucccugggcaaaauggugcaccagaucuuugguagcgcauauacagcguuguucucggggguaucuuggauuaugaagaucggcaucggagugcuccugacuuggauuggcuuaaacuccaaaaauaccucaaugaguuuuagcugcauaguuaucgggauuaucacgcuguaccuaggagcugucgugcaggccgauaugggcugugugauuaacuggaaggguaaggaacucaaaugcggguccggaaucuucgucacaaaugagguucauaccuggacugagcaguauaaguuucaagcagacucucccaaacggcuggccacagcuauagccggcgcaugggaaaacgguguguguggcauccgaagcaccacucgcauggagaaucuuuuguggaagcagauugcuaacgaacugaauuacauccucugggagaacaauauuaaacugaccgugguagucggggauaucauaggaguguuagaacagggcaagagaacacugacgccacagccuauggagcuuaaauauucauggaagaccugggggaaggccaaaauuguuacugcggagacacaaaacaguuccuucaucauugacggacccaacaccccagaaugccccagcgccucuagggcuuggaaugugugggaggucgaagacuacggcuuugguguguucacaacuaacaucugguugaagcuccgggagguuuauacccagucaugugaucaccgccugaugagugcagccauaaaagacgaaagagcugugcacgccgauaugggguacuggaucgagagccagaagaauggauccuggaaacuagagaaggcaucuuuuauugaaguaaagacgugcacauggccuaaaucgcauacccuguggagcaacggcguccucgaguccgacaugaucauuccaaagucacuggcggguccgaucagucagcacaaucauaggcccggcuaccacacucaaaccgccgggccuuggcaccuuggaaaauuggaacuggauuucaacuauugcgagggcacaacuguggugauaaccgagaauugugggacacguggaccaucuuuacggacgaccacugucagcggcaagcucauucaugaauggugcugucgauccugcacacugcccccucuuagauacaugggugaggacggguguugguauggaauggaaaucaggccaaucaacgagaaagaagagaauaugguuaagucacuggugagcgcuggcucugguaagguagauaacuuuaccaugggcauuuugugccucgccauccuguucgaggaagugaugcgcgggaaauucggaaagaaacacaugauugcaggcguccuauuuacuuucgugcugcuccuguccgggcagauaacauggcgggacauggcucauacccuuaucaugauuggaaguaaugccagcgauagaaugggcauggguguuacguacuuggcacugaucgccacuuuuaagauucagcccuucuuagcucucggguuuuuccugaggaaacuuaccucucgcgagaaccugcuacucggagugggccuggcgauggccacaaccuugcaacugccggaagacaucgagcagauggcaaauggcauagcuuuagggcucaugacucugaagcuuaucacacaguuugaaaccuaucagcuguggacagccuuggucucccucacuuguucaaacaccauuuucacgcugacaguggccuggcgaaccgcuacucuaauccuggcaggaguuagucuucucccucugugccaaagcucguccaugcggaagaccgauugguugccaaugacaguggccgcgauggguguccccccucugcccuuauuuauuuucucucucaaagacacuccaaagcguagaagcuggccucugaaugagggcguaauggcuguggggcuuguuucaauccuggccaguuccuugcucaggaacgaugugcccauggcaggaccacuggucgccggcggucuacugauagcuuguuacgugauuaccgggacgucugcagaccuuacaguagagaaagccgcggacgugaccugggaagaggaagcugagcagacuggagucagccacaaccucaugaucacaguugaugacgauggcaccaugcgcaucaaggacgaugaaacugagaauauucugacaguguuguuaaaaaccgcccugcucauaguguccggcaucuuuccguauucaauuccugcaacgcugcuugucuggcauacuuggcagaagcagacccaacggagcggggugcugugggacguucccaguccacccgagacacagaaagccgaauuggaggaaggaguauacagaaucaagcagcaggguauuuucggcaagacccaagugggggucggagugcagaaagagggcguuuuucacacaauguggcacgugacuaggggugcuguccuaacccauaacgggaagcgacuggagccuaauugggccucugugaaaaaggaucucaucuccuacggaggcggcuggcgccugagcgcacaguggcaaaaaggggaagagguacaggucauagcuguggaaccaggaaagaaccccaagaauuuccagacgaugccugguaucuuccagacaacuaccggcgagauuggggccaucgcgcuugacuuuaaaccgggaacaucgggcucaccaauuaucaaccgggaagguaagguugugggguuauauggaaauggcgucgugaccaaaaacggcggguacguuucuggaauagcccaaacuaaugcagagcccgaugguccuaccccagagcuggaagaggaaauguucaagaaaagaaaccucacaauuauggacuugcaccccggcagugggaagacgaggaaguaucugccugcuaucgugcgugaggccaucaaacgccggcucagaacucugauucuugcuccgaccagggucguggcagccgaaauggaggaggcccugaagggauugcccauccgauaccagacaaccgcuauaaaauccgaacauacuggccgggagauuguagaucuaaugugccacgcgacauuuaccaugcgccugcucagcccagugagaguuccuaauuauaacuuaaucauuauggacgaagcacauuucacggaucccgccucuaucgcugccagggguuacauaagcacucgggucgggaugggagaggcagccgcuauuuuuaugacagcgaccccaccuggcaccgccgaagcauucccccaguccaaugcuccaauccaggacgaggagcgagacaucccggaaagaucauggaacaguggcaaugaguggauuacugauuuuguggggaagacagugugguucgucccuagcaucaaagccggaaacgacauugcaaacugucugcgcaagaaugguaagaaaguaauacaacuuucuaggaagaccuuugauacagaauaucagaaaacucgucugaacgacugggauuucgugguuacgaccgacaucuccgagaugggcgccaauuuuaaggcugaucgggugauugaccccagaaggugccucaaaccagucaucuugacagaugggcccgagcgcgugauccuggccggaccuaugccaguuacugcggcaucagccgcucagcgaagaggccggguggguaggaacccccagaaggaaaaugaccaauacauuuucaccgggcagccucucaacaaugaugaggaccacgcccacuggacagaagcuaagaugcugcuugacaacauaaauaccccggagggcaucauuccagcacuauucgaacccgagcgcgagaaaagugccgcuaucgauggagaauaccgucugaagggcgagagcagaaaaacuuuugucgaauugaugcggaggggggacuuaccuguguggcuggcccauaagguagcauccgagggaauuaaauauacggaucgcaaguggugcuucgacggugaacgaaacaaucagauccucgaggagaacauggauguggaaauauggaccaaagagggcgaaagaaagaagcugcggcccagguggcuugacgcgcgcacauacucugauccacuggcccucaaagaguuuaaggacuucgcugccgggagaaaaucgaucgcauuggaucugguuacugaaauuggaagggucccuagccaccuagcucaucggacccguaaugcccuggacaaccucgugaugcuucacacaucagagcacggcggucgcgcauaucgacaugccguggaggaacugcccgagaccauggaaacuuuauugcugcucgggcugaugauccuucugacaggcggagcuaugcucuuuuugauuuccggcaaggggaucggaaaaacgaguauaggucugauuugugucaucguuucuagcggcauguuauggauggcggaugugccacuacaguggauugccuccgcaaucguacuggaguucuuuaugauggugcuccuuauaccugagccggaaaagcaaagaaccccccaggacaaucagcuggcuuacgucgugaucgggauuuugacucuggccgccaucguuacagcaaacgagaugggacuccuggaaaccaccaagagggaucuuggcaugucaaaagagccagguguggucucuccuacaagcuaucucgacguagaccugcaccccgcuagugccuggacuuuguacgcgguggcuacgaccguuauuacaccaaugcugcggcauacuaucgaaaauuccaccgccaacgugagcuuagcagccauagcuaaccaagcagucgugcuaauggggcuggauaagggcuggccuauuucuaaaauggaccucggagucccccuucuggccuugggcugcuauucacaggugaauccgcugacacucaccgcggcuguucugcuuuuagugacucacuacgccaucaucgggccaggacugcaggcaaaggccacgcgcgaggcucagaaaagaacagccgcaggcauuaugaagaacccuaccguagaugguaucaugacuauagaccucgaucccgugauuuacgacuccaaguucgagaaacaauuggggcaggucaugcugcuaguucugugugcugugcagcuccuucugaugaggaccaguugggccuugugcgaagcgcugacacucgccacuggaccaaucaccacacugugggagggcagccccgguaaguuuuggaauacgaccauugcagucucgauggcuaacaucuuccggggcucuuauuuagccggggcaggacuugcuuuuuccauaaugaaaagcgugggcacugggaagcgaggaacaggcucacagggugaaacccugggggagaaauggaagaagaaacucaaucaacuaaguagaaaggaauucgaucuguacaaaaagucuggaaucacugagguagaccgcacagaggccaaagaaggcuugaagaggggugagaccacgcaucacgccgugucccggggcagcgcgaaacugcagugguuuguugaacguaacauggugauuccugaggggagagucaucgaucucggauguggcagggggggauggucauauuacugcgcuggccuuaagaaggugaccgaaguccgcgguuauacaaaagggggaccgggccacgaggagcccgugccaaugaguacuuacggcuggaauauuguuaagcugaugagcgggaaagacguauucuauuugccucccgaaaagugugauacccugcucugcgacaucggagaguccucuccuagcccaacaguggaagagucccggacuauucgagucuuaaaaaugguggagcccuggcugaagaacaaucaguucuguaucaagguucuuaacccuuacaugccaaccgugauagaacaucuggagagacuacagaggaaacacgguggcaugcucguccgcaauccccugucacggaacucuacacaugaaauguacuggauuaguaaugggaccggaaacaucgugucgagcguaaauaugguguccagauugcugcucaaccguuuuacuaugacgcacaggcggccgacaaucgagaaggauguugaccuuggcgcagguacccgccacgucaacgccgaaccugagacuccaaauauggacgugauuggggagcgaauaaaaagaaucaaggaagagcauucuucaaccuggcacuaugaugacgaaaaccccuacaaaacaugggcuuaucauggaagcuacgaggugaaggccacgggcuccgcaaguucuaugauuaauggcgucguuaagcuguuaaccaaaccuugggaugugguaccaauggugacucaaauggccaugacagacaccacucccuucgggcagcagagggucuuuaaggaaaaaguggauacacggaccccgcgcccuaugcccggaacaagaaagguuauggagaucacugcugaguggcuguggaggaccuugggucgaaacaaacggccacgucucugcacgagagaagaguucaccaagaaggugcgcacaaaugcggccaugggcgcagucuuuacugaagagaaccaaugggacagcgcuagggccgcaguggaagaugaggaguucuggaaacugguagaccgggaaagagagcuacacaagcuugggaaauguggaucaugcguuuauaauaugaugggcaagcgcgaaaaaaagcugggugaguuugggaaagccaagggauccagggcuauuugguacauguggcucggcgcccgauaucuggaguucgaagcguugggcuuucugaacgaggaucauugguucagucgggaaaauagcuacucugggguggagggagaaggucuccacaagcuuggcuacauccugagagacauauccaaaaucccugggggagcaauguaugccgaugacaccgcuggcugggacacaaggauuacugaggaugacuuacacaacgaggaaaagaucacccagcagauggaucccgagcaucgccagcuggccaaugcaauuuuuaaauugacguaccaaaacaaggucgugaaagugcagcguccaacacccaaggguaccgucauggacaucauaucacggaaggaucagagagggagcggacagguuggcacuuauggccucaauacauucaccaacauggaagcucaacuggugaggcagauggagggggaaggaguacuaucgaaaguggaccuugagaauccucaccugcucgagaagaaaauuacucaguggcuggaaaccaagggugucgagcgcuugcgacggauggccaucucuggcgaugacugcgugguuaaaccaaucgaugacagauuugcuaacgccuuacuggcacucaacgauauggggaaggugaggaaggacauuccgcaguggcaacccaguaaaggauggcaugauuggcagcaggucccuuucuguucccaccacuuccaugaacuuauaaugaaggacggccgcaaacuggugguaccaugcagaccccaggacgagcuaaucggucgggcgaggauuagccaaggggccggauggucacugaaggaaacagcuugucucggcaaagccuacgcacagaugugguccuugauguauuuucaccgucgagaucugcgccuugcuucuaaugccaucugcagcgcaguuccugugcauugggucccaacgaguagaaccacuugguccauucacgcccaucaccaguggaugacaaccgaggacaugcugacuguguggaaccggguuuggaucgaggauaaucccuggauggaagacaagacaccugugaccacgugggaggaugucccguaccucggcaagagggaagaccaauggugugggagcuuaauaggacugacaucucgcgcgaccugggcucagaacaucuugacugccauucagcaggugagaucacugaucggugaugaggaguuccucgacuauaugccaaguaugaaacgguuuaggaaggaagaggaauccgagggcgcaauuugguga

SEQ ID NO: 15392 - RNA, 9873 nt, Artificial Sequence
  derived and/or modified CDS sequence (opt3) from DENV-3__GQ868593__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacauaucgcggaaguugagccggaagacauugauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauccucgcccuguuucuggcucauuacauuggcacaucucucacucagaagguugugaucuucauauuacugauccuugucaccccaucgauggccaugcgcugugugggcguagggaacagagacuuuguugaaggauugucaggugcgacauggguggaugucgugcuggagcacggcgggugcgugaccacgauggcaaagaauaaacccacucuagacauugagcuccagaagacagaagccacccaacuggcuacucuuaggaaacuguguaucgagggaaagauuacaaacaucaccacggauagccggugcccuacccagggcgaagccauauugccagaggaacaggaccagaauuaugucuguaaacacacauacguugaucgcgguugggggaacggaugcggccucuucggcaaggggagucuggugacuugcgcaaaguuucaauguuuagaguccauugagggaaaaguagugcagcaugaaaaucugaaguauaccgucaucauuacagugcacacuggugaccagcaucagguuggcaacgagacccaaggggugacagcugaaaucaccccccaggccucuacugucgaggcgauccucccugaauacggaacgcuuggccuggagugcagcccacgaacagguuuggacuucaaugagaugauucuacugaccaugaaaaacaaggccuggauggugcacagacagugguuuuucgaucucccgcugcccuggacuuccggggcaaccacagaaaccccuacuuggaauaggaaagagcuucugguaacauuuaagaacgcucacgccaaaaagcaagaaguuguggucuugggcucacaggagggagcuaugcauacggcccucaccggcgcaacugaaauacagaauagugggggaacaagcaucuucgccggucaccugaagugucgguuaaaaauggacaagcuggagcuaaaaggcaugucuuaugcuaugugccucaacaccuuugugcugaagaaagaggucuccgaaacacagcaugggacuauucuuaucaagguggaguacaagggagaagaugcgccauguaaaauacccuucucaaccgaggacggccaagguaaggcacacaacgggcguuugauuacggccaauccuguugugaccaaaaaggaggaaccaguaaacaucgaggcugaacccccguucggcgagagcaauaucgucauuggaaucggcgauaaagcccugaagauuaacugguacaagaaagggaguucuauaggaaagauguuugaagcaacagcccgcggugcuagaaggauggccauccucggcgacacugcaugggauuucggguccgugggaggcguucugaauagccuugguaaaauggugcaucagauuuuugggucggcguauaccgcucuguucucuggcgucuccuggaucaugaagaucggaauuggcguguugcucacauggauagggcugaacucaaaaaauacuaguaugagcuuuuccugcaucgccauuggaaucauuaccuuauaccugggcgcaguagugcaggccgacauggguuguguuaucaacuggaaggggaaggagcuaaaaugcggaucuggcauauucgucacgaaugaggugcacacauggaccgaacaguauaaguuucaagcugauagcccuaaacggcucgccacugcaaucgcuggugccugggagaacggcgugugugggauucgaucaacaacccgcauggaaaaucugcuuuggaagcagaucgcgaacgaguugaauuacauucugugggaaaacaauaucaaacucacugucguugugggagacauaauuggcgugcuggagcaggggaagagaaccuuaacaccccagccaauggagcugaaauauaguuggaagacguggggaaaggccaaaaucguaaccgcugaaacucaaaacuccagcuucauuaucgauggcccuaacacacccgagugcccaucugcaucaagggccuggaaugucugggaaguggaggacuacgguuuugggguuuucaccacaaacauauggcuuaaguugcgggaaguguauacucagcucugugaccaccgccugaugagugcugccgucaaagaugagagagcagugcaugcggacaugggauacuggaucgagagccagaagaauggcuccuggaaacuagaaaaggccucucugauugagguuaagaccugcacguggcccaaaucgcacacacucuggagcaacggugugcuggaauccgauaugaucauuccuaagucacuugcuggcccaaucagucagcauaaucacaggccgggguaccacacccaaacugccggacccuggcauuugggcaaacuggaguuagacuuuaacuauugcgaggggaccacaguagucauaacugaaaauuguggaacccguggcccuucucuccggacaacgaccgugagcgguaagcugauucacgaguggugcugucgauccugcacucuuccaccccugagauacaugggggaagauggauguugguauggcauggagaucaggccuaucaacgaaaaagaggagaauauggugaagucauuggcaagcgcugguucuggcaaggucgacaacuucacaauggggguucucugccuggccauucuauuugaagaggugaugcgcggaaaauucggcaagaaacauaugaucgcagggguacugcucaccuucgugcugcuuuuguccggacagauuacuuggcgggauauggcccacacacugauaaugaucggcaguaaugcuagcgacagaauggguaugggggucaccuacuuagcgcucauugccacguuuaagauccagccauuccuggcacuuggauuuuuccugaggaaacuaacuucucgcgaaaaccuccuguugggcgugggccuggcuauggccaccacauuacaacuccccgaggauauugaacagauggccaaugggaucgcucugggacuuauggcacugaaguugauaacccaguuugagacuuaucagcucuggacagcccugguuucccuaaccuguucaaacacaaucuucacucugaccguggcguggcgaacggcuacacuuauucucgccggugucagucuguugccggugugccaaagcucguccaugcggaagaccgacuggcugccuauggcaguugccgcuaugggcgugccacccuuaccucucuuuaucuucucucugaaagauacucuuaagcguagaagcuggccccugaaugagggggucauggcaguaggauuggugucaauucucgccaguucccugcuaaggaacgacguuccaauggcgggcccucugguggcuggugggcuucucaucgccuguuacgucauaaccggaacaucugcagaucugacuguggaaaaagccgcugacguaaccugggaggaagaggccgaacagacgggcgugagccauaacuugaugauuacagucgacgaugacggcaccaugcgcaucaaggaugacgagacugagaauaucuuaacaguucugcucaaaaccgcacugcuuauuguguccgggauauuucccuauucaaucccagcuacucuguugguguggcacacauggcagaagcagacccaacggagcggaguccuaugggaugugccgaguccucccgaaacgcagaaagccgagcuggaagaggguguuuacagaauuaagcagcagggcaucuucgggaagacucaaguaggagugggcguccagaaagaggguguguuucacaccauguggcauguuacaaggggggcggugcucacccacaacggaaagcgacuggaaccaaauugggccucugucaaaaaggaccuuauuuccuacggcggcggguggcgcuuaagcgcacaguggcaaaaaggagaggaagugcagguaaucgcugucgagcccgguaagaacccuaagaauuuccagacaaugccaggcauauuucagacuaccacgggggaaaucggagccauugcucuggauuucaaacccggcacaucggguucaccuaucauuaaccgggaggggaaggugguuggacucuauggcaauggcguggucacuaaaaacgggggauacgugucugguaucgcacaaaccaaugccgagccggacggcccaacacccgaauuggaggaagagauguucaagaaaagaaaccugaccauaauggaucuccauccugggaguggaaagacuaggaaguaucugccagccauuguucgugaagcuaucaaacgccggcuuagaacccugaucuuggcgcccacaaggguggucgcagccgagauggaggaagcucuaaagggccugccuauucgauaccagacgacugccaccaaauccgagcacacaggucgggaaaucguggaccucaugugccaugcaaccuuuacuaugcgcuuacugagcccgguaagagugcccaauuauaaccuuauaauuauggaugaggcccacuucacagacccagcuucuaucgcggccaggggguacauuagcacccggguuggaaugggcgaagcagcugccaucuuuaugacggcaacuccucccggcacagccgaugcuuucccacaguccaaugccccuauacaggacgaggagcgagacauucccgaaagaucauggaacagugggaaugaguggaucaccgauuuugucggaaagaccgugugguucgugccaagcaucaaagcggguaacgacauugcaaacugucugcgcaagaauggcaagaaagucauccaacucucuaggaagacuuuugauacagaauaucagaaaaccaaguugaacgacugggauuucguagugacaacugacauuuccgagaugggggccaauuuuaaagcugaucguguuauagacccgcggagaugccugaagccugugauccucacggauggacccgagagggucauucuggccggcccaaugcccgugaccgcugcaucagccgcucagcgccgagguagaguugggcggaacccucagaaggaaaaugaccaauacaucuucacaggccagccacuuaacaaugaugaggaccacgcccauuggacugaagcaaaaaugcuacuggacaacaucaauacccccgagggaauuauaccugcguuguuugaaccggagagggagaagagugccgcuaucgauggcgaauaccgcuuaaaaggggagagccguaagacauucguggaacugaugagacggggagaccucccagucuggcuggcccacaaaguggcauccgaggguauuaaguauaccgauaggaaauggugcuucgacggcgaacgcaacaaucagauccuugaggagaacauggauguagaaauuuggacuaaggagggggaaaagaaaaagcugcgacccagauggcucgacgcucggacguacucugauccuuuggcccugaaagaguuuaaggacuucgcagccggaaggaaaucgaucgcucuagaucuggugaccgaaauaggccgcguucccagccaucucgcgcacagaacaaggaaugcccuugacaaccuggucauguuacacacuucagagcauggugggcgggcauaucgucacgcuguggaggaauugccagagaccauggaaacacugcuccugcuuggccugaugauccucuugaccggaggcgccaugcuguuuuuaauuuccgggaagggaaucgguaagacuaguauuggccuaaucugugugauagccucuagcgggaugcuguggauggcagaugucccucuccaguggauugcuuccgccaucguucuugaguucuuuaugauggugcuguugauucccgagccagaaaaacaacgcacaccucaggacaaucagcuggcguacguagugaucggaauacucacgcuggcugccaucgucgcagccaacgagaugggccuucucgaaaccacuaagcgagaucuggguaugucaaaagagccgggggugguuucucccacaagcuauuuggacguggaccugcauccagcuagugcauggaccuuauacgccgucgcgaccacaguaauuacuccuaugcuaagacacacgaucgaaaauuccaccgcuaacgugagccuggccgcaauugccaaccaagcuguugugcucaugggccuugauaagggauggcccaucucuaaaauggaccugggcgucccauugcuggcccucgggugcuauucacaggugaauccucugacacuuacugcagcugucuuacugcucgccacccauuacgcgauaauuggacccggcuugcaggccaaggcaacaagggaggcucagaagcggaccgccgcagguaucaugaaaaacccgacuguggaugggaucaugacgauugaccuggauccaguuaucuacgacuccaaguucgagaaacaacuaggacaggugaugcugcucguacuuugugcugugcagcuguugcugaugcgcacaaguugggcccucugcgaagcccugaccuuagcgacuggcccuauaaccacacuuugggaggguagccccggcaaguuuuggaauacuaccauugcugucucgauggcaaacaucuucagagggucuuaucuggccggagcuggccucgccuuuuccauuaugaaaagcguugggacaggaaagaggggcacggguucacagggggaaacccuaggagagaaguggaaaaagaaacugaaucaauugagucggaaggaauucgaucuguacaaaaagucuggcaucacugagguggaccgaacagaggcaaaagaaggucucaagagaggcgagauaacccgccacgccgucuccagggggagcgcuaagcuucagugguuuguggaacggaacaugguaaucccagagggacgugugauugaucugggcugugggagaggaggcuggucauauuacugcgcggguuugaaaaagguuacugaagugaggggguauacaaaaggaggccccggccacgaggagccugucccgaugaguaccuacggguggaauaucgugaagcugaugagcggaaaagacgucuucuaucuccccccagaaaagugugauacguuacugugcgacauuggugaguccucuccuagccccaccguggaagagucccgcacaauccggguucuuaagaugguagagccuuggcugaaaaacaaucaguuuuguauuaaggugcuaaacccauacaugcccacugucaucgaacaucucgagcgacugcagagaaaacacggcgggauguuggugaggaauccucugucacgcaacucuacccaugaaauguacuggauaaguaauggaacaggcaacauuguuucgagcgugaauauggucucccggcuccuucugaacagauucacuaugacccaccguaggccaacaaucgagaaggauguggacuuaggugccgggacccggcacguaaacgcagaacccgagacuccgaauauggacgugaucggagagcgcauuaaacgaauaaaggaagagcauaacucuacguggcacuaugaugacgaaaauccuuacaagacaugggcuuaucauggcucauacgagguuaaagccaccggcagcgcauccaguaugaucaacggggucgugaagcuguugacuaaaccaugggaugugguccccaugguuauucaaauggccaugaccgacacaacgccuuucggacagcagagaguguuuaaggaaaaaguagauaccaggacuccacggcccaugccggguacacgcaaggugauggagaucaccgcugaguggcucuggagaacucugggcaggaauaagcgaccucggcuaugcacacgugaagaguucaccaaaaaggucagaacaaacgccgcgaugggggcaguguuuacugaagagaaucaaugggacucugcccgcgcugccguugaagaugaggaguucuggaaacuuguggacagggaacgggagcugcacaagcucggaaaauguggcagcugcgucuauaacaugauggguaagagagaaaaaaagcugggggaguuuggaaaggcaaaaggcucacgcgcuauuugguacaugugguugggcgccagguaucuggaguucgaagcucucggguuucuuaaugaggaucauugguucucccgagaaaacaguuacagcggaguggagggugaaggccugcacaaguuaggguacauccugcgggacauaucuaaaauccccggaggcgccauguaugcagaugacaccgcggguugggacacgagaauuaccgaggaugacuugcacaaugaggaaaagaucacacagcagauggauccagagcauaggcagcucgccaacgcuauuuuuaaacugacuuaccaaaauaagguaguuaaggugcagcgcccuacccccaaagggacagucauggacaucauaucccguaaggaucagcggggaucaggccaggugggcacuuaugggcuaaacaccuucacgaauauggaagcccaacuugugagacagauggagggagaagguguccugagcaaagcagaccucgagaacccacaccuguuggagaagaaaauuacacagugguuagaaaccaagggcguugagaggcugaagcgcauggcuaucucgggggaugacugcgugguaaaacccaucgaugaccgauuugccaacgcacuccuugcccugaaugauaugggaaaggugcggaaagacauuccucaguggcaaccaucuaagggcuggcaugauuggcagcaggucccguucuguagucaccacuuucaugaacuaauaaugaaagacgguagaaagcuggugguucccugcaggccucaggacgagcucaucgggcgcgcgagaauuucccaaggagcuggcuggagcuugaaggaaacugccugucugggcaaagcauacgcccagauguggucacuuauguauuuccaccggagggaucugcgucucgcuuccaacgccaucugcucugcagugccaguccauugggugcccacaagccgaaccacuuggaguauucacgcucaucaccaguggaugaccacagaggacauguuaacgguauggaaucgcguuuggaucgaggauaacccuuggauggaagacaagaccccagugacuacaugggaggauguccccuaccuggggaaaagagaagaccaaugguguggauccuugauaggucugaccagccgggccacuugggcgcagaauauccucacagcuauucagcaggugaggucucuuaucggcaacgaggaguuccuggauuauaugccuucaaugaagcgcuuuaaaaaggaagaggaaagugagggggccauuugguga

SEQ ID NO: 15393 - RNA, 9873 nt, Artificial Sequence
  derived and/or modified CDS sequence (opt3) from DENV-3__FJ898459__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgcaggugcuugggagaauggcgucugugggauacgaagcaccacacgcauggaaaaccuccuguggaaacagaucgccaaugagcuuaacuauauuuugugggaaaauaacaucaagcugacgguuguggugggagacauuaucggcguacucgagcaggggaaaagaacccugacuccacagccuauggaguuaaaguacucauggaaaacauggggaaaggcgaagauagucaccgccgaaacacaaaacaguuccuucauuaucgauggccccaauacuccagagugccccagcgcuucuagggcauggaacgugugggaaguugaggacuaugguuuugggguguucaccacgaauauuuggcugaaacuucgggaagucuacacacaguugugugaccaccgccucaugucagccgcugugaaggaugagagagccguucacgcagacaugggauacuggaucgagagucagaaaaacggcagcuggaagcuggaaaaagcgucccuaauagaggugaagaccugcacuuggccuaagucucauacccuguggucgaaugguguacucgaaagcgauaugaucauuccaaaaucccuggccggcccgaucucacagcacaaccauaggcccggguaucacacacaaacugcuggaccuuggcaccuuggcaaguuggagcuggacuuuaauuacugcgaggggaccacagucgugauuacggaaaacuguggaacccguggcccaaguuuacggacuacaaccgugucugguaaacucauccaugaguggugcugucgaagcugcacucugcccccucuuagauauaugggggaagauggauguugguacggcauggagauaaggccaauuuccgaaaaggaggagaauauggucaaaucacugguuagcgccgguucuggcaagguggacaacuucacaauggggguauugugccucgcaauccuguuugaagaggugaugcgcggaaaguucggcaaaaagcacaugaucgcuggggucuucuuuaccuucgugcuacugcucuccggacagauuacguggcgggauauggcccauacucugaucaugauuggcaguaaugcaagcgacagaauggguauggggguuaccuaucuugccuugauagcuacauuuaaagugcagcccuuccuggcguuaggauuuuuccucaggaagcugaccucucgcgaaaaccuucugcuaggcgucggccucgccauggcaacuacacugcaauugccggaggauaucgaacagauggcuaaugggauugcccugggauuaauggcccucaaacugaucacccaguuugagacauaccagcuuuggacugcucugauuuccuugaccuguucaaacacgauguucacacucaccguggcauggcgaacugccacccugauccuagcggguguuagucugcuuccugugugccaaagcucguccaugcggaagacagacuggcucccaauggcugucgccgcaaugggcguacccccucugcccuuguuuauauucucucugaaggauacuuuaaaacguagaagcuggccacucaaugagggggugauggccguuggacuggugucaauccuugcuaguucccuguugaggaacgacgucccuauggcaggcccccucguggccggugggcugcuaauugcguguuauguaaucaccggaacgucugcugaucugacaguggaaaaggccgcagacauuaccugggaggaagaggccgaacagacuggcgucagccacaaccuuaugaucacaguugacgaugacggcaccaugcgcauaaaagaugacgagacugagaauauucucacagugcuguugaagaccgcuuuacugaucguguccggggucuuuccauacucaaucccggccacgcuccugguguggcauacuuggcagaaacagacccaacggagcggaguucuuugggauguaccuagucccccagaaacacagaaggcagagcuggaagaggguguguacagaauuaaacagcagggcauauucgggaagacccaagucggagugggcguucagaaggaggguguguuucacacaauguggcacgucacuaggggggcuguguugaccuauaacggaaaacgacuagaacccaauugggccucuguaaagaaagaccugaucuccuacggcggcggguggcgccucagcgcgcaguggcaaaagggagaggaaguccaggugauugccguugagccugguaaaaacccaaagaauuuccagacgaugcccggcacauuccagacuaccacaggggaaaucggagcaauugcucuggauuuuaagccuggcaccucggguucaccgaucauaaaccgggaggggaaaguggucggacuuuauggcaauggcgugguuacuaagaacgggggauacgugucugguaucgcccaaaccaaugcugagccagacggccccacaccugaauuagaggaagagauguucaaaaagagaaaccugacgauuauggaucuccauccagggaguggaaaaacuaggaaguauuugcccgcaaucguccgugaagccauuaagcgccggcugagaacccucauccuggccccuacaagggugguagcugcggagauggaggaagcacuuaaaggccugccgauacgauaccagaccacugccacaaaguccgagcacaccggucgggaaauuguggacuugaugugccaugcuacguuuacuaugcgccuacugagccccguuagagucccaaauuauaaccucaucaucauggaugaggcccacuucacagacccugcaucuauugccgcuaggggguacaucagcacccgggugggaaugggcgaagcggccgcaauauuuaugaccgcuacucccccaggcacagccgaugcauucccucaguccaaugcccccauucaggacgaggagcgagacaucccagaaagaucauggaacagugggaaugaguggauuaccgauuuugcuggaaaaacagugugguucgucccgagcaucaaggccgguaacgacauagcgaacuguuuacgcaaaaauggcaagaagguaauucaacugucuaggaaaacuuuugauacggaauaccagaagaccaaacuuaacgacugggauuucgugguuacaacugacaucuccgagaugggggcaaauuuuaaggccgaucgugugaucgacccucggagaugccugaaacccgucauucucaccgauggaccagagagggugaucuuggcuggccccaugccuguuacagccgcuucagcagcccagcgccgagguagaguggggcggaacccacagaaggaaaaugaccaauauauuuucaccggccagccccugaacaaugaugaggaccaugcucacuggacugaagccaagaugcuccuggacaacauaaauacgccugagggaaucauuccggcacuuuucgaaccagagagggagaaaagugcggccaucgauggcgaauaccgccuaaagggggagagccguaaaaccuuugucgaacugaugagacggggagacuugcccgugugguuagcucacaagguagccuccgaggguaucaaauauacagauaggaaguggugcuucgacggccagcgcaacaaucagauucuggaagagaacauggauguggagauauggacuaaagaaggggagaagaagaaacuccgaccuagauggcuggacgcacggaccuacucugauccccuugcucugaaggaauuuaaagacuucgccgcaggaaggaagucgaucgcccucgauuugguuacagagauuggccgcgucccaagccaucuggcucacagaaccaggaaugcgcuagacaaccuggugaugcuccauacuucagaacacggugggcgggccuaucgucacgcaguggaggagcuuccugaaacaauggagacgcuguuauugcugggccucaugauccugcuuaccggaggcgcuaugcuguuucucauuuccgggaaaggaaucgguaagacuaguauaggcuugaucugugucauugccucuagcgggaugcuguggauggccgaaauccccuuacaauggauugcauccgcuaucguucuagaguucuuuaugauggugcugcucauaccagagccugaaaagcagcgcacaccgcaggauaaucaacuugccuacguagugauuggaauccugaccuuggcggcuauuaucgccgcaaacgagaugggccugcucgaaaccacaaaacgagaccuggguaugucaaaggagcccggggucgugucuccaacuagcuaucuugauguugaccuccauccugccagugcuuggacgcuguacgcaguggccaccacagucauaacucccauguugagacacaccaucgaaaauuccacagcgaacguaagccuggcugccauugcaaaccaggccgugguuuuaaugggccuagacaaaggauggccaaucucuaagauggaucugggcgugccucuccuugcucuggggugcuacucacaggucaaucccuugacccugacugccgcagugcuccugcuuauuacgcauuaugcuaucauaggaccgggcuuacaggccaaagcgacaagggaggcccaaaagcggaccgcagcugguauuaugaagaacccaacugucgacgggaucaugaccaucgaucuggacccugugauuuacgauuccaaauucgagaagcagcucggacagguuauguugcuggugcuaugugccguacagcugcuccuuaugcgcacaaguugggcacugugcgaagcuuugacucuggccaccggccccaucacaacgcucugggaggguagcccaggcaaauuuuggaauaccacuauagccgugucgauggcgaacauuuucagagggucuuaucuggcuggagcaggcuuagccuuuuccaucaugaagagcgucgggacaggaaaaaggggcaccgguucacaaggggaaacucuuggagagaaguggaagaaaaagcugaaucagcucagucggaaagaauucgaccuauacaagaaaucuggcauuacagagguugaucgaaccgaggcuaaggaaggucugaaaagaggcgagacgacccaccaugccgugucccgcgggagcgcaaaguugcagugguuugucgaaaggaacauggugauccccgagggacggguaauagaccugggcugugggcguggaggcuggucauauuacugcgccggucucaagaaagugacagaaguuagaggguauacuaagggaggcccuggccacgaggagccggugcccaugaguaccuacggguggaauaucgucaaacuuaugagcggaaaggauguguucuaccugccaccugaaaaaugugacacauugcugugcgauauuggugaguccucucccagcccuacugucgaagaguccaggaccauccgcgugcucaagaugguugagccaugguuaaagaacaaucaguucuguauuaaaguacugaaccccuauaugccuacagugaucgaacaccuugagcggcugcaacgaaagcauggcgggaugcuagucagaaauccacucucaaggaacucuacccacgaaauguacuggauuaguaauggaacuggcaacaucguggcuucgguuaauauggugagccgccuguugcugaaccgguuuacgaugacacauagacgucccaccauagagaaagacgucgaucucggugcggggacuaggcacgugaacgccgaaccggagaccccuaauauggacguaauuggagagcggaucaagcgcaucaaagaagagcacaacuccacauggcauuaugacgaugaaaauccauacaagacgugggcauaucacggcucuuacgaggugaaggcuaccggcucagccagcuccaugauuaacgggguugucaaacuucugacuaagcccugggacguggugccuauggucacacagauggcaaugaccgauacuacaccauucggacagcaacgaguuuuuaaagaaaagguggacaccagaacacccaggaguaugccggguacucggcgcguaaugggcauaaccgccgagugguuauggagaacgcuggggaggaauaaaaagccucgauugugcacccgggaggaauucacaaagaaagugcguacuaacgcugccaugggagcggucuuuaccgaggaaaaucagugggauucugcaaaggccgcuguggaggacgaagauuucuggaaacucguugacagagagcgcgagcugcauaagcuaggcaaaugugguagcugcguguauaacaugauggggaagagggaaaaaaagcuuggagaguuuggcaaggccaaaggcucacgggcaaucugguacauguggcugggggcuagauaccucgaauucgaggcccugggauuuuugaaugaggaucacugguucucccgcgaaaacaguuauagcggugucgagggcgaagggcugcauaagcucggauacauucuuagggacaucucuaaaauucccggcggugcuauguaugccgaugacacagcagggugggacacucgaaucaccgaggaugaccugcacaaugaagagaagauaacgcagcagauggauccagagcaccggcaauuagcgaacgccaucuuuaaacugacauaccagaauaaggugguaaagguucagagaccuacccccacuggaacagugauggacauuaucuccaggaaagaucagcgcggcucaggccaagucgggaccuauggauugaacacuuucaccaauauggaagcucagcucauucgucagauggagggugaaggcgugcugagcaaggccgaccuagagaacccacaucuucccgaaaaaaagaucacacaguggcuggagacgaaagggguggagcggcucaagagaauggcaauaucgggagaugacugcgucguuaagccuauugaugacagguuugcuaacgcccuguuggcauuaaaugauaugggcaaagugcgcaaggacaucccacaauggcagccgucuaaagguuggcacgauuggcagcagguacccuucuguagucaucacuuccacgaacugaucaugaaggacgggcgaaaacucguggucccuugccggccacaagacgagcuuauuggaagagccaggauaucccagggcgcgggcuggagccugcgcgaaaccgcuugucuagggaaggccuacgcacagauguggucacugauguauuuucauagacgggaucucagguuggccuccaacgcuaucugcucugccgugcccguucacugggugccuacuagccguacaaccuggaguauucaugcacaccaucaauggaugacuacagaggacaugcugaccgucuggaaucgaguguggaucgaagauaacccauggauggaggacaagacgcccguaacaaccugggagaauguuccuuaccuuggaaaacgcgaagaucaguggugugguucccugauuggccucacuagcagagcuaccugggcccagaacaucccgacagcgauacagcaagugcggucuuuaaucgggaaugaggaauuccuggacuacaugccaucaaugaagagguuucgcaaagaggaggaaagugagggagcuauuugguga

SEQ ID NO: 15394 - RNA, 9873 nt, Artificial Sequence
  derived and/or modified CDS sequence (opt3) from DENV-3__EU482555__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggagugaucacccuguauuuaggcgccguuguccaggcagacauggguugugugauuaauuggaaagggaaggagcugaagugcggauccggcaucuucgugacuaacgagguccauacauggaccgaacaguacaaauuucaagccgauucucccaagcggcuagcuacugccauugcaggugcuugggagaauggcguuugugggauccgaagcaccacacgcauggaaaaccuccuguggaaacagauagccaaugagcuuaacuauaucuugugggaaaauaacauuaagcugacgguggugguaggagacaucauuggcguccucgagcaggggaaaagaacccugacuccacagccuauggaguuaaaguacucauggaaaacauggggaaaggcgaagaucgugaccgccgaaauacaaaacaguuccuucauuaucgauggccccaauacaccagagugccccagcgcuucuagggcauggaacguuugggaaguggaggacuaugguuuuggggucuucacuaccaauauuuggcugaaacuucgggaaguguacacgcaguugugugaccaccgccucaugucagccgcuguuaaggaugagagagccgugcacgcagacaugggauacuggaucgagagucagaaaaacggcagcuggaagcuggaaaaagcgucccuaauagagguaaagacaugcaccuggccuaagucucauacucuguggucgaaugguguccucgaaagcgauaugaucauuccaaaaucccuggccggcccgaucucacagcacaacuauaggcccggguaccauacccaaacagcuggaccuuggcaccuuggcaaguuggaccuggauuuuaauuauugcgaggggacuaccguggugauuacagagaacuguggaacgcguggcccaaguuuacggaccacuacagucucugguaaacucauccacgaauggugcugucgaagcugcacccugcccccucuuagauacaugggggaggacggauguugguauggcauggaaauaaggccaauuuccgagaaggaagagaauaugguuaaaucacuggugagcgccgguucuggcaagguagauaacuucacuauggggguguugugccucgcaauccuguuugaggaagucaugcgcggaaaguucggcaaaaagcauaugaucgcugggguguucuuuacauucguucuacugcucuccggacagauuaccuggcgggacauggcccacacgcugaucaugauuggcaguaaugcaagcgauaaaauggguaugggggugacuuaccuugccuugauagcuaccuuuaagauccagcccuuccuggcguuaggauuuuuccucagaaaacugacaucuagggagaaccuucugcuaggcgucggccucgccauggcaaccacucugcaauugccggaagacauugagcagauggcuaaugggaucgcccugggauuaauggcccucaagcugauuacacaguuugaaaccuaucagcuuuggacagcucugaucuccuugacuuguucaaacaccauguucacgcucacaguggcauggcgcaccgccacucugauacuagcggguguuagucugcuuccugugugccaaagcucguccaugcgaaagaccgauuggcucccaauggcugucgccgcaaugggcguacccccucugcccuuguuuaucuucucucugaaagacacauuaaagcggcguagcuggccacucaaugagggggugauggccguuggacuggugucaauucuugcuaguucccuguugagaaacgaugucccuauggcaggcccccucguggccggugggcugcuaaucgcguguuacguaauuacuggaaccucugcugaccugacgguggagaaagccgcagacaucacaugggaagaggaagccgagcagaccggcgucagccauaaccuuaugauaacuguugaugacgauggcacaaugaggauuaaggacgaugaaaccgagaauauccucacugugcuguugaaaacagcuuuacugaucguguccggggucuuuccauacucaauuccggccacccuccugguguggcacacguggcagaagcagacucaacgcagcggaguucuuugggacguaccuagucccccagagacccagaaagcagaacuggaggaagguguguaucggauaaagcagcagggcaucuucgggaagacacaagucggagugggcguucagaaagaggguguguuucauaccauguggcacgucacaagaggggcuguguugacuuacaacggaaagaggcuagagcccaauugggccucuguaaaaaaggaucugauuuccuauggcggcggguggcgacucagcgcgcaguggcaaaaaggagaagagguccaggugaucgccguugaaccugguaagaacccaaagaauuuccagaccaugcccggcacguuccagacaacuaccggggagauuggagcaaucgcucuggacuuuaaaccuggcacaucggguucaccgauaaucaaccgcgaagggaagguggucggacuuuacggcaauggcgugguuaccaaaaacgggggauaugugucugguauugcccaaacuaaugcugagccagauggccccaccccugaguuagaagaggaaauguucaagaaacggaaccugacaaucauggaccuccacccagggaguggaaagacgagaaaguacuugcccgcaauugucagggaggccaucaaacgucgccugcggacucucauacuggccccuaccagagugguagcugcggaaauggaggaggcacuuaagggccugccgauuagguaucagacaaccgccacuaaauccgaacauacaggucgagagaucguggauuugaugugccacgcuaccuuuacgaugcggcuacugagccccguucgcgucccaaauuacaaccucaucauuauggacgaagcccauuucacugauccugcaucuaucgccgcuagaggguacauaagcacaagggugggaaugggcgaggcggccgcaauuuuuaugaccgcuacccccccaggcacugccgacgcauucccucaguccaaugcccccauccaggacgaagagcgggauauuccagagcgaucauggaacagugggaaugaauggaucacagacuuugcuggaaagaccgugugguucgucccgagcauaaaagccgguaacgauauugcgaacuguuuaagaaagaauggcaagaaaguaauccaacugucucgcaagacauuugacacugaguaucagaaaacgaagcuuaacgauugggacuucgugguuaccacagauaucuccgaaaugggggcaaauuuuaaagccgacagggugauugauccucgucggugccugaagcccgucauccucacugacggaccagagagagugauuuuggcuggccccaugccuguuaccgccgcuucagcagcccagaggcgcggucgaguggggagaaacccacagaaggagaaugaucaauacauauucacaggccagccccugaacaaugacgaagaccacgcucauuggaccgaggccaaaaugcuccuggauaacaucaauacuccugaaggaauuaucccggcacuuuucgagccagaacgggagaagagugcggccaucgacggcgaguauaggcuaaaaggggaaagccgcaagacguuugucgagcugaugcguagaggagauuugcccgugugguuagcucacaaaguagccuccgaagguauuaaguacaccgaccggaaauggugcuucgauggccagaggaacaaucagauacuggaggaaaacauggacguggagaucuggacaaaggagggggaaaagaaaaagcuccgcccucgauggcuggaugcaagaacuuauucugacccccuugcucugaaagaguuuaaggauuucgccgcaggacggaaaucgauugcccucgacuugguuaccgaaaucggcagggucccaagccaccuggcucaucgcacaagaaaugcgcuagauaaccuggugaugcuccacaccucagagcauggugggagggccuaccggcacgcaguggaagagcuuccugagacuauggaaacacuguuauugcugggccucaugauucugcuuacgggaggcgcuaugcuguuucucaucuccgggaagggaauagguaagaccaguaucggcuugauuugugucaucgccucuagcgggaugcuguggauggccgagauucccuuacaauggaucgcauccgcuauaguucuagaauucuuuaugauggugcugcucauuccagagccugagaaacagcguacuccgcaggacaaucaacuugccuauguagugaucggaauucugacauuggcggcuaucauagccgcaaacgaaaugggccugcucgagaccaccaagcgcgaucuggguaugucaaaagaacccggggucgugucuccaacaagcuaccuugacguugaccuccacccugccagugcuuggacucuguacgcaguggccacgaccgucaucacacccauguugcgacauacuauugagaauuccaccgcgaacguaagccuggcugccaucgcaaaccaggccgugguuuuaaugggccuagauaagggauggccaauuucuaaaauggaccugggcgugccucuccuugcucuggggugcuauucacaggucaaucccuugacacugaccgccgcagugcuccugcuuaucacucacuacgcuauaauuggaccgggcuuacaggccaaggcgacgagagaagcccaaaagaggacagcagcugguaucaugaaaaacccaaccgucgaugggaucaugacuauugaccuggauccugugaucuaugacuccaaguucgagaaacagcucggacagguuauguugcuggugcuaugugccguacagcugcuccuuaugcggaccaguugggcacugugcgaggcuuugacacuggccacuggccccauaaccacacucugggaagguagcccaggcaaguuuuggaauacgaccauugccgugucgauggcgaacaucuuccgcgggucuuaccuggcuggagcaggcuuagccuuuuccauuaugaaaagcgucgggacuggaaagagaggcacagguucacaaggggagacccuuggagaaaaguggaaaaagaaacugaaucagcucaguaggaaggaguucgaucuauauaaaaagucuggcaucacugaaguugaccggacagaggcuaaagagggucugaagcgaggcgaaaccacgcaucacgccguguccagagggaccgcaaaguugcagugguuugucgagcgcaacauggugauacccgaaggaaggguaaucgaucugggcugugggcggggaggcuggagcuacuauugcgccggucucaaaaaggugacagagguucguggguacacuaaaggaggcccuggccaugaagagccggugcccaugucaaccuacggguggaauauugucaagcuuaugaguggaaaagacguguucuaucugccaccugagaagugugauacauugcugugcgacaucggugaaagcucccccucuccuacugucgaggaaagcagaaccauuagggugcucaagaugguugagccaugguuaaaaaacaaucaguucuguaucaagguacugaaccccuacaugccuacagugauugagcaccuugaacgccugcaacggaaacacggcgggaugcuaguccgaaauccacucuccagaaacucaacccaugagauguauuggaucucuaauggaacuggcaacauaguggcuaguguuaauauggugucgaggcuguugcugaaccgcuuuacgaugacacaccggagacccaccauugaaaaggaugucgaccucggugcggggacucgucaugugaacgccgagccggaaaccccuaauauggacguaaucggagagaggaucaaacggauuaaggaggaacacaacagcacauggcacuacgaugacgagaauccauauaagacgugggcauaccauggcuccuaugaagugaaagcuaccggcucugccucaagcaugauaaacgggguugucaagcuucugacuaaacccugggauguggugccuauggucacacagauggcaaugaccgacacuacaccauucggacagcaacgcguuuuuaaggagaaaguggauacccgaacacccagauccaugccggguacuaggcggguaaugggcaucaccgccgaaugguuauggcgcacgcuggggagaaauaagaagccuagguugugcacccgagaggaguucacaaaaaaggugcggacuaacgcugccaugggagcggucuuuaccgaagagaaucagugggacagugcaaaagccgcuguggaagaugaggacuucuggaagcucguugaucgugaaagagagcugcacaaacuaggcaagugugguucuugcguguacaacaugauggggaaacgcgagaagaagcuuggagaauuuggcaaagccaagggcagcagggcaauuugguacauguggcugggggcucgguaucucgaguucgaagcccugggauuuuugaaugaggaccauugguucucaagagagaacuccuacaguggugucgaaggcgaggggcugcacaaacucggauauauccuucgcgauauuagcaagauccccggcggugcuauguacgccgacgacacagcagggugggauacuaggauaaccgaagacgaucugcauaaugaggaaaaaaucacgcagcagauggacccagagcaccgacaauuagcgaacgccauuuuuaagcugacauaucagaauaaggugguaaaaguucagcggccuacccccacuggaacagugauggauaucauuucuagaaaggaccagaggggcuccggccaagucgggaccuacggauugaacacuuucaccaauauggaggcucagcucauccgccagauggaaggugagggcgugcugucaaaagccgaucuagaaaacccacaccuucccgagaagaaaauaacacaguggcuggaaacgaaggggguggagcgucuccggagaauggcaauuagcggagacgauugcgucguuaagccuaucgacgauagguuugcuaacgcccuguuggcauuaaaugacaugggcaaagugcgcaaggauaucccacaauggcagccgucgaaagguuggcaugacuggcagcagguacccuucuguucucaccauuuccacgagcugauuaugaaggacgggcgaaaacucguggucccuugccggccacaagaugaacuuauaggaagagccaggaucagucagggcgcgggcuggucccugcgcgagaccgcuugucuagggaaggccuaugcacagauguggagccugauguacuuucacagacgggaccucagguuggccucaaacgcuauuugcuccgccgugcccguucauugggugccuacuucucguacaaccuggagcauccacgcacaucaccaauggaugacuacagaagauaugcugaccgucuggaaucgaguguggauugaggacaacccauggauggaagauaagacgcccguaacaaccugggagaauguuccuuaccuuggaaaacgcgaggaccaguggugugguagucugaucggccucacuuccagagcuaccugggcccagaacauaccgacagcgauccagcaagugcggagcuuaauugggaaugaagaguuccuggauuauaugccaucuaugaagagguuucgcaaagaagaggagucagaaggagcuaucugguga

SEQ ID NO: 15395 - RNA, 9873 nt, Artificial Sequence
  derived and/or modified CDS sequence (opt3) from DENV-3__EU529692__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggagugaucacccuguauuuaggcgccguuguccaggcagacauggguugugugauuaauuggaaagggaaggagcugaagugcggauccggcaucuucgugacuaacgagguccauacauggaccgaacaguacaaauuucaagccgauucucccaagcggcuagcuacugccauugcaggugcuugggagaauggcguuugugggauccgaagcaccacacgcauggaaaaccuccuguggaaacagauagccaaugagcuuaacuauaucuugugggaaaauaacauuaagcugacgguggugguaggagacaucauuggcguccucgagcaggggaaaagaacccugacuccacagccuauggaguuaaaguacucauggaaaacauggggaaaggcgaagaucgugaccgccgaaauacaaaacaguuccuucauuaucgauggccccaauacaccagagugccccagcgcuucuagggcauggaacguuugggaaguggaggacuaugguuuuggggucuucacuaccaauauuuggcugaaacuucgggaaguguacacgcaguugugugaccaccgccucaugucagccgcuguuaaggaugagagagccgugcacgcagacaugggauacuggaucgagagucagaaaaacggcagcuggaagcuggaaaaagcgucccuaauagagguaaagacaugcaccuggccuaagucucauacucuguggucgaaugguguccucgaaagcgauaugaucauuccaaaaucccuggccggcccgaucucacagcacaacuauaggcccggguaccauacccaaacagcuggaccuuggcaccuuggcaaguuggaccuggauuuuaauuauugcgaggggacuaccguggugauuacagagaacuguggaacgcguggcccaaguuuacggaccacuacagucucugguaaacucauccacgaauggugcugucgaagcugcacccugcccccucuuagauacaugggggaggacggauguugguauggcauggaaauaaggccaauuuccgagaaggaagagaauaugguuaaaucacuggugagcgccgguucuggcaagguagauaacuucacuauggggguguugugccucgcaauccuguuugaggaagucaugcgcggaaaguucggcaaaaagcauaugaucgcugggguguucuuuacauucguucuacugcucuccggacagauuaccuggcgggacauggcccacacgcugaucaugauuggcaguaaugcaagcgauaaaauggguaugggggugacuuaccuugccuugauagcuaccuuuaagauccagcccuuccuggcguuaggauuuuuccucagaaaacugacaucuagggagaaccuucugcuaggcgucggccucgccauggcaaccacucugcaauugccggaagacauugagcagauggcuaaugggaucgcccugggauuaauggcccucaagcugauuacacaguuugaaaccuaucagcuuuggacagcucugaucuccuugacuuguucaaacaccauguucacgcucacaguggcauggcgcaccgccacucugauacuagcggguguuagucugcuuccugugugccaaagcucguccaugcgaaagaccgauuggcucccaauggcugucgccgcaaugggcguacccccucugcccuuguuuaucuucucucugaaagacacauuaaagcggcguagcuggccacucaaugagggggugauggccguuggacuggugucaauucuugcuaguucccuguugagaaacgaugucccuauggcaggcccccucguggccggugggcugcuaaucgcguguuacguaauuacuggaaccucugcugaccugacgguggagaaagccgcagacaucacaugggaagaggaagccgagcagaccggcgucagccauaaccuuaugauaacuguugaugacgauggcacaaugaggauuaaggacgaugaaaccgagaauauccucacugugcuguugaaaacagcuuuacugaucguguccggggucuuuccauacucaauuccggccacccuccugguguggcacacguggcagaagcagacucaacgcagcggaguucuuugggacguaccuagucccccagagacccagaaagcagaacuggaggaagguguguaucggauaaagcagcagggcaucuucgggaagacacaagucggagugggcguucagaaagaggguguguuucauaccauguggcacgucacaagaggggcuguguugacuuacaacggaaagaggcuagagcccaauugggccucuguaaaaaaggaucugauuuccuauggcggcggguggcgacucagcgcgcaguggcaaaaaggagaagagguccaggugaucgccguugaaccugguaagaacccaaagaauuuccagaccaugcccggcacguuccagacaacuaccggggagauuggagcaaucgcucuggacuuuaaaccuggcacaucggguucaccgauaaucaaccgcgaagggaagguggucggacuuuacggcaauggcgugguuaccaaaaacgggggauaugugucugguauugcccaaacuaaugcugagccagauggccccaccccugaguuagaagaggaaauguucaagaaacggaaccugacaaucauggaccuccacccagggaguggaaagacgagaaaguacuugcccgcagucgugagggaggccauuaaacgucgccugcggacucucauccuggccccuaccagaguaguggcugcggaaauggaggaggcacuuaagggccugccgauaagguaucagacaaccgccacuaaauccgaacauacaggucgagagauuguugauuugaugugccacgcuaccuuuacgaugcggcuacugagccccguccgcgugccaaauuacaaccucaucaucauggacgaagcccauuucacugauccugcaucuauugccgcuagaggguacaucagcacaagggugggaaugggcgaggcggccgcaauauuuaugaccgcuacccccccaggcacugccgacgcauucccucaguccaaugcccccauucaggacgaagagcgggauaucccagagcgaucauggaacagugggaaugaauggauuacagacuuugcuggaaagaccgucugguucguaccgagcaucaaagccgguaacgauauagcgaacuguuuaagaaagaauggcaagaaagugauucaacugucucgcaagacauuugacacugaguaucagaaaacgaagcuuaacgauugggacuucguugugaccacagauaucuccgaaaugggggcaaauuuuaaagccgacagggucaucgauccucgucggugccugaagcccgugauucucacugacggaccagagagaguuaucuuggcuggccccaugccugugaccgccgcuucagcagcccagaggcgcggucgagucgggagaaacccacagaaggagaaugaucaauacauuuucacaggccagccccugaacaaugacgaagaccacgcucauuggaccgaggccaaaaugcuccuggauaacauaaauacuccugaaggaaucauuccggcacuuuucgagccagaacgggagaagagugcggccaucgacggcgaguauaggcuaaaaggggaaagccgcaagacguuuguggagcugaugcguagaggagauuugcccguaugguuagcucacaaaguggccuccgaagguaucaaguacaccgaccggaaauggugcuucgauggccagaggaacaaucagauucuggaggaaaacauggacguugagauauggacaaaggagggggaaaagaaaaagcuccgcccucgauggcuggaugcaagaacuuauucugacccccuugcucugaaagaguuuaaggauuucgccgcaggacggaaaucgaucgcccucgacuuggucaccgaaauuggcagggugccaagccaccuggcucaucgcacaagaaaugcgcuagauaaccuggugaugcuccacaccucagagcauggugggagggccuaccggcacgcagucgaagagcuuccugagacuauggaaacacuguuauugcugggccucaugauccugcuuacgggaggcgcuaugcuguuucucauuuccgggaagggaaucgguaagaccaguauaggcuugaucuguguuauugccucuagcgggaugcuguggauggccgagauccccuuacaauggauugcauccgcuaucgugcuagaauucuuuaugaugguacugcucauaccagagccugagaaacagcguacuccgcaggacaaucaacuugccuauguggucauuggaauccugacauuggcggcuauuaucgccgcaaacgaaaugggccugcucgagaccaccaagcgcgaucuggguaugucaaaagaacccggggugguuucuccaacaagcuaccuugacguggaccuccacccugccagugcuuggacucuguacgcagucgccacgaccguaauaacacccauguugcgacauacuaucgagaauuccaccgcgaacgugagccuggcugccauugcaaaccaggccguuguguuaaugggccuagauaagggauggccaaucucuaaaauggaccugggcgucccucuccuugcucuggggugcuauucacaggugaaucccuugacacugaccgccgcaguccuccugcuuauuacucacuacgcuaucauaggaccgggcuuacaggccaaggcgacgagagaagcccaaaagaggacagcagcugguauuaugaaaaacccaaccguggaugggaucaugacuaucgaccuggauccuguuauuuaugacuccaaguucgagaaacagcucggacaggugauguugcugguacuaugugccgugcagcugcuccuuaugcggaccaguugggcacugugcgaggcuuugacacuggccacuggccccaucaccacacucugggaagguagcccaggcaaguuuuggaauacgaccauagccgucucgauggcgaacauuuuccgcgggucuuaccuggcuggagcaggcuuagccuuuuccaucaugaaaagcguugggacuggaaagagaggcacagguucacaaggggagacccuuggagaaaaguggaaaaagaaacugaaucagcucaguaggaaggaguucgaucuauauaaaaagucuggcauuacugaaguggaccggacagaggcuaaagagggucugaagcgaggcgaaaccacgcaucacgccgucuccagagggaccgcaaaguugcagugguuuguggagcgcaacaugguaauccccgaaggaagggugauagaucugggcugugggcggggaggcuggagcuacuauugcgccggucucaaaaagguuacagaggugcguggguacacuaaaggaggcccuggccaugaagagccgguccccaugucaaccuacggguggaauaucgugaagcuuaugaguggaaaagacgucuucuaucugccaccugagaagugugauacauugcugugcgacauuggugaaagcucccccucuccuacuguggaggaaagcagaaccaucaggguucucaagaugguagagccaugguuaaaaaacaaucaguucuguauuaaggugcugaaccccuacaugccuacagucaucgagcaccuugaacgccugcaacggaaacacggcgggaugcuagugcgaaauccacucuccagaaacucaacccaugagauguauuggauuucuaauggaacuggcaacaucguugcuagugugaauauggucucgaggcuguugcugaaccgcuuuacgaugacacaccggagacccaccauagaaaaggauguggaccucggugcggggacucgucauguaaacgccgagccggaaaccccuaauauggacgugauuggagagaggaucaaacggaucaaggaggaacacaacagcacauggcacuacgaugacgagaauccauauaagacgugggcauaccauggcuccuaugaaguuaaagcuaccggcucugccucaagcaugauuaacggggucgugaagcuucugacuaaacccugggauguggucccuaugguuacacagauggcaaugaccgacacuacaccauucggacagcaacgcguguuuaaggagaaaguagauacccgaacacccagauccaugccggguacuaggcgggugaugggcauaaccgccgaaugguuauggcgcacgcuggggagaaauaagaagccuagguugugcacccgagaggaguucacaaaaaagguccggacuaacgcugccaugggagcgguguuuaccgaagagaaucagugggacagugcaaaagccgcuguugaagaugaggacuucuggaagcucguggaucgugaaagagagcugcacaaacuaggcaagugugguucuugcgucuacaacaugauggggaaacgcgagaagaagcuuggagaauuuggcaaagccaagggcagcagggcaaucugguacauguggcugggggcucgguaucucgaguucgaagcccugggauuuuugaaugaggaccauugguucucaagagagaacuccuacagugguguggaaggcgaggggcugcacaaacucggauauauucuucgcgauaucagcaagauucccggcggugcuauguacgccgacgacacagcagggugggauacuaggaucaccgaagacgaucugcauaaugaggaaaaaauaacgcagcagauggacccagagcaccgacaauuagcgaacgccaucuuuaagcugacauaucagaauaagguaguuaaagugcagcggccuacccccacuggaacagucauggauauuaucucuagaaaggaccagaggggcuccggccaaguggggaccuacggauugaacacuuucaccaauauggaggugcagcucauucgccagauggaaggugagggcguccugucaaaagcugaucuagaaaacccacaccuucccgagaagaaaaucacacaguggcuggaaacgaaggggguugagcgucuccggagaauggccauaagcggagacgauugcgugguaaagccuauugacgauagguuugcaaacgcucuguuggccuuaaaugacaugggcaaagugcgcaaggauaucccacaauggcagccgucgaaagguuggcaugacuggcagcagguccccuucuguucucaccauuuccacgagcugaucaugaaggacgggcgaaaacucgugguuccuugccggccacaagaugaacuuauuggaagagcaaggauaagucagggcgccggcuggucccugcgcgagaccgcgugucuagggaaggcuuaugcccagauguggagccugauguacuuucacagacgggaccucagguuggcaucaaacgccaucugcuccgcugugcccguccauugggugccuacuucucguacaaccuggagcauucacgcccaucaccaauggaugacuacagaagauaugcugaccguauggaaucgaguuuggaucgaggacaacccauggauggaagauaagacgcccgugacaaccugggagaaugucccuuaccuuggaaaacgcgaggaccaguggugugguagucugauuggccucacuuccagagcaaccugggcucagaacaucccgacagccauacagcaagugcggagcuuaaucgggaaugaagaguuccuggauuauaugccaucuaugaagagguuucgcaaagaagaggagucagaaggagcgauuugguga

SEQ ID NO: 15396 - RNA, 9873 nt, Artificial Sequence
  derived and/or modified CDS sequence (opt3) from DENV-3__EU482558__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcaagguagacaacuucacaauggggguguugugccucgccauccuguuugaagaggucaugcgcggaaaguucggcaaaaagcauaugaucgcagggguguucuuuaccuucguucuacugcucuccggacagauuacguggcgggauauggcucacacucugaucaugauuggcaguaauaccagcgacagaauggguaugggggugacauaccuugccuugauagcaaccuuuaaaauccagcccuuccuggccuuaggauuuuuccucaggaagcugacuucucgcgaaaaccuucugcuaggcgucggccucgcuauggcgacaacccugcaauugccggaggauauugaacagauggccaaugggaucgcacugggauuaauggcucucaaacugauuacacaguuugagacuuaucagcuuuggaccgcccugaucuccuugacguguucaaacacaauauucacccucacuguggccuggcgaaccgcuacacugauccuagcagguguuagucugcuuccugugugccaaagcucguccaugcggaagacugacuggcucccaaugaccgucgccgcgaugggcguacccccucugcccuuguuuauuuucucucugaaggauacguuaaaacguagaagcuggccacucaaugagggggugauggcuguuggacuggugucaauccuugccaguucccuguugaggaacgacgucccuauggcaggcccccucguggccggugggcugcuaauugcuuguuacguaaucacaggaaccucugcagaucugacuguggaaaaggccgcggacgucacaugggaggaagaggcugaacagaccggcguuagccauaaccuuaugauaacuguggacgaugacggcacaaugcgcauuaaagaugacgagaccgagaauauccucacggugcuguugaagacugccuuacugaucgucuccgggauuuuuccauacucaauaccggcaacccuccugguguggcacacauggcagaaacagacccaacggagcggaguucuuugggauguaccuagucccccagaaacacagaaggccgagcuggaagaggguguguauagaaucaaacagcagggcauuuucgggaagacucaagucggagugggcguucagaaggaggguguguuucauaccauguggcacgucacgaggggggcuguguugacauacaacggaaaacgacuagaacccaauugggccucuguaaagaaagaccugaucuccuauggcggcggguggcgccucagcgcacaguggcaaaagggagaggaaguccaggugauugcuguugagccugguaaaaacccaaagaauuuccagacuaugcccggcaccuuccagacaaccacuggggaaaucggagccauagcgcuggauuuuaagccuggcaccucggguucaccgaucauuaaccgggaggggaaaguggucggacuuuacggcaauggcgugguuacaaagaacgggggauaugugucugguaucgcccaaacgaaugcagagccagacggccccacuccugaauuagaggaagagauguucaaaaagagaaaccugaccauuauggaucuccacccagggaguggaaaaacaaggaaguacuugcccgcuaucguccgugaagccauaaagcgccggcugagaacccucauucuggcuccuacuagggugguagcagccgagauggaggaagcccuuaaaggccugccgauccgauaucagacaaccgcuacgaaguccgagcauacuggucgggaaaucguggacuugaugugccacgcgacauuuaccaugcgccuacugagccccguuagagucccaaauuacaaccucauuaucauggaugaggcacauuucaccgacccugccucuauagcugccaggggguacauuagcacucgggugggaaugggcgaagcagccgcuaucuuuaugacagcgacccccccaggcacagccgaugcauucccucaguccaaugcucccauucaggacgaggagcgagacaucccagaaagaucauggaacagugggaaugaguggauaacugauuuugccggaaaaacggugugguucgucccgagcauuaaggcagguaacgacaucgccaacuguuuacgcaaaaauggcaagaagguaauccaacugucuaggaaaaccuuugauacagaauaucagaagacuaaacuuaacgacugggauuucgugguuaccacagacauuuccgagaugggggcuaauuuuaaggccgaucgugugaucgacccucggagaugccugaaacccgucauucucaccgauggaccagagagggugauauuggcgggccccaugccuguuacugcagccucagcugcccagcgccgagguagaguggggcggaacccacagaaggaaaaugaccaauacaucuucacgggccagccccugaacaaugaugaggaccacgcucauuggaccgaagcaaagaugcuccuggacaacauuaauacaccugagggaaucaucccggcccuuuucgaaccagagagggagaaaagugcugccauugauggcgaauaucgccuaaagggggagagccguaaaacuuuugucgaacugaugagacggggagacuugcccgugugguuagcacacaagguagcguccgaggguauaaaauacaccgauaggaaguggugcuucgacggccagcgcaacaaucagauccuggaagagaacauggauguggagauuuggacaaaagaaggggagaagaagaaacuccgaccuagauggcuggacgcccggaccuauucugauccccuugcucugaaggaauuuaaagacuucgccgcaggaaggaagucgaucgcucucgauuugguuacugagauuggccgcgucccaagccaccuggcccauagaacaaggaaugcacuagacaaccuggugaugcuccacacgucagaacauggugggaaagccuaccggcacgcuguggaggagcuuccugaaaccauggagacucuguuauugcugggccucaugauccugcuuacaggaggcgcgaugcuguuucucauauccgggaagggaaucgguaagaccaguauuggcuugaucugugucauugccucuagcgggaugcuguggauggcagaaauccccuuacaauggauagcuuccgccauuguucuagaguucuuuaugauggugcugcucaucccagagccugaaaaacagcguaccccgcaggauaaucaacuugccuauguagugauuggaauccugacauuggcagcuauaaucgccgcgaacgagaugggccugcucgaaacuacgaagcgcgaccuggguaugucaaaagagcccggggucgugucuccaaccagcuaccuugauguugaccuccacccugcuagugccuggacacuguacgcaguggccacuaccgucauuacacccauguugcgacauaccaucgaaaauuccacugcuaacguaagccuggcagccauugcgaaccaggcugugguuuuaaugggccuagacaagggauggccaaucucuaaaauggaucugggcgugccucuccuugcccuggggugcuauucacaggucaaucccuugacgcugacagcagccgugcuccugcuuauaacccacuacgcuauuaucggaccgggcuuacaggccaaggcaacuagagaggcucaaaagaggaccgccgcggguaucaugaaaaacccaacagucgacgggauuaugacuaucgaucuggacccugugauauaugauuccaaguucgagaaacagcucggacagguuauguugcuggugcuaugugccguacagcugcuccuuaugcggaccaguugggcacugugcgaagcuuugacacuggccacgggccccauuaccacucucugggaggguagcccaggcaaguuuuggaauacaaccaucgcagugucgauggcuaacauuuuccgcgggucuuaccuggccggagccggcuuagcguuuuccaucaugaaaagcgucgggacuggaaagagaggcacagguucacaaggggaaacccuuggagagaaguggaaaaagaaacugaaucagcucaguaggaaggaauucgaccuauauaaaaagucuggcauaacggagguugaucggaccgaggcuaaagaaggucugaagcgaggcgagaucacacaucacgcaguguccagagggagcgccaaguugcagugguuugucgaacgcaacauggugauucccgagggaaggguaaucgaccugggcugugggcggggaggcuggucauacuauugcgcuggucucaaaaaggugacugaaguucguggguacaccaaaggaggcccuggccaugaggagccggugcccaugaguacauacggguggaauauugucaagcuuaugagcggaaaagauguguucuaucugccaccugaaaagugugacacuuugcugugcgauaucggugaguccucucccagcccuaccgucgaagaguccagaacaauuagggugcucaagaugguugagccaugguuaaaaaacaaucaguucuguaucaagguacugaaccccuacaugccuaccgugauagaacaccuugagcgccugcaacggaaacacggcgggaugcuaguccgaaauccacucucaagaaacucuacucaugaaauguauuggauuaguaauggaacgggcaacaucguggccucgguuaauauggugagcaggcuguugcugaaccgcuuuacaaugacccaccggagacccacuaucgagaaggacgucgaucucggugcagggacccgucaugugaacgccgaaccggagacaccuaauauggacguaauuggagagaggauaaaacggaucaaggaagagcacaacuccacguggcacuacgacgaugaaaauccauauaagaccugggcuuaccauggcucuuaugaggugaaagcgacuggcucagccagcuccaugauuaacgggguugucaagcuucugacaaaacccugggacguggugccuauggucacccagauggcaaugacugauacaaccccauucggacagcaacgcguuuuuaaggaaaaaguggacacacgaacucccagaaguaugccggguaccaggcggguaaugggcaucacggcugagugguuauggcgcacccuggggagaaauaagaagccuagguugugcacacgagaggaauucacuaaaaaggugcggaccaacgccgcaaugggagccgucuuuacagaggaaaaucagugggauucugcuaaagccgcgguggaggacgaagauuucuggaagcucguugaccgugagagagagcugcacaaacuaggcaagugugguagcugcguguacaacaugauggggaaacgcgaaaagaagcuuggagaguuuggcaaagcaaagggcucaagggccauuugguacauguggcugggggcucgguaucucgaauucgaggcccugggauuuuugaaugaggaucauugguucuccagagaaaacaguuacagcggugucgagggcgaagggcugcacaaacucggauauauccuucgcgacauaucuaagauccccggcggugcaauguacgcugaugacacugccgggugggacaccaggauuacggaggaugaccugcauaaugaagagaaaaucacacagcagauggauccagagcaccgacaauuagcuaacgccauuuuuaagcugaccuaucagaauaaggugguaaaaguucagcggccuacucccacaggaaccgugauggacaucauauccagaaaggaucagaggggcucaggccaagucgggacuuacggauugaacaccuucacaaauauggaagcacagcucauucgccagauggagggugaaggcgugcugagcaaagcggaccuagagaacccacaccuucccgaaaagaaaaucacgcaguggcuggagaccaaggggguggagcgucucaagcggauggccaucucgggagaugacugcgucguuaaaccuauugaugacagauuugcuaacgcccuguuggcauuaaaugauaugggcaaggugaggaaagacauaccacaauggcagccgucuaaggguuggcaugauuggcagcagguacccuucuguagucaccauuuccacgaacugaucaugaaagacgggcgcaagcucguggucccuugccgaccacaagacgagcuuauuggacgggcuagaaucucccagggcgccggcuggagccugagggaaacugcaugucuagggaaggccuaugcgcagauguggucacugauguacuuucaccgcagagaucuccgguuggcuuccaacgccauuugcucugcagugcccguucauugggugccuacaagcaggaccacuuggaguauccacgcccaucaccaauggaugacaaccgaggacaugcugacggucuggaaucguguguggauagaagauaacccauggauggaggacaaaacacccguaaccacuugggagaauguuccuuaccuuggaaagcgagaagaucaguggugugguucccugaucggccucaccagccgcgcuacaugggcccagaacauuccgacugcaauccagcaagugagaucuuuaauugggaaugaggaauuccuggacuauaugccaucaaugaaacgguuuaggaaggaggaggaaagugagggagcuaucugguga

SEQ ID NO: 15397 - RNA, 9873 nt, Artificial Sequence
  derived and/or modified CDS sequence (opt3) from DENV-3__EU482563__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauugcugaaguugagccggaagacaucgauugcugguguaaccugacuaguaccugggugacauaugggaccugcaaucaggccggagagcaccgccgagacaagcguagcguagcacuugccccccaugugggcaugggucuggauacuagaacacaaaccuggauguccgcugagggggcauggaggcaggucgaaaaaguggagacgugggccuugcggcacccuggauucacuauucucgcucuguuucuggcccauuacaucggcaccucucucacacagaagguugugauauucgucuuacugaugcuugugacuccaucgaugaccaugcgcuguguaggcguugggaacagagacuuuguggaaggauugucaggugcgacaugggucgauguggugcuggagcacggcgggugcgucaccacgauggcaaagaauaaacccacucuagacaucgagcuccagaagacagaagccacccaacuggcuacucuuaggaaacuguguauugagggaaagaucacaaacauuaccacggauagccggugcccuacccagggcgaagccguuuugccagaggaacaggaccagaauuauguguguaaacacacauacguagaucgcgguugggggaacggaugcggccucuucggcaaggggagucuggugacuugcgcaaaguuucaauguuuagagcccaucgagggaaaagucgugcaguaugaaaaucugaaguacaccguuauaauuacagugcauacuggugaccagcaccaggucggcaacgagacccaaggggugacagcugaaaucaccccucaggccuccacuacggaggcgauucucccagaauauggaacacuuggccuggagugcucuccgcgaaccgguuuggacuucaaugagaugauccuacugacuaugaaaaacaaggccuggaugguacauagacagugguuuuucgaucucccccugccuuggaccagcggggcaacaaccgaaacuccaacauggaauaggaaagagcuucugguuacguuuaagaacgcucacgccaaaaagcaagaaguggucguguugggcucccaggagggagcuaugcacaccgcccucacuggcgcaacagaaauccagaauucagggggaaccaguauuuucgccggucaucugaagugucgguuaaaaauggacaagcuggagcuaaaaggcaugagcuacgcuaugugcacaaacacuuuuguccucaagaaagaggugucugaaacccagcacgggacgauacugaucaagguugaguacaagggagaagaugcgcccuguaaaauuccuuucuccaccgaggacggccaagguaaggcacauaacgggcgucuuaucacagccaauccagugguaacuaaaaaggaggaacccgucaacauagaggcugaaccgccuuucggcgagucaaauauugugaucggaaucggcgauaacgccuugaaaauuaauugguauaagaaggggagcaguaucggaaaaauguuugaagcaaccgcccgcggugcuagaaggauggccauucugggcgacacagcaugggauuucgggucuguuggaggcgugcucaacucccuggguaagaugguccaccagauauuugggagcgcguacacugcucuuuucucgggcgugucuuggguaaugaaaaucggaauuggcgugcuguugaccuggaucgggcucaauuccaagaacacgucaaugaguuuuagcugcaucgccauuggaauaaucacacuguauuuaggcgcaguuguccaggccgacaccgguugugugauuaauuggaaagggaaggagcugaagugcggauccggcaucuucgugacuaacgagguccauacauggaccgaacaguacaaauuucaagcugauucucccaagcggcuagccacugcaauugcuggugccugggagaauggcguuugugggauccgaagcaccacacgcauggaaaaccuccuguggaaacagguggcgaaugagcuuaacuauauauugugggaaaauaacaucaagcugacggugguagucggagacauuaucggcgugcucgagcaggggaaaagaacccugacuccacagccuauggaguuaaaguacucauggaaaacauggggaaaggccaagauuguuaccgcugaaacacaaaacaguuccuucaucauagauggccccaauacuccagagugccccagcgcaucuagggccuggaacgugugggaagucgaggacuaugguuuugggguguucaccacgaauauuuggcugaaacuucgggaaguuuacacacaguugugugaccaccgccucaugucagcugccgugaaggaugagagagcaguacacgcggacaugggauacuggaucgagagucagaaaaacggcagcuggaagcuggaaaaagccucccuaauugaggucaagaccugcacuuggccuaagucucauacccuguggucgaauggugugcucgaaagcgauaugaucauaccaaaaucccuggcuggcccgaucucacagcacaacuauaggcccggguaccauacacaaacugccggaccuuggcaccuuggcaaguuggagcuggacuuuaauuauugcgaggggaccacaguggucauuacggaaaacuguggaacccguggcccaaguuuacggacuacaaccguuucugguaaacucauccacgaguggugcugucgaagcugcacucugcccccucuuagauacaugggggaagauggauguugguauggcauggagauuaggccaaucuccgaaaaggaggagaauauggugaaaucacugguaagcgcagguucuggcaagguggacaacuucacaaugggggucuugugccucgcuauacuguuugaagaggugaugcgcggaaaguucggcaaaaagcauaugauugccgggguuuucuuuaccuucgugcuacugcucuccggacagaucacguggcgggauauggcacacacucugaucaugauuggcaguaaugccagcgacagaauggguaugggggucaccuaccuugcuuugaucgcgacauuuaaaauucagcccuuccuggccuuaggauuuuuccucaggaagcugaccucucgcgaaaaccuucugcuaggcgugggccucgcaauggcuacuacacugcaauugccggaggauauagaacagauggccaaugggaucgcccugggauuaauggcucucaaacugauuacccaguuugagacauaucagcuuuggacugcacugaucuccuugaccuguucaaacacgauuuucacacucaccguugccuggcgaacugcgacccugauccuagcuggugugagucugcuuccugucugccaaagcucguccaugcggaagucugacuggcucccaaugacaguagccgcaaugggcgugcccccucugcccuuguuuauauucagccugaaggauacuuuaaaacguagaucauggccacucaaugaggggguuauggccgugggacuggucaguauccuugcuuccucucuguugaggaacgacgugccuauggcaggcccccucguagccggugggcugcuaauugcguguuacgugaucaccggaacgagcgcugaucugacagucgaaaaggccgcagacguuaccugggaggaagaggccgaacagacuggcgugucccauaaccuuaugauuacaguggacgaugacggcaccaugcgcaucaaagaugacgagacugagaauauacucacaguccuguugaagaccgcuuuacugauugugucagggaucuuuccauacagcaucccggccacgcuccugguuuggcacacuuggcagaaacagacccggagaaguggaguacuuugggaugugccuucucccccagaaacacaaaaggcagagcuggaagagggugucuauaggauuaaacagcagggcauauucgggaagacccaggugggaguuggcgugcaaaaggagggugucuuucauacaauguggcacgugacucgaggggcuguauugaccuacaacggaaaacgccuagaacccaauugggccuccgucaagaaagaccugaucagcuauggcggcggguggcggcucucggcgcaguggcagaagggagaggaagugcaaguuauugccguggagccugguaaaaacccaaagaauuuccagacgaugcccggcacauuccagacuaccacaggggaaaucggagcaauugcucuggauuuuaagccuggcaccucagguucuccgaucauaaacagagaggggaaagucgugggacuuuacggcaauggcguugugacuaagaacgggggauaugucagugguaucgcccagaccaaugcugagccagacggccccacaccugaauuagaggaagagauguucaaaaagaggaaccugacgauuauggaucuccacccaggguccggaaaaacucguaaguacuugcccgcaaucgugcgcgaagccauuaagcggagacugaggacccucauccuggccccuacacgaguaguggcugcggagauggaggaagcacuuaaaggccugccgauacgguaucaaaccacugccacaaagagcgagcauaccggucgcgaaauuguugacuugaugugccacgcuacguuuacuaugagacuacugucucccgucagggugccaaauuacaaccucaucaucauggaugaggcccauuucacagacccugcaagcauugccgcucggggguacaucuccacccgagugggaaugggcgaagcggccgcaauauuuaugaccgcuacucccccaggcacagccgaugcauucccucagucaaaugcccccauucaggacgaggagagagacaucccagaacgcaguuggaacagcgggaaugaguggauuaccgauuuugcuggaaaaacagucugguucguaccgucuaucaaggccgguaacgacauagcgaacuguuuaaggaaaaauggcaagaaggugauucagcugucccguaaaacuuuugauacggaauaucaaaagaccaaacuuaacgacugggauuucguugugacaacugacaucucagagaugggggcaaauuuuaaggccgaucgggucaucgacccuagaaggugccugaaacccgugauucucaccgauggaccagagcgcguuaucuuggcuggccccaugccugugacagccgcuagugcagcccagcgaagaggucgggucgggaggaacccacagaaggaaaaugaccaguacauuuucaccggccaaccccugaacaaugaugaggaccacgcucauuggacugaagccaagaugcuccuggacaacauaaauacgccugagggaaucauuccggcacuuuucgaaccagagcgcgagaaaagcgcggccaucgauggcgaauaucgucuaaagggggaguccagaaaaaccuuuguggaacugaugcggaggggagacuugcccguaugguuagcucacaagguggccucugaggguaucaaauacacagaucgcaaguggugcuucgacggccagcgaaacaaucagauucuggaagagaacauggauguugagauauggacuaaagaaggggagaagaagaaacucagaccucgguggcuggacgcaaggaccuauucggauccccuugcucugaaggaauuuaaagacuucgccgcaggacgcaagagcaucgcccucgauuuggucacagagauuggcagagugccaucacaccuggcucauaggacccggaaugcgcuagacaaccuggugaugcuccacacuuccgaacauggugggaaagccuaccgucacgcagucgaggagcuuccugaaacaauggagacgcuguuauugcugggccucaugauccugcuuaccggaggcgcuaugcuguuucucauuagugggaagggaaucgguaagacuucuauaggcuugaucuguguuauugccagcuccgggaugcuguggauggccgaaauccccuuacaguggauugcaucagcuaucgugcuagaguucuuuaugaugguacugcucauaccagagccugaaaaacaacgcacaccgcaggauaaucagcuugccuauguggucauuggaauccugaccuuggcggcuauuaucgccgcaaacgagaugggccugcucgaaaccacaaagcgagaccuggguaugucuaaagagcccggggugguuagcccaacuaguuaccuugauguggaccuccacccugccuccgcuuggacgcuguacgcagucgccaccacaguaauaacucccauguugagacauaccaucgaaaauagcacagcgaacgugucucuggcugccauugcaaaccaagccguuguguuaaugggccuagacaagggauggccaaucucaaaaauggaucugggcgucccucuccuugcucuggggugcuauucccaggugaaucccuugacccugacugccgcaguccuccugcuuauuacgcacuacgcuaucauaggaccgggcuuacaggccaaggcgacaagggaggcccagaagcggaccgcagcugguauuaugaaaaacccaacuguggacgggaucaugaccaucgaucuggacccuguuauuuaugauaguaaguucgagaaacaacucggacaggugauguugcugguacuaugugccgugcagcugcuccuuaugcgcacaagcugggcacugugcgaagcuuugacucuggccaccggccccaucacaacgcucugggaggguucgccaggcaaguuuuggaauaccacuauagccgucucuauggcgaacauuuucagaggguccuaccuggcuggagcaggcuuagccuuuagcaucaugaaaucaguugggacaggaaagaggggcaccgguagucagggggaaacucuuggagagaaguggaaaaagaaacugaaucaacucucucggaaggaauucgaccuauauaaaaaguccggcauuacagagguggaucgaaccgaggcuaaagaaggucugaagagaggcgagaucacgcaucacgccgucagccgcgggucagcaaaguugcagugguuuguggaaaggaacaugguaauacccgagggacgggugaucgaccugggcugugggcguggaggcuggaguuacuauugcgccggucucaaaaagguuaccgaagugagaggguacacaaaaggaggcccuggccaugaggagccgguccccaugagcacuuacggguggaauauugugaagcuuauguccggaaaagaugucuucuaucugccaccugaaaagugugacaccuugcugugcgauaucggugagucuagccccuccccuacaguggaagagucaaggacuauucgcguucucaagaugguagagccaugguuaaaaaacaaucaguucuguaucaaggugcugaaccccuacaugccuaccgucauugaacaccuugagcggcugcagcgaaaacacggcgggaugcuagugagaaauccacucucuaggaacaguacacaugaaauguauuggaucucgaauggaaccggcaacauaguugcuagcgugaauauggucucccgccuguugcugaaccgguuuacuaugacgcacagacgucccacaauugagaaggacguggaucucggugcggggaccaggcauguaaacgccgaaccggagacuccuaauauggacgugaucggagagcggaucaaacgcauuaaggaagagcacaacucuaccuggcacuacgacgaugaaaauccauauaagacaugggcauaccauggcucauaugagguuaaagcuacgggcagcgccuccaguaugauaaacggggucgugaagcuucugaccaaacccugggacguggucccuaugguuacucaaauggcaaugacagauaccacuccauucggacagcagcgaguguuuaaggaaaaaguagacacaagaacccccaggucuaugccggguacacggcgcgugaugggcaucacugccgagugguuauggagaacccuggggaggaauaagaagccucgauugugcacgcgggaggaauucaccaaaaagguccguacaaacgcugccaugggagcgguguuuacugaggaaaaucaaugggauagcgcaaaagccgcuguugaggacgaagauuucuggaagcucguggacagagagcgcgagcugcacaaacuaggcaagugugguucaugcgucuacaacaugauggggaaaagggaaaagaagcuuggagaguuuggcaaagccaagggcucccgggcaauuugguacauguggcugggggcuagauaucucgaauucgaggcccugggauuuuugaaugaggaucauugguucagucgcgaaaacagcuacucugguguggagggcgaagggcugcacaaacucggauauauccuuagggacauuuccaagauccccggcggugcuauguacgccgaugacaccgcagggugggacacacgaauaacugaggaugaccugcauaaugaagagaaaaucacccagcagauggauccagagcaccggcaguuagcgaacgccauuuuuaagcugacguaucaaaauaagguaguuaaagugcagagaccuacacccaccggaacugucauggacaucauuucaaggaaggaucagcgcggcagcggccagguggggacauacggauugaacaccuucacuaauauggaagcucaacucauccgucagauggagggugaaggcgugcugaccaaagccgaccuagagaacccacaccuuucggaaaagaaaauaacacaguggcuggagacgaagggggucgagcggcucaagagaauggcaauuucuggagaugacugcguugugaaacccaucgaugacagguuugcuaacgcccuguuggcauuaaaugauaugggcaagguacgcaaagacaucccucaguggcaaccaaguaaggguuggcaugauuggcagcaggugccguucuguucccaccauuuccacgaacugauuaugaaagacgggcgaaagcucgucgugcccugccggccucaggacgagcuuauaggaagagccaggaucagccaaggcgcgggcuggucacugcgcgaaaccgcuugucuagggaaggccuaugcacagauguggucccugauguacuuucacagacgggaucucagguuggccucuaacgcuauuugcagcgccguuccagugcauuggguccccacuagucguacaaccugguccauccacgcacaucaccaguggaugacuacagaggacaugcugaccguguggaaucgaguauggauugaagauaacccuuggauggaggacaaaacgccaguuacaaccugggagaaugugcccuaccuuggaaagcgcgaagaucaauggugugguagccugaucggccucacuucuagagcuaccugggcccagaacauaccuacagcgauccagcagguccggucauuaauugggaaugaggaauuccuggacuauaugccgaguaugaaaagguuucgcaaggaggaggaauccgagggagcuaucugguga

SEQ ID NO: 15398 - RNA, 9873 nt, Artificial Sequence
  derived and/or modified CDS sequence (opt3) from DENV-3__EU529696__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggagugaucacccuguauuuaggcgccguuguccaggcagacauggguugugugauuaauuggaaagggaaggagcugaagugcggauccggcaucuucgugacuaacgagguccauacauggaccgaacaguacaaauuucaagccgauucucccaagcggcuagcuacugccauugcaggugcuugggagaauggcguuugugggauccgaagcaccacacgcauggaaaaccuccuguggaaacagauagccaaugagcuuaacuauaucuugugggaaaauaacauuaagcugacgguggugguaggagacaucauuggcguccucgagcaggggaaaagaacccugacuccacagccuauggaguuaaaguacucauggaaaacauggggaaaggcgaagaucgugaccgccgaaauacaaaacaguuccuucauuaucgauggccccaauacaccagagugccccagcgcuucuagggcauggaacguuugggaaguggaggacuaugguuuuggggucuucacuaccaauauuuggcugaaacuucgggaaguguacacgcaguugugugaccaccgccucaugucagccgcuguuaaggaugagagagccgugcacgcagacaugggauacuggaucgagagucagaaaaacggcagcuggaagcuggaaaaagcgucccuaauagagguaaagacaugcaccuggccuaagucucauacucuguggucgaaugguguccucgaaagcgauaugaucauuccaaaaucccuggccggcccgaucucacagcacaacuauaggcccggguaccauacccaaacagcuggaccuuggcaccuuggcaaguuggaccuggauuuuaauuauugcgaggggacuaccguggugauuacagagaacuguggaacgcguggcccaaguuuacggaccacuacagucucugguaaacucauccacgaauggugcugucgaagcugcacccugcccccucuuagauacaugggggaggacggauguugguauggcauggaaauaaggccaauuuccgagaaggaagagaauaugguuaaaucacuggugagcgccgguucuggcaagguagauaacuucacuauggggguguugugccucgcaauccuguuugaggaagucaugcgcggaaaguucggcaaaaagcauaugaucgcugggguguucuuuacauucguucuacugcucuccggacagauuaccuggcgggacauggcccacacgcugaucaugauuggcaguaaugcaagcgauaaaauggguaugggggugacuuaccuugccuugauagcuaccuuuaagauccagcccuuccuggcguuaggauuuuuccucagaaaacugacaucuagggagaaccuucugcuaggcgucggccucgccauggcaaccacucugcaauugccggaagacauugagcagauggcuaaugggaucgcccugggauuaauggcccucaagcugauuacacaguuugaaaccuaucagcuuuggacagcucugaucuccuugacuuguucaaacaccauguucacgcucacaguggcauggcgcaccgccacucugauacuagcggguguuagucugcuuccugugugccaaagcucguccaugcgaaagaccgauuggcucccaauggcugucgccgcaaugggcguacccccucugcccuuguuuaucuucucucugaaagacacauuaaagcggcguagcuggccacucaaugagggggugauggccguuggacuggugucaauucuugcuaguucccuguugagaaacgaugucccuauggcaggcccccucguggccggugggcugcuaaucgcguguuacguaauuacuggaaccucugcugaccugacgguggagaaagccgcagacaucacaugggaagaggaagccgagcagaccggcgucagccauaaccuuaugauaacuguugaugacgauggcacaaugaggauuaaggacgaugaaaccgagaauauccucacugugcuguugaaaacagcuuuacugaucguguccggggucuuuccauacucaauuccggccacccuccugguguggcacacguggcagaagcagacucaacgcagcggaguucuuugggacguaccuagucccccagagacccagaaagcagaacuggaggaagguguguaucggauaaagcagcagggcaucuucgggaagacacaagucggagugggcguucagaaagaggguguguuucauaccauguggcacgucacaagaggggcuguguugacuuacaacggaaagaggcuagagcccaauugggccucuguaaaaaaggaucugauuuccuauggcggcggguggcgacucagcgcgcaguggcaaaaaggagaagagguccaggugaucgccguugaaccugguaagaacccaaagaauuuccagaccaugcccggcacguuccagacaacuaccggggagauuggagcaaucgcucuggacuuuaaaccuggcacaucggguucaccgauaaucaaccgcgaagggaagguggucggacuuuacggcaauggcgugguuaccaaaaacgggggauaugugucugguauugcccaaacuaaugcugagccagauggccccaccccugaguuagaagaggaaauguucaagaaacggaaccugacaaucauggaccuccacccagggaguggaaagacgagaaaguacuugcccgcagucgugagggaggccauuaaacgucgccugcggacucucauccuggccccuaccagaguaguggcugcggaaauggaggaggcacuuaagggccugccgauaagguaucagacaaccgccacuaaauccgaacauacaggucgagagauuguugauuugaugugccacgcuaccuuuacgaugcggcuacugagccccguccgcgugccaaauuacaaccucaucaucauggacgaagcccauuucacugauccugcaucuauugccgcuagaggguacaucagcacaagggugggaaugggcgaggcggccgcaauauuuaugaccgcuacccccccaggcacugccgacgcauucccucaguccaaugcccccauucaggacgaagagcgggauaucccagagcgaucauggaacagugggaaugaauggauuacagacuuugcuggaaagaccgucugguucguaccgagcaucaaagccgguaacgauauagcgaacuguuuaagaaagaauggcaagaaagugauucaacugucucgcaagacauuugacacugaguaucagaaaacgaagcuuaacgauugggacuucguugugaccacagauaucuccgaaaugggggcaaauuuuaaagccgacagggucaucgauccucgucggugccugaagcccgugauucucacugacggaccagagagaguuaucuuggcuggccccaugccugugaccgccgcuucagcagcccagaggcgcggucgagucgggagaaacccacagaaggagaaugaucaauacauuuucacaggccagccccugaacaaugacgaagaccacgcucauuggaccgaggccaaaaugcuccuggauaacauaaauacuccugaaggaaucauuccggcacuuuucgagccagaacgggagaagagugcggccaucgacggcgaguauaggcuaaaaggggaaagccgcaagacguuuguggagcugaugcguagaggagauuugcccguaugguuagcucacaaaguggccuccgaagguaucaaguacaccgaccggaaauggugcuucgauggccagaggaacaaucagauucuggaggaaaacauggacguugagauauggacaaaggagggggaaaagaaaaagcuccgcccucgauggcuggaugcaagaacuuauucugacccccuugcucugaaagaguuuaaggauuucgccgcaggacggaaaucgaucgcccucgacuuggucaccgaaauuggcagggugccaagccaccuggcucaucgcacaagaaaugcgcuagauaaccuggugaugcuccacaccucagagcauggugggagggccuaccggcacgcagucgaagagcuuccugagacuauggaaacacuguuauugcugggccucaugauccugcuuacgggaggcgcuaugcuguuucucauuuccgggaagggaaucgguaagaccaguauaggcuugaucuguguuauugccucuagcgggaugcuguggauggccgagauccccuuacaauggauugcauccgcuaucgugcuagaauucuuuaugaugguacugcucauaccagagccugagaaacagcguacuccgcaggacaaucaacuugccuauguggucauuggaauccugacauuggcggcuauuaucgccgcaaacgaaaugggccugcucgagaccaccaagcgcgaucuggguaugucaaaagaacccggggugguuucuccaacaagcuaccuugacguggaccuccacccugccagugcuuggacucuguacgcagucgccacgaccguaauaacacccauguugcgacauacuaucgagaauuccaccgcgaacgugagccuggcugccauugcaaaccaggccguuguguuaaugggccuagauaagggauggccaaucucuaaaauggaccugggcgucccucuccuugcucuggggugcuauucacaggugaaucccuugacacugaccgccgcaguccuccugcuuauuacucacuacgcuaucauaggaccgggcuuacaggccaaggcgacgagagaagcccaaaagaggacagcagcugguauuaugaaaaacccaaccguggaugggaucaugacuaucgaccuggauccuguuauuuaugacuccaaguucgagaaacagcucggacaggugauguugcugguacuaugugccgugcagcugcuccuuaugcggaccaguugggcacugugcgaggcuuugacacuggccacuggccccaucaccacacucugggaagguagcccaggcaaguuuuggaauacgaccauagccgucucgauggcgaacauuuuccgcgggucuuaccuggcuggagcaggcuuagccuuuuccaucaugaaaagcguugggacuggaaagagaggcacagguucacaaggggagacccuuggagaaaaguggaaaaagaaacugaaucagcucaguaggaaggaguucgaucuauauaaaaagucuggcauuacugaaguggaccggacagaggcuaaagagggucugaagcgaggcgaaaccacgcaucacgccgucuccagagggaccgcaaaguugcagugguuuguggagcgcaacaugguaauccccgaaggaagggugauagaucugggcugugggcggggaggcuggagcuacuauugcgccggucucaaaaagguuacagaggugcguggguacacuaaaggaggcccuggccaugaagagccgguccccaugucaaccuacggguggaauaucgugaagcuuaugaguggaaaagacgucuucuaucugccaccugagaagugugauacauugcugugcgacauuggugaaagcucccccucuccuacuguggaggaaagcagaaccaucaggguucucaagaugguagagccaugguuaaaaaacaaucaguucuguauuaaggugcugaaccccuacaugccuacagucaucgagcaccuugaacgccugcaacggaaacacggcgggaugcuagugcgaaauccacucuccagaaacucaacccaugagauguauuggauuucuaauggaacuggcaacaucguugcuagugugaauauggucucgaggcuguugcugaaccgcuuuacgaugacacaccggagacccaccauagaaaaggauguggaccucggugcggggacucgucauguaaacgccgagccggaaaccccuaauauggacgugauuggagagaggaucaaacggaucaaggaggaacacaacagcacauggcacuacgaugacgagaauccauauaagacgugggcauaccauggcuccuaugaaguuaaagcuaccggcucugccucaagcaugauuaacggggucgugaagcuucugacuaaacccugggauguggucccuaugguuacacagauggcaaugaccgacacuacaccauucggacagcaacgcguguuuaaggagaaaguagauacccgaacacccagauccaugccggguacuaggcgggugaugggcauaaccgccgaaugguuauggcgcacgcuggggagaaauaagaagccuagguugugcacccgagaggaguucacaaaaaagguccggacuaacgcugccaugggagcgguguuuaccgaagagaaucagugggacagugcaaaagccgcuguugaagaugaggacuucuggaagcucguggaucgugaaagagagcugcacaaacuaggcaagugugguucuugcgucuacaacaugauggggaaacgcgagaagaagcuuggagaauuuggcaaagccaagggcagcagggcaaucugguacauguggcugggggcucgguaucucgaguucgaagcccugggauuuuugaaugaggaccauugguucucaagagagaacuccuacagugguguggaaggcgaggggcugcacaaacucggauauauucuucgcgauaucagcaagauucccggcggugcuauguacgccgacgacacagcagggugggauacuaggaucaccgaagacgaucugcauaaugaggaaaaaauaacgcagcagauggacccagagcaccgacaauuagcgaacgccaucuuuaagcugacauaucagaauaagguaguuaaagugcagcggccuacccccacuggaacagucauggauauuaucucuagaaaggaccagaggggcuccggccaaguggggaccuacggauugaacacuuucaccaauauggaggcucagcucauucgccagauggaaggugagggcgugcugucaaaagccgaucuagaaaacccacaccuucccgagaagaaaaucacacaguggcuggaaacgaagggggucgagcgucuccggagaauggcaauaagcggagacgauugcguugugaagccuauugacgauagguuugcuaacgcccuguuggcauuaaaugacaugggcaaaguacgcaaggauaucccacaauggcagccgucgaaagguuggcaugacuggcagcaggugcccuucuguucucaccauuuccacgagcugaucaugaaggacgggcgaaaacucgucgugccuugccggccacaagaugaacuuauuggaagagccaggauaagucagggcgcgggcuggucccugcgcgagaccgcuugucuagggaaggccuaugcacagauguggagccugauguacuuucacagacgggaccucagguuggccucaaacgcuaucugcuccgccguucccgugcauugggucccuacuucucguacaaccuggagcauucacgcacaucaccaauggaugacuacagaagauaugcugaccguguggaaucgaguauggaucgaggacaacccauggauggaagauaagacgcccguuacaaccugggagaaugugccuuaccuuggaaaacgcgaggaccaguggugugguagucugauuggccucacuuccagagcuaccugggcccagaacaucccgacagcgauacagcaaguccggagcuuaaucgggaaugaagaguuccuggauuauaugccaucuaugaagagguuucgcaaagaagaggagucagaaggagcuauuugguga

SEQ ID NO: 15399 - RNA, 9873 nt, Artificial Sequence
  derived and/or modified CDS sequence (opt3) from DENV-3__EU529697__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauugcugaaguugagccggaagacaucgauugcugguguaaccugacuaguaccugggugacauaugggaccugcaaucaggccggagagcaccgccgagacaagcguagcguagcacuugccccccaugugggcaugggucuggauacuagaacacaaaccuggauguccgcugagggggcauggaggcaggucgaaaaaguggagacgugggccuugcggcacccuggauucacuauucucgcucuguuucuggcccauuacaucggcaccucucucacacagaagguugugauauucgucuuacugaugcuugugacuccaucgaugaccaugcgcuguguaggcguugggaacagagacuuuguggaaggauugucaggugcgacaugggucgauguggugcuggagcacggcgggugcgucaccacgauggcaaagaauaaacccacucuagacaucgagcuccagaagacagaagccacccaacuggcuacucuuaggaaacuguguauugagggaaagaucacaaacauuaccacggauagccggugcccuacccagggcgaagccgcauugccagaggaacaggaccagaauuauguuuguaaacacacauacguggaucgcgguugggggaacggaugcggccucuucggcaaggggagucugguaacuugcgcuaaguuucaauguuuagagcccaucgagggaaaagugguccaguaugaaaaucugaaguacaccgugauaauuacaguucauacuggugaccagcaccaggugggcaacgagacccaaggggucacagccgaaaucaccccucaggcguccacuacggaggccauucucccagaauauggaacacuuggccuggagugcucuccgcgaaccgguuuggacuucaaugagaugauccuacugacuaugaaaaacaaggcauggauggugcauagacagugguuuuucgaucucccccugccuuggaccagcggggcuacaaccgaaacuccaacauggaauaggaaagagcuucugguaacguuuaagaacgcccacgcuaaaaagcaagaaguuguggucuugggcucccaggagggagccaugcacaccgcacucacuggcgccacagaaauccagaauucagggggaaccaguauuuucgcuggucaucugaagugucgguuaaaaauggacaagcuggagcuaaaaggcaugagcuacgcgaugugcacaaacacuuuugugcucaagaaagaggucucugaaacccagcacgggacgauacugaucaagguggaguacaagggagaagaugcacccuguaaaauuccuuucuccaccgaggacggccaagguaaggcccauaacgggcgucuuaucacagcuaauccaguugugacuaaaaaggaggaacccguaaacauagaggccgaaccgccuuucggcgagucaaauauugucaucggaaucggcgauaacgcauugaaaauuaauugguauaagaaggggagcaguaucggaaaaauguuugaagccaccgcucgcggugccagaaggauggcaauucugggcgacacagcgugggauuucgggucugugggaggcguucucaacucccuggguaagauggugcaccagauauuugggagcgcuuacacugcccuuuucucgggcgucucuugggugaugaaaaucggaauuggcguacuguugaccuggaucgggcucaauuccaagaacacgucaaugaguuuuagcugcaucgcaauuggaauaaucacacuguauuuaggcgccgugguucaggcugacaccgguugugucauuaauuggaaagggaaggagcugaagugcggauccggcaucuucgugacuaacgaggugcauacauggaccgaacaguacaaauuucaagccgauucucccaagcggcuagcaacugcuauugccggugcgugggagaauggcgucugugggauccgaagcaccacacgcauggaaaaccuccuguggaaacagguugccaaugagcuuaacuauauauugugggaaaauaacaucaagcugacgguggugguaggagacauuaucggcguccucgagcaggggaaaagaacccugacuccacagccuauggaguuaaaguacucauggaaaacauggggaaaggcuaagauugugaccgcagaaacacaaaacaguuccuucaucauagauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagccgcaguuaaggaugagagagcggugcacgccgacaugggauacuggaucgagagucagaaaaacggcagcuggaagcuggaaaaagcuucccuaauugagguaaagaccugcacuuggccuaagucucauacccuguggucgaaugguguccucgaaagcgauaugaucauaccaaaaucccuggccggcccgaucucacagcacaacuauaggcccggguaccauacacaaacugcaggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauuaggccaaucuccgaaaaggaggagaauaugguuaaaucacuggugagcgcugguucuggcaagguagacaacuucacaauggggguguugugccucgccauacuguuugaagaggucaugcgcggaaaguucggcaaaaagcauaugauugcagggguguucuuuaccuucguucuacugcucuccggacagaucacguggcgggauauggcccacacucugaucaugauuggcaguaaugcuagcgacagaauggguaugggggugacccaucuugcguugaucgccacauuuaaaauucagcccuuccuggcauuaggauuuuuccucaggaagcugaccucucgcgaaaaccuucugcuaggcgucggccucgcuauggccacuacacugcaauugccggaggauauagaacagauggccaaugggaucgcucugggauuaauggcacucaaacugauuacccaguuugagacauaccagcuuuggacugcccugaucuccuugaccuguucaaacacgauuuucacacucaccguggcguggcgaacugcuacccugauccuagccgguguuagucugcuuccugugugccaaagcucguccaugcggaagucugacuggcucccaaugacagucgcagccaugggcguacccccucugcccuuguuuauauucagccugaaggauacuuuaaaacguagaucauggccacucaaugagggggugauggcuguuggacuggugaguauccuugcauccucucuguugaggaacgacgucccuauggccggcccccucguggcgggugggcugcuaauugcuuguuauguaaucaccggaacgagcgccgaucugacaguggaaaaggcagccgacgucaccugggaggaagaggcugaacagacuggcguuucccacaaccuuaugauuacaguggacgaugacggcaccaugcgcaucaaagaugacgagacugagaauauacucacagugcuguugaagaccgccuuacugauugucucagggaucuuuccauacagcaucccggcaacgcuccugguguggcauacuuggcagaaacagacccggagaaguggaguucuuugggauguaccuucucccccagaaacacaaaaggcugagcuggaagaggguguguacaggauuaaacagcagggcauauucgggaagacccaggucggagugggcguucaaaaggaggguguguuucacacaauguggcacgucacucgaggggccguguugaccuauaacggaaaacgccuagaacccaauugggcguccguaaagaaagaccugaucagcuacggcggcggguggcggcucucggcccaguggcagaagggagaggaaguccaagugauugcaguugagccugguaaaaacccaaagaauuuccagacgaugcccggcacauuccagacuaccacaggggaaaucggagcuauugcccuggauuuuaagccuggcaccucagguucuccgaucauaaacagagaggggaaaguggucggacuuuauggcaauggcgugguuacuaagaacgggggauacgugagugguaucgcucagaccaaugcagagccagacggccccacaccugaauuagaggaagagauguucaaaaagaggaaccugacgauuauggaucuccauccaggguccggaaaaacucguaaguauuugcccgccaucguccgcgaagccauuaagcggagacugaggacccucauccuggcuccuacacgagugguagcggcagagauggaggaagcccuuaaaggccugccgauacgguaccaaaccacugcuacaaagagcgagcacaccggucgcgaaauuguggacuugaugugccaugccacguuuacuaugagacuacugucucccguuagggucccaaauuauaaccucaucaucauggaugaggcacacuucacagacccugccagcauugcugcgcggggguacaucuccacccgagugggaaugggcgaagccgcagcuauauuuaugaccgccacucccccaggcacagcagaugccuucccucagucaaaugcucccauucaggacgaggagagagacaucccagaacgcaguuggaacagcgggaaugaguggauuaccgauuuugccggaaaaacagugugguucgucccgucuaucaaggcggguaacgacauagcaaacuguuuaaggaaaaauggcaagaagguaauucagcugucccguaaaacuuuugauacggaauaccaaaagaccaaacuuaacgacugggauuucgugguuacaacugacaucucagagaugggggccaauuuuaaggcugaucgggugaucgacccuagaaggugccugaaacccgucauucucaccgauggaccagagcgcgugaucuuggccggccccaugccuguuacagcugcaagugccgcucagcgaagaggucggguggggaggaacccacagaaggaaaaugaccaguauauuuucaccggccaaccccugaacaaugaugaggaccaugcccacuggacugaagcaaagaugcuccuggacaacauaaauacgccugagggaaucauuccggcgcuuuucgaaccagagcgcgagaaaagcgccgcuaucgauggcgaauaccgucuaaagggggaguccagaaaaaccuuugucgaacugaugcggaggggagacuugcccgugugguuagcccacaagguagcaucugaggguaucaaauauacagaucgcaaguggugcuucgacggccagcgaaacaaucagauucuggaagagaacauggauguggagauauggacuaaagaaggggagaagaagaaacucagaccucgguggcuggacgcuaggaccuacucggauccccuugcccugaaggaauuuaaagacuucgcagccggacgcaagagcaucgcucucgauuugguuacagagauuggcagagucccaucacaucuggcgcacaggacccggaaugcccuagacaaccuggugaugcuccauacuuccgaacacggugggaaagcauaucgucacgcuguggaggagcuuccugaaacaauggagacgcuguuauugcugggccucaugauccugcuuaccggaggcgccaugcuguuucucauuagugggaagggaaucgguaagacuucuauaggcuugaucugugucauugccagcuccgggaugcuguggauggcagaaauccccuuacaguggauugcuucagccaucguucuagaguucuuuaugauggugcugcucauaccagagccugaaaaacaacgcacaccgcaggauaaucagcuugcguacguagugauuggaauccugaccuuggcugccauuaucgcagccaacgagaugggccugcucgaaaccacaaagcgagaccuggguaugucuaaagagcccggggucgugagcccaacuaguuaucuugauguugaccuccauccugcuuccgcauggacgcuguacgccguggcgaccacagucauaacucccauguugagacacaccaucgaaaauagcacagcuaacguaucucuggccgcaauugccaaccaagcugugguuuuaaugggccuaaauaagggauggccaaucucaaaaauggaccugggcgugccucuccuugcccuggggugcuacucccaggucaaccccuugacccugacugcagcugugcuccugcuuauuacgcauuaugccaucauaggaccgggcuuacaggcgaaggccacaagggaggcacagaagcggaccgcugccgguauuaugaaaaauccaacugucgaugggaucaugaccaucgaccuggauccugugauuuacgacaguaaguucgagaaacaacucggacagguuauguugcuggugcuaugugcaguacagcugcuccuuaugcgcacaagcugggcucugugcgaagccuugacucuggccaccggccccaucacaacgcucugggaggguucgccaggcaaguuuuggaacaccacuauagcggugucuauggcuaauauuuucagaggguccuaucuggcaggagccggcuuagcuuuuagcaucaugaaaucagucgggacaggaaagaggggcaccgguagucagggggaaacucuuggagagaaguggaaaaagaaacugaaccaacucucucggaaggaauucgaucuauacaaaaaguccggcauuacagagguugaccgaaccgaggccaaagaaggucugaagagaggcgagaucacgcaccaugcagugagccgcgggucagccaaguugcagugguuugucgaaaggaauauggugauacccgagggacggguaaucgaucugggcugugggcguggaggcuggaguuauuacugcgcuggucucaaaaaggugaccgaaguuagaggguauacaaaaggaggcccuggccacgaggagccggugcccaugagcacuuacggguggaacauugucaagcuuauguccggaaaagacguguucuaccugccaccugaaaagugugauaccuugcugugcgacaucggugagucuagccccuccccuacagucgaagagucaaggacuauucgcgugcucaagaugguugagccaugguuaaaaaauaaccaguucuguaucaagguacugaaucccuauaugccuaccgugauugaacaccuugagcggcugcagcgaaaacauggcgggaugcuagucagaaacccacucucuaggaauaguacacacgaaauguacuggaucucgaacggaaccggcaauauaguggcgagcguuaacauggugucccgccuguugcugaaccgguuuacuaugacgcauagacgucccacaauugagaaggaugucgaccucggugccgggaccaggcacgugaaugcagaaccggagacuccuaacauggauguaaucggagagcggaucaaacgcauuaaggaagagcacaauucuaccuggcauuaugacgacgaaaacccauacaagacaugggcuuaucacggcucauacgaggugaaagccacgggcagcgcauccaguaugauaaaugggguugucaagcuucugaccaaacccugggauguggugccuauggucacucaaauggccaugacagacaccacuccauucggacagcagcgaguuuuuaaggaaaaaguggauacaagaacccccaggucuaugccggguacacggcgcguaaugggcaucacugcugagugguuauggagaacccuggggaggaacaagaagccucgauugugcacgcgggaggaauucaccaaaaaggugcguacaaaugccgcgaugggagcagucuuuacugaggaaaaccaaugggacagcgccaaagcugccguggaggaugaagacuucuggaagcucguugauagagagcgcgagcugcauaaacuaggcaagugugguucaugcguguauaauaugauggggaaaagggaaaagaagcuuggagaguuuggcaaagcaaagggcucccgggcuauuugguacauguggcugggggccagauaccucgaauucgaggcucugggauuuuugaacgaggaccacugguucagucgcgaaaauagcuauucuggugucgagggcgaagggcugcauaaacucggauacauccuuagggauauuuccaagauccccggcggugccauguaugcagacgauaccgcggggugggacacacgaauaacugaggacgaucugcacaacgaagagaaaaucacccagcagauggacccagagcaccggcaguuagccaaugcuauuuuuaagcugacguaccaaaacaaggugguaaaaguucagagaccuacacccaccggaacugugauggauaucauuucaaggaaggaccagcgcggcagcggccaggucgggacauauggauugaauaccuucacuaacauggaagcccaacucauccgucagauggagggugaaggcgugcugaccaaagcagaucuagagaacccacaucuuucggaaaagaaaauaacacaguggcuggagacgaaggggguggagcggcucaagagaauggcuauuucuggagacgauugcgucguuaaacccaucgacgauagguuugccaaugcacuguuggccuuaaacgacaugggcaaggugcgcaaagauaucccucaguggcaaccaaguaaggguuggcacgacuggcagcagguaccguucuguucccaucacuuccacgaacugauuaugaaagaugggcgaaagcucgugguccccugccggccucaggacgagcuuauaggaagagcgaggaucagccaaggcgcuggcuggucacugcgcgaaaccgccugucuagggaaggcauacgcccagauguggucccugauguauuuucauagacgggaccucagguuggcuucuaaugccauuugcagcgcagugccaguucacugggugcccacuagucguacaaccugguccauccaugcucaccaucaguggaugacuacagaggauaugcugaccgucuggaaccgaguguggauugaagacaauccuuggauggaggauaaaacgccaguaacaaccugggagaacguucccuaccuuggaaagcgcgaagaccaauggugugguagccugaucggccucacuucuagagccaccugggcgcagaauauaccuacagcuauccagcaggugcggucauuaauugggaacgaggaauuccuggauuacaugccgaguaugaaaagguuucgcaaggaggaggaauccgagggagccaucugguga

SEQ ID NO: 15400 - RNA, 9873 nt, Artificial Sequence
  derived and/or modified CDS sequence (opt3) from DENV-3__EU482564__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggagugaucacccuguauuuaggcgccguuguccaggcagacauggguugugugauuaauuggaaagggaaggagcugaagugcggauccggcaucuucgugacuaacgagguccauacauggaccgaacaguacaaauuucaagccgauucucccaagcggcuagcuacugccauugcaggugcuugggagaauggcguuugugggauccgaagcaccacacgcauggaaaaccuccuguggaaacagauagccaaugagcuuaacuauaucuugugggaaaauaacauuaagcugacgguggugguaggagacaucauuggcguccucgagcaggggaaaagaacccugacuccacagccuauggaguuaaaguacucauggaaaacauggggaaaggcgaagaucgugaccgccgaaauacaaaacaguuccuucauuaucgauggccccaauacaccagagugccccagcgcuucuagggcauggaacguuugggaaguggaggacuaugguuuuggggucuucacuaccaauauuuggcugaaacuucgggaaguguacacgcaguugugugaccaccgccucaugucagccgcuguuaaggaugagagagccgugcacgcagacaugggauacuggaucgagagucagaaaaacggcagcuggaagcuggaaaaagcgucccuaauagagguaaagacaugcaccuggccuaagucucauacucuguggucgaaugguguccucgaaagcgauaugaucauuccaaaaucccuggccggcccgaucucacagcacaacuauaggcccggguaccauacccaaacagcuggaccuuggcaccuuggcaaguuggaccuggauuuuaauuauugcgaggggacuaccguggugauuacagagaacuguggaacgcgucggccaaguuuacgaaccacuacagucucuggcaaacucauccacgaauggugcuguagaagcugcacccugcccccucuuagguacaugggugaggacggguguugguauggaauggaaauacgcccaauuuccgagaaggaagagaauaugguuaaaucacuggugagcgccggcucugguaagguagauaacuucacuaugggcguguugugccucgcaauccuguuugaggaagucaugcgggggaaguucggaaaaaagcauaugaucgcuggcguguucuuuacauucguucuacugcucuccgggcagauuaccuggagagacauggcccacacgcugaucaugauuggaaguaaugcaagcgauaaaaugggcaugggugugacuuaccuugccuugauagcuaccuuuaagauccagcccuuccuggcguuaggguuuuuccucaggaaacugacaucucgcgagaaccuucugcuaggagucggccucgccauggcaaccacucugcaauugccggaagacauugagcagauggcuaauggcaucgcccugggguuaauggcccucaagcugauuacacaguuugaaaccuaucagcuuuggacagcucugaucuccuugacuuguucaaacaccauguucacgcucacaguggcauggcgaaccgccacucugauacuagcgggaguuagucugcuuccugugugccaaagcucguccaugcggaagaccgauuggcucccaauggcugucgccgcaauggguguacccccucugcccuuguuuaucuucucucugaaagacacauuaaagcguagaagcuggccacucaaugagggcgugauggccguugggcuggugucaauucuugcuaguucccuguugaggaacgaugucccuauggcaggaccccucguggccggcggucugcuaaucgcguguuacguaauuacugggaccucugcugaccugacgguggagaaagccgcagacaucacaugggaagaggaagccgagcagaccggagucagccauaaccuuaugauaacuguugaugacgauggcacaaugcgcauuaaggacgaugaaaccgagaauauccucacugugcuguugaaaacagcuuuacugaucguguccggcgucuuuccauacucaauuccggccacccuccugguguggcacacguggcagaagcagacucaacggagcgggguucuuugggacguaccuagucccccagagacccagaaagcagaacuggaggaaggaguguauagaauaaagcagcaggguaucuucggcaagacacaagucggggugggaguucagaaagagggcguguuucauaccauguggcacgucacaaggggugcuguguugacuuacaacgggaagcgacuagagcccaauugggccucuguaaaaaaggaucugauuuccuauggaggcggcuggcgccucagcgcgcaguggcaaaaaggggaagagguccaggugaucgccguugaaccuggaaagaacccaaagaauuuccagaccaugcccgguacguuccagacaacuaccggcgagauuggggcaaucgcucuggacuuuaaaccuggaacaucgggcucaccgauaaucaaccgggaagguaagguggucgggcuuuacggaaauggcgugguuaccaaaaacggcggguaugugucuggaauugcccaaacuaaugcugagccagauggucccaccccugaguuagaagaggaaauguucaagaaaagaaaccugacaaucauggaccuccacccaggcagugggaagacgaggaaguacuugcccgcagucgugcgugaggccauuaaacgccggcugagaacucucauccuggccccuaccaggguaguggcugcggaaauggaggaggcacuuaagggacugccgauacgauaucagacaaccgccacuaaauccgaacauacaggccgggagauuguugauuugaugugccacgcuaccuuuacgaugcgccuacugagccccgucagagugccaaauuacaaccucaucaucauggacgaagcccauuucacugauccugcaucuauugccgcuagggguuacaucagcacacggguggggaugggagaggcggccgcaauauuuaugaccgcuacccccccaggcacugccgacgcauucccucaguccaaugcccccauucaggacgaagagcgagauaucccagagagaucauggaacaguggcaaugaauggauuacagacuuugcugggaagaccgucugguucguaccgagcaucaaagccggaaacgauauagcgaacuguuuacgcaagaaugguaagaaagugauucaacugucuaggaagacauuugacacugaguaucagaaaacgaagcuuaacgauugggacuucguugugaccacagauaucuccgaaaugggcgcaaauuuuaaagccgaccgugucaucgauccucggagaugccugaagcccgugauucucacugacgggccagagaggguuaucuuggcuggacccaugccugugaccgccgcuucagcagcccagcgccgaggcagagucggucggaacccacagaaggagaaugaucaauacauuuucacagggcagccccugaacaaugacgaagaccacgcucauuggaccgaggccaaaaugcuccuggauaacauaaauacuccugaaggcaucauuccggcacuuuucgagccagaaagggagaagagugcggccaucgacggagaguaucgccuaaaaggcgaaagccguaagacguuuguggagcugaugagacggggggauuugcccguaugguuagcucacaaaguggccuccgaaggaaucaaguacaccgacaggaaauggugcuucgauggucagcgcaacaaucagauucuggaggaaaacauggacguugagauauggacaaaggagggcgaaaagaaaaagcuccgaccuagauggcuggaugcacggacuuauucugacccccuugcucugaaagaguuuaaggauuucgccgcagggaggaaaucgaucgcccucgacuuggucaccgaaauuggacgcgugccaagccaccuggcucauagaacaaggaaugcgcuagauaaccuggugaugcuccacaccucagagcauggcggucgggccuaccgucacgcagucgaagagcuuccugagacuauggaaacacuguuauugcuggggcucaugauccugcuuacgggcggagcuaugcuguuucucauuuccggcaaggggaucggaaagaccaguauagguuugaucuguguuauugccucuagcggcaugcuguggauggccgagauccccuuacaauggauugcauccgcuaucgugcuagaauucuuuaugaugguacugcucauaccagagccugagaaacagcgcacuccgcaggacaaucaacuugccuauguggucauugggauccugacauuggcggcuauuaucgccgcaaacgaaaugggacugcucgagaccaccaagcgagaucugggcaugucaaaagaacccggugugguuucuccaacaagcuaccuugacguggaccuccacccugccagugcuuggacucuguacgcagucgccacgaccguaauaacacccauguugagacauacuaucgagaauuccaccgcgaacgugagccuggcugccauugcaaaccaggccguuguguuaauggggcuagauaagggcuggccaaucucuaaaauggaccugggagucccucuccuugcucugggcugcuauucacaggugaaucccuugacacugaccgccgcaguccuccugcuuauuacucacuacgcuaucauagggccgggauuacaggccaaggcgacgagggaagcccaaaagcggacagcagcuggcauuaugaaaaacccaaccguggaugguaucaugacuaucgaccuggauccuguuauuuaugacuccaaguucgagaaacagcucgggcaggugauguugcugguacuaugugccgugcagcugcuccuuaugcgcaccaguugggcacugugcgaggcuuugacacuggccacuggacccaucaccacacucugggaaggcagcccagguaaguuuuggaauacgaccauagccgucucgauggcgaacauuuucagaggcucuuaccuggcuggggcaggauuagccuuuuccaucaugaaaagcguuggcacugggaagaggggaacaggcucacaaggugagacccuuggggaaaaguggaaaaagaaacugaaucagcucagucggaaggaguucgaucuauauaaaaagucuggaauuacugaaguggaccgaacagaggcuaaagagggccugaagagaggugaaaccacgcaucacgccgucucccgcggcaccgcaaaguugcagugguuuguggagaggaacaugguaauccccgaagggcgggugauagaucugggauguggccgugggggauggagcuacuauugcgccggccucaaaaagguuacagaggugagagguuacacuaaagggggaccuggccaugaagagccgguccccaugucaaccuacggcuggaauaucgugaagcuuaugagugggaaagacgucuucuaucugccaccugagaagugugauacauugcugugcgacauuggagaaagcucccccucuccuacuguggaggaaagcaggaccauccgcguucucaagaugguagagccaugguuaaaaaacaaucaguucuguauuaaggugcugaaccccuacaugccuacagucaucgagcaccuugaacggcugcaacgaaaacacgguggcaugcuagugagaaauccacucuccaggaacucaacccaugagauguauuggauuucuaaugggacuggaaacaucguugcuagugugaauauggucucgcgccuguugcugaaccgguuuacgaugacacacagacgucccaccauagaaaaggauguggaccucggcgcggguacuaggcauguaaacgccgagccggaaaccccuaauauggacgugauuggggagcggaucaaacgcaucaaggaggaacacaacagcacauggcacuacgaugacgagaauccauauaagacgugggcauaccauggauccuaugaaguuaaagcuaccggcucugccucaagcaugauuaacggcgucgugaagcuucugacuaaacccugggauguggucccuaugguuacacagauggcaaugaccgacacuacaccauucgggcagcaacgaguguuuaaggagaaaguagauaccagaacacccagguccaugccgggaacucggcgcgugauggguauaaccgccgaaugguuauggagaacgcugggcaggaauaagaagccucgauugugcacccgggaggaguucacaaaaaagguccguacuaacgcugccaugggggcgguguuuaccgaagagaaucagugggacagugcaaaagccgcuguugaagaugaggacuucuggaagcucguggauagagaacgcgagcugcacaaacuaggaaaguguggcucuugcgucuacaacaugauggguaaaagggagaagaagcuuggggaauuuggaaaagccaagggcagccgggcaaucugguacauguggcugggcgcuagauaucucgaguucgaagcccugggguuuuugaaugaggaccauugguucucacgcgagaacuccuacaguggaguggaaggugagggccugcacaaacucggguauauucuuagggauaucagcaagauucccggaggcgcuauguacgccgacgacacagcagguugggauacucgaaucaccgaagacgaucugcauaaugaggaaaaaauaacgcagcagauggacccagagcaccggcaauuagcgaacgccaucuuuaagcugacauaucagaauaagguaguuaaagugcagagaccuacccccacugggacagucauggauauuaucucuaggaaggaccagcgcggauccggccaagugggcaccuacggguugaacacuuucaccaauauggaggcucagcucauucgucagauggaaggagagggugugcugucaaaagccgaucuagaaaacccacaccuucccgagaagaaaaucacacaguggcuggaaacgaagggcgucgagcggcucagaaggauggcaauaagcggggacgauugcguugugaagccuauugacgaucgcuuugcuaacgcccuguuggcauuaaaugacaugggaaaaguacgaaaggauaucccacaauggcagccgucgaaaggcuggcaugacuggcagcaggugcccuucuguucucaccauuuccacgagcugaucaugaaggacggucggaaacucgucgugccuugcagaccacaagaugaacuuauugggagggcccgcauaagucagggagcgggcuggucccugagagagaccgcuugucuaggcaaggccuaugcacagauguggagccugauguacuuucaccggagggaccuccguuuggccucaaacgcuaucugcuccgccguucccgugcauugggucccuacuucucgaacaaccuggagcauucacgcacaucaccaauggaugacuacagaagauaugcugaccguguggaaucgcguauggaucgaggacaacccauggauggaagauaagacgcccguuacaaccugggagaaugugccuuaccuugggaaaagagaggaccagugguguggaagucugauuggucucacuucccgggcuaccugggcccagaacaucccgacagcgauacagcaagucaggagcuuaaucggcaaugaagaguuccuggauuauaugccaucuaugaagcgcuuuagaaaagaagaggagucagaaggggcuauuugguga

SEQ ID NO: 15401 - RNA, 9873 nt, Artificial Sequence
  derived and/or modified CDS sequence (opt3) from DENV-3__EU529699__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacaccauuggcguccucgagcaggggaaaagaacucugacaccacagccuauggaguuaaaguacucauggaaaaccuggggaaaggccaagaucgugacagcggaaacucaaaacaguuccuucauaauugauggccccaauaccccagagugccccagcgccucuagggcuuggaacguuugggaaguggaggacuaugguuuuggggucuucacgacaaauaucuggcugaaacuucgggaaguguacacccaguugugugaccaccgccucaugucagcagccguuaaggaugagagagcugugcacgccgacaugggauacuggauugagagucagaaaaacggcagcuggaagcuggaaaaagcaucccuaaucgagguaaagacuugcaccuggccuaagucucauacacuguggucgaaugguguccucgaaagcgauaugauaaucccaaaaucccuggcgggcccgauuucacagcacaacuauaggcccggguaccauacucaaaccgccggaccuuggcaccuuggcaaguuggagcuggacuuuaauuauugcgaggggacaacgguggugaucaccgaaaacuguggaacucguggcccaaguuuacggacaaccacugucucugguaaacucauucacgaguggugcugucgaagcugcacacugcccccucuuagauacaugggggaagauggauguugguauggcauggagaucaggccaguuuccgaaaaggaggagaauauggugaaaucacugguaagcgcugguucuggcaagguggacaacuucaccaugggggucuugugccucgccauacuguuugaagaggugaugcgcggaaaguucggcaaaaagcauaugauugcagggguuuucuuuacguucgugcuacugcucuccggacagaucacuuggcgggauauggcucacacccugaucaugauuggcaguaaugccagcgacagaauggguaugggggucacauaccuugcauugaucgccaccuuuaaaauucagcccuuccuggcuuuaggauuuuuccucaggaagcugacuucucgcgaaaaccuucugcuaggcgugggccucgcgauggccacaacccugcaauugccggaggauauagaacagauggcaaaugggaucgcucugggauuaauggcccucaaacugauuacacaguuugagacuuaucagcuuuggaccgcccugaucuccuugacguguucaaacacaauuuucacccucacuguugcuuggcgaaccgcaacacugauccuagccggugugagucugcuuccugucugccaaagcucguccaugcggaagacugacuggcucccaaugaccguagcggcuaugggcgugcccccucugcccuuguuuauauucucucugaaggauacguuaaaacguagaagcuggccacucaaugaggggguuauggccgugggacuggucucaauccuugcaaguucccuguugaggaacgacgugccuauggccggcccccucguagcuggugggcugcuaauugcauguuacgugaucacaggaaccucugccgaucugacugucgaaaaggcggcugacguuacaugggaggaagaggccgaacagaccggcgugagccauaaccuuaugauuacuguggacgaugacggcacaaugcgcaucaaagaugacgagaccgagaauauacucacgguccuguugaagacugcauuacugauuguguccgggaucuuuccauacucaaucccggccacccuccugguuuggcacacauggcagaaacagacccaacggagcggaguacuuugggaugugccuagucccccagaaacacagaaggcugagcuggaagagggugucuauagaauuaaacagcagggcauauucgggaagacucaagugggaguuggcgugcagaaggagggugucuuucauaccauguggcacgugacgaggggggccguauugacauacaacggaaaacgacuagaacccaauugggcaucugucaagaaagaccugaucuccuauggcggcggguggcgccucagcgcucaguggcaaaagggagaggaagugcagguuauugccguggagccugguaaaaacccaaagaauuuccagacuaugcccggcaccuuccagacaaccacuggggaaaucggagcgauugcccuggauuuuaagccuggcaccucggguucaccgaucauaaaccgggaggggaaagucgugggacuuuacggcaauggcguugugacaaagaacgggggauaugucucugguaucgcacaaacgaaugcugagccagacggccccacuccugaauuagaggaagagauguucaaaaagagaaaccugaccauuauggaucuccacccagggaguggaaaaacaaggaaguacuugcccgccaucgugcgugaagcuauuaagcgccggcugagaacccucauccuggcaccuacuaggguaguggccgccgagauggaggaagcucuuaaaggccugccgauacgauaucagacaaccgcgacgaaguccgagcauacuggucgggaaauuguugacuugaugugccacgcaacauuuaccaugcgccuacugagccccgucagagugccaaauuacaaccucaucaucauggaugaggcccauuucaccgacccugcuucuauugccgcaaggggguacaucagcacucgggugggaaugggcgaagccgcugcgauauuuaugacagccacccccccaggcacagcagaugcuuucccucaguccaaugcccccauucaggacgaggagcgagacaucccagaaagaucauggaacagugggaaugaguggauuacugauuuugcaggaaaaacggucugguucguaccgagcaucaaggccgguaacgacauagcuaacuguuuacgcaaaaauggcaagaaggugauucaacugucuaggaaaaccuuugauacagaauaucagaagacuaaacuuaacgacugggauuucguugugaccacagacaucuccgagaugggggccaauuuuaaggcggaucgugucaucgacccucggagaugccugaaacccgugauucucaccgauggaccagagaggguuaucuuggcaggccccaugccugugacugccgcuucagccgcucagcgccgagguagagucgggcggaacccacagaaggaaaaugaccaauacauuuucacgggccagccccugaacaaugaugaggaccacgcacauuggaccgaagccaagaugcuccuggacaacauaaauacaccugagggaaucauuccggcucuuuucgaaccagagagggagaaaagugccgcaaucgauggcgaauaucgccuaaagggggagagccguaaaacuuuuguggaacugaugagacggggagacuugcccguaugguuagcgcacaagguggccuccgaggguaucaaauacaccgauaggaaguggugcuucgacggccagcgcaacaaucagauucuggaagagaacauggauguugagauauggacaaaagaaggggagaagaagaaacuccgaccuagauggcuggacgcucggaccuauucugauccccuugcccugaaggaauuuaaagacuucgcagcuggaaggaagucgaucgcccucgauuuggucacugagauuggccgcgugccaagccaccuggcacauagaacaaggaaugcccuagacaaccuggugaugcuccacacgucagaacauggugggaaagcuuaccggcacgcggucgaggagcuuccugaaaccauggagacucuguuauugcugggccucaugauccugcuuacaggaggcgccaugcuguuucucauuuccgggaagggaaucgguaagaccaguauaggcuugaucuguguuauugcaucuagcgggaugcuguggauggcugaaauccccuuacaauggauugccuccgccaucgugcuagaguucuuuaugaugguacugcucauaccagagccugaaaaacagcguaccccgcaggauaaucaacuugcauauguggucauuggaauccugacauuggcugccauuaucgcggcuaacgagaugggccugcucgaaacuacgaagcgcgaccuggguaugucaaaagagcccggggugguuucuccaaccagcuaccuugauguggaccuccacccugccagugcauggacacuguacgccgucgcuacuaccguaauaacacccauguugcgacauaccaucgaaaauuccacugcaaacgugagccuggccgcgauugcuaaccaggccguuguguuaaugggccuagacaagggauggccaaucucuaaaauggaucugggcgucccucuccuugcacuggggugcuauucacaggugaaucccuugacgcugacagccgcuguccuccugcuuauuacccacuacgccaucauaggaccgggcuuacaggcaaaggcuacuagagaggcccaaaagaggaccgcggccgguauuaugaaaaacccaacaguggacgggaucaugacuaucgaucuggacccuguuauuuaugauuccaaguucgagaaacagcucggacaggugauguugcugguacuaugugcagugcagcugcuccuuaugcggaccaguugggcucugugcgaagccuugacacuggcaacgggccccaucaccacucucugggaggguagcccaggcaaguuuuggaauacaaccauagcugucucgauggccaacauuuuccgcgggucuuaccuggccggagcgggcuuagcuuuuuccaucaugaaaagcguugggacuggaaagagaggcacagguucacaaggggaaacccuuggagagaaguggaaaaagaaacugaaucagcucaguaggaaggaauucgaccuauauaaaaagucuggcauuacggagguggaucggaccgaggcaaaagaaggucugaagcgaggcgagaucacacaucacgccgucuccagagggagcgcuaaguugcagugguuuguggaacgcaacaugguaauacccgagggaagggugaucgaccugggcugugggcggggaggcuggucauacuauugcgccggucucaaaaagguuacugaagugcguggguacaccaaaggaggcccuggccaugaggagccgguccccaugaguacauacggguggaauauugugaagcuuaugagcggaaaagaugucuucuaucugccaccugaaaagugugacacuuugcugugcgauaucggugaguccucucccagcccuaccguggaagaguccagaacaauuaggguucucaagaugguagagccaugguuaaaaaacaaucaguucuguaucaaggugcugaaccccuacaugccuaccgucauugaacaccuugagcgccugcaacggaaacacggcgggaugcuagugcgaaauccacucucaagaaacucuacucaugaaauguauuggaucaguaauggaacgggcaacauaguugcaucggugaauauggucagcaggcuguugcugaaccgcuuuacaaugacccaccggagacccacuauugagaaggacguggaucucggugccgggacccgucauguaaacgcugaaccggagacaccuaauauggacgugaucggagagaggaucaaacggauuaaggaagagcacaacuccacguggcacuacgacgaugaaaauccauauaagaccugggcguaccauggcucuuaugagguuaaagccacuggcucagcaagcuccaugauaaacggggucgugaagcuucugacaaaacccugggacguggucccuaugguuacccagauggcuaugacugauacaaccccauucggacagcaacgcguguuuaaggaaaaaguagacacacgaacucccagaaguaugccggguaccaggcgggugaugggcaucacggccgagugguuauggcgcacccuggggagaaauaagaagccuagguugugcacacgagaggaauucacuaaaaagguccggaccaacgcagccaugggagcuguguuuacagaggaaaaucagugggauucugccaaagcggcaguugaggacgaagauuucuggaagcucguggaccgugagagagagcugcacaaacuaggcaagugugguagcugcgucuacaacaugauggggaaacgcgaaaagaagcuuggagaguuuggcaaagccaagggcucaagggcuauuugguacauguggcugggggcccgguaucucgaauucgaggcacugggauuuuugaaugaggaucauugguucuccagagaaaacaguuacagcgguguggagggcgaagggcugcacaaacucggauauauccuucgcgacauuucuaagauccccggcggugcuauguacgccgaugacacugcugggugggacaccaggauaacggaggaugaccugcauaaugaagagaaaaucacacagcagauggauccagagcaccgacaauuagccaacgcaauuuuuaagcugaccuaucagaauaagguaguuaaagugcagcggccuacucccacaggaaccgucauggacaucauuuccagaaaggaucagaggggcucaggccaaguggggacuuacggauugaacaccuucacaaauauggaagcgcagcucauccgccagauggagggugaaggcgugcugagcaaagccgaccuagagaacccacaccuucccgaaaagaaaauaacgcaguggcuggagaccaagggggucgagcgucucaagcggauggcuauuucgggagaugacugcguugugaaaccuaucgaugacagauuugccaacgcacuguuggcuuuaaaugauaugggcaagguaaggaaagacaucccacaauggcagccgucuaaggguuggcaugauuggcagcaggugcccuucuguagucaccauuuccacgaacugauuaugaaagacgggcgcaagcucgucgugccuugccgaccacaagacgagcuuauaggacgggccagaaucucccagggcgcaggcuggagccugagggaaacugccugucuagggaaggcguaugcucagauguggucacugauguacuuucaccgcagagaucuccgguuggccuccaacgcaauuugcucugccguucccgugcauugggucccuacaagcaggaccacuuggaguauccacgcucaucaccaauggaugacaaccgaggacaugcugacgguguggaaucguguauggauugaagauaacccauggauggaggacaaaacacccguuaccacuugggagaaugugccuuaccuuggaaagcgagaagaucaguggugugguucccugaucggccucaccagccgcgccacaugggcacagaacauaccgacugcuauccagcaagucagaucuuuaauugggaaugaggaauuccuggacuauaugccaucaaugaaacgguuuaggaaggaggaggaaagugagggagccaucugguga

SEQ ID NO: 15402 - RNA, 9873 nt, Artificial Sequence
  derived and/or modified CDS sequence (opt3) from DENV-3__EU482566__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaccuuacugaugcuugucacaccaucgaugaccaugcgcugugugggcguagggaacagagacuuuguugaaggauugucaggugccacguggguggaugucgugcuggagcacggcgggugcgugacuacaauggcgaagaauaaacccacccuagacaucgagcuccagaagacugaagcaacacaacuggccacccuuaggaaacuguguauugagggaaagaucacgaacauuaccacagauagccggugcccuacucagggcgaagcugucuugccagaggaacaggaccagaauuauguuuguaaacacaccuacguggaucgcgguugggggaacggaugcggccucuucggcaaggggagucugguaacaugcgccaaguuucaauguuuagagcccaucgagggaaaagugguccaguaugaaaaucugaaguacacugugauaauuaccguucauacaggugaccagcaccaggugggcaacgagacccaaggggucacugcagaaaucacgccucaggcuuccacaaccgaggccauucucccagaauauggaacucuuggccuggagugcucuccgcgaaccgguuuggacuucaaugagaugauccuacugacaaugaaaaacaaggcguggauggugcauagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcacacagcucucaccggcgccacagaaauccagaauucagggggaacuaguauuuucgcaggucaucugaagugucgguuaaaaauggacaagcuggagcuaaaaggcaugagcuacgccaugugcaccaacacguuugugcucaagaaagaggucucugaaacccagcacgggacaauacugaucaagguggaguacaagggagaagauguucccuguaaaauuccuuucuccacugaggacggccaagguaaggcucauaacgggcgucuuaucaccgcgaauccagugguaacaaaaaaggaggaacccgucaacauagaggcagaaccgccuuucggcgagucaaauauugugaucggaaucggcgauaacgccuugaaaauuaauugguauaagaaggggagcaguaucggaaaaauguuugaagcuacugcccgcggugcaagaaggauggccauucugggcgacaccgcuugggauuucgggucuguuggaggcgugcucaacucccuggguaagaugguccaccagauauuugggagcgccuacacggcacuuuucucgggcgugucuuggguaaugaaaaucggaauuggcgugcuguugacauggaucgggcucaauuccaagaacaccucaaugaguuuuagcugcaucgcgauuggaauaaucacucuguauuuaggcgcuguuguccaggccgacauggguugugugauuaauuggaaagggaaggagcugaagugcggauccggcaucuucgugacaaacgagguccauaccuggacugaacaguacaaauuucaagcagauucucccaagcggcuagccaccgcuauugccggugcaugggagaauggcguuugugggauccgaagcacaacgcgcauggaaaaccuccuguggaaacagauagcuaaugagcuuaacuauaucuugugggaaaauaacauuaagcugaccguggugguaggagacaucauuggcguccucgagcaggggaaaagaacucugacaccacagccuauggaguuaaaguacucauggaaaaccuggggaaaggccaagaucgugacagcggaaacucaaaacaguuccuucauaauugauggccccaauaccccagagugccccagcgccucuagggcuuggaacguuugggaaguggaggacuaugguuuuggggucuucacgacaaauaucuggcugaaacuucgggaaguguacacccaguugugugaccaccgccucaugucagcagccguuaaggaugagagagcugugcacgccgacaugggauacuggauugagagucagaaaaacggcagcuggaagcuggaaaaagcaucccuaaucgagguaaagacuugcaccuggccuaagucucauacacuguggucgaaugguguccucgaaagcgauaugauaaucccaaaaucccuggcgggcccgauuucacagcacaacuauaggcccggguaccauacucaaaccgccggaccuuggcaccuuggcaaguuggagcuggacuuuaauuauugcgaggggacaacgguggugaucaccgaaaacuguggaacuaaaggcccaaguuuacguacaaccacugucucugguaagcucauucacgaguggugcugucggagcugcacacugcccccucuucgauacaugggggaagauggauguugguauggcauggagaucagaccaauauccgaaaaagaggagaauaugguuaagucacuggugagcgcugguucuggcaagguagacaacuucaccauggggguguugugccucgccauucuguuugaagaggucaugaggggaaaauucggcaagaaacauaugaucgcagggguguucuuuacguucguucuacugcucuccggacagaucacuuggcgcgauauggcucacacccugauuaugaucggcaguaaugccagcgaccggauggguaugggggugacauaccuugcauugauugccaccuuuaagauacagcccuuccuggcuuuaggauuuuuccucagaaaacugacuucuagggaaaaccuucugcuaggcgucggccucgcgauggccacaacccugcaauugccggaggauaucgaacagauggcaaaugggauugcucugggauuaauggcccucaagcugaucacacaguuugagacuuaucagcuuuggaccgcccugauuuccuugacguguucaaacacaaucuucacccucacuguggcuuggcgcaccgcaacacugauacuagccgguguuagucugcuuccugugugccaaagcucguccaugcgaaagacugacuggcucccaaugaccgucgcggcuaugggcguacccccucugcccuuguuuaucuucucucugaaagauacguuaaagcggcguagcuggccacucaaugagggggugauggccguuggacuggugucaauucuugcaaguucccuguugagaaacgacgucccuauggccggcccccucguggcuggugggcugcuaaucgcauguuacguaauuacaggaaccucugccgaucugacuguggaaaaagcggcugacgucacaugggaggaagaggccgaacagaccggcguuagccauaaccuuaugaucacuguggacgaugacggcacaaugaggauaaaggaugacgagaccgagaauauucucacggugcuguugaaaacugcauuacugaucgucuccgggaucuuuccauacucaauuccggccacccuccugguguggcacacauggcagaagcagacccaacgcagcggaguucuuugggauguaccuagucccccagaaacacagaaagcugagcuggaagaggguguguaucggauaaagcagcagggcaucuucgggaagacucaagucggagugggcguucagaaagaggguguguuucauaccauguggcacgucacgagaggggccguguugacauacaacggaaagaggcuagaacccaauugggcaucuguaaaaaaggaccugauuuccuauggcggcggguggcgacucagcgcucaguggcaaaaaggagaggaaguccaggugaucgccguugagccugguaagaacccaaagaauuuccagacuaugcccggcaccuuccagacaaccacuggggaaauuggagcgaucgcccuggauuuuaaaccuggcaccucggguucaccgauaaucaaccgcgaggggaagguggucggacuuuacggcaauggcgugguuacaaaaaacgggggauaugugucugguauugcacaaacgaaugcugagccagacggccccacuccugaauuagaggaagagauguucaagaaacggaaccugaccaucauggaucuccacccagggaguggaaagacaagaaaguacuugcccgccauugucagggaagcuaucaaacgucgccugcggacccucauacuggcaccuacuagagugguagccgccgagauggaggaagcucuuaagggccugccgauuagguaucagacaaccgcgacgaaauccgagcauacuggucgagaaaucguggacuugaugugccacgcaacauuuaccaugcggcuacugagccccguucgcgucccaaauuacaaccucaucauuauggaugaggcccauuucaccgacccugcuucuaucgccgcaagaggguacauaagcacuagggugggaaugggcgaagccgcugcgauuuuuaugacagccacccccccaggcacagcagaugcuuucccucaguccaaugcccccauccaggacgaggagcgggacauuccagaacgaucauggaacagugggaaugaguggaucacugauuuugcaggaaagacggugugguucgucccgagcauaaaagccgguaacgacauugcuaacuguuuaagaaagaauggcaagaaaguaauccaacugucucgcaagaccuuugauacagaauaucagaaaacuaagcuuaacgacugggauuucgugguuaccacagacaucuccgagaugggggccaauuuuaaagcggauagggugauugacccucgucggugccugaagcccgucauccucaccgauggaccagagagagugauuuuggcaggccccaugccuguuacugccgcuucagccgcucagaggcgcggucgaguggggagaaacccacagaaggaaaaugaccaauacauauucacgggccagccccugaacaaugaugaggaccacgcacauuggaccgaagccaaaaugcuccuggacaacaucaauacaccugagggaauuaucccggcucuuuucgaaccagagcgggagaagagugccgcaaucgauggcgaauauaggcuaaaaggggagagccgcaagacuuuugucgaacugaugcguagaggagacuugcccgugugguuagcgcacaaaguagccuccgaggguauuaaguacaccgaucggaaauggugcuucgacggccagaggaacaaucagauacuggaagagaacauggauguggagaucuggacaaaggaaggggagaagaaaaagcuccgcccucgauggcuggacgcuagaaccuauucugauccccuugcccugaaagaauuuaaggacuucgcagcuggacggaaaucgauugcccucgauuugguuacugagaucggcagggucccaagccaccuggcacaucgcacaagaaaugcccuagacaaccuggugaugcuccacacgucagaacauggugggaaggcuuacaggcacgcgguggaggagcuuccugaaaccauggagacucuguuauugcugggccucaugauucugcuuacaggaggcgccaugcuguuucucaucuccgggaagggaauagguaaaaccaguaucggcuugauuugugucaucgcaucuagcgggaugcuguggauggcugaaauucccuuacaauggaucgccuccgccauaguucuagaguucuuuaugauggugcugcucauuccagagccugaaaagcagcggaccccgcaggauaaucaacuugcauauguagugaucggaauucugacauuggcugccaucauagcggcuaacgagaugggccugcucgaaacuacgaaacgugaccuggguaugucaaaggagcccggggucgugucuccaaccagcuaccuugauguugaccuccacccugccagugcauggacacuguacgccguggcuacuaccgucaucacacccauguugcgccauaccauugaaaauuccacugcaaacguaagccuggccgcgaucgcuaaccaggccgugguuuuaaugggccuagacaaaggauggccaauuucuaagauggaucugggcgugccucuccuugcacuggggugcuauucacaggucaaucccuugacgcugacagccgcugugcuccugcuuaucacccacuacgccauaauuggaccgggcuuacaggcaaaggcuacucgagaggcccaaaaaagaaccgcggccgguaucaugaagaacccaacagucgacgggaucaugacuauugaucuggacccugugaucuaugauuccaaauucgagaagcagcucggacagguuauguugcuggugcuaugugcaguacagcugcuccuuaugaggaccaguugggcucugugcgaagccuugacacuggcaacgggccccauaaccacucucugggaggguagcccaggcaaauuuuggaauacaaccauugcugugucgauggccaacaucuuccgggggucuuaccuggccggagcgggcuuagcuuuuuccauuaugaagagcgucgggacuggaaagcgcggcacagguucacaaggggaaacccuuggagagaaauggaagaaaaagcugaaucagcucaguagaaaagaauucgaccuauauaagaaaucuggcaucacggagguugauaggaccgaggcaaaggaaggucugaagcggggcgagauaacacaucacgccgugucccgagggagcgcuaaauugcagugguuugucgaaagaaacauggugauccccgagggacgcguaauugaccugggcugugggaggggaggcuggucauacuauugcgccggucucaagaaagugacugaaguucggggguacaccaagggaggcccuggccaugaggagccggugcccaugaguacauacggguggaauaucgucaaacuuaugagcggaaaggauguguucuaucugccaccugaaaagugugacacuuugcugugcgauauuggugaguccucucccagcccuaccgucgaagagucccguacaaucagagugcucaaaaugguugagccaugguuaaagaacaaucaguucuguauuaaaguacugaaccccuacaugccuaccgugaucgaacaccuugagaggcugcaacgcaagcacggcgggaugcuaguccggaauccacucucacgaaacucuacucaugaaauguauuggauaaguaauggaacgggcaacauuguggcaucgguuaauauggugagcagacuguugcugaacagguuuacaaugacccaccgccggcccacuaucgagaaagacgucgaucucggugccgggaccagacaugugaacgcugaaccggagacaccuaauauggacguaaucggagagcguauuaagaggauaaaggaagagcacaacuccacguggcacuacgacgaugaaaauccauauaaaaccugggcguaccauggcucuuaugaggugaaggccacuggcucagcaagcuccaugaucaacgggguugucaaacuucugacaaagcccugggacguggugccuauggucacccagauggcuaugacugauacaaccccauucggacagcaacggguuuuuaaagaaaagguggacacacgcacuccccgaaguaugccggguaccagaaggguaaugggcauuacggccgagugguuauggcggacccuggggcgcaauaagaaaccuagauugugcacaagggaggaauucacuaagaaagugcgaaccaacgcagccaugggagcugucuuuacagaggaaaaucagugggauucugccaaggcggcaguggaggacgaagauuucuggaaacucguugaccgggagcgugagcugcacaagcuaggcaaaugugguagcugcguguacaacaugauggggaagagagaaaagaaacuuggagaguuuggcaaggccaaaggcucacgcgcuaucugguacauguggcugggggccagguaucucgaauucgaggcacugggauuuuugaaugaggaucauugguucucccgggaaaacaguuacagcggugucgagggcgaagggcugcacaagcucggauauauucuuagagacaucucuaaaauacccggcggugcuauguacgccgaugacacugcugggugggacacccgcaucacggaggaugaccugcauaaugaagagaagauuacacagcagauggauccagagcacaggcaauuagccaacgcaaucuuuaagcugaccuaucagaauaaagugguaaagguucagcgaccuacucccacaggaaccgugauggacauuaucucccggaaagaucagagaggcucaggccaagucgggacuuacggauugaacaccuucacaaauauggaagcgcagcucauaaggcagauggagggugaaggcgugcugagcaaggccgaccuagagaacccacaccuucccgaaaaaaagauuacgcaguggcuggagaccaaggggguggagcgccucaaacguauggcuaucucgggagaugacugcgucguuaagccuaucgaugaccgguuugccaacgcacuguuggcuuuaaaugauaugggcaaagugagaaaggacauuccacaauggcagccgucuaaagguuggcaugauuggcagcagguacccuucuguagucaccauuuccacgaacugauaaugaaggacgggaggaagcucguggucccuugccgcccacaagacgagcuuaucggacgagcccggauuucccagggcgcaggcuggagccugagagaaacugccugucuagggaaagcguaugcucagauguggucacugauguacuuucacaggcgcgaucucagauuggccuccaacgcaaucugcucugccgugcccguucauugggugccuacaagccggaccacuuggaguauucacgcucaucaccaauggaugacaaccgaggacaugcugacggucuggaauaggguguggaucgaagauaacccauggauggaggacaagacacccguaaccacuugggagaauguuccuuaccuuggaaaacgugaagaucaguggugugguucccugauaggccucaccagccgagccacaugggcacagaacaucccgacugcuauucagcaagugcgcucuuuaaucgggaaugaggaauuccuggacuauaugccaucaaugaagagauuucggaaagaggaggaaagugagggagccauuugguga

SEQ ID NO: 15403 - RNA, 9873 nt, Artificial Sequence
  derived and/or modified CDS sequence (opt3) from DENV-3__EU529702__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacguuggcacaucucucacucagaagguggucaucuucauauuacugaugcuugugaccccaucgaugacaaugcgcuguguaggcguugggaacagagacuuuguggaaggauugucaggugccaccugggucgauguggugcuggagcacggcgggugcgucacgacuauggcgaagaauaaacccacacuagacaucgagcuccagaagaccgaagcaacucaacuggccacacuuaggaaacuguguauugagggaaagaucaccaacauuacgaccgauagccggugcccuacacagggcgaagcuguuuugccagaggaacaggaccagaauuauguguguaaacacacuuacguagaucgcgguugggggaacggaugcggccucuucggcaaggggagucuggugaccugcgccaaguuucaauguuuagagcccaucgagggaaaagucgugcaguaugaaaaucugaaguacacaguuauaauuacugugcauaccggugaccagcaccaggucggcaacgagacacaaggggugaccgcagaaaucacuccucaggcuuccacgacagaggccauucucccagaauauggaacccuuggccuggagugcucuccgcgaacugguuuggacuucaaugagaugauccuacugaccaugaaaaacaaggcguggaugguacauagacagugguuuuucgaucucccccugccuuggacaagcggggccaccacugaaacaccaacguggaauaggaaagagcuucugguuaccuuuaagaacgcacacgcuaaaaagcaagaaguggucguguugggcucccaggagggagccaugcacacugcucucacaggcgccaccgaaauccagaauucagggggaacaaguauuuucgcaggucaucugaagugucgguuaaaaauggacaagcuggagcuaaaaggcaugagcuacgccaugugcacuaacaccuuuguccucaagaaagaggugucugaaacgcagcacgggaccauacugaucaagguugaguacaagggagaagaugugcccuguaaaguaccuuucuccacagaggacggccaagguaaggcucauaacgggcgucuuauuacugcgaauccagucgugaccaaaaaggaggaacccguuaacaucgaggcagaaccgccuuucggcgagucaaauauagugauuggaaucggcgauaacgccuugaaaaucaauugguauaagaaggggagcaguauuggaaaaauguuugaagcuacagcccgcggugcaagaaggauggccauccugggcgacacugcuugggauuucgggucugucggaggcgugcucaacucccuggguaagaugguacaccagauuuuugggagcgccuacaccgcacuuuucucgggcgugucuuggguuaugaaaauaggaaucggcguccuguugacguggauugggcucaauuccaagaacacaucaaugaguuuuagcugcaucgugaucggaauuauaacccuguauuuaggcgcggugguccaggcugacauggguuguguuaucaauuggaaagggaaggagcugaagugcggauccggcauuuucgugacuaacgaggugcauacauggaccgaacaguacaaauuucaagccgauucucccaagcggcuagcaacugccaucgcuggugccugggagaauggcguaugugggauucgaagcaccacacgcauggaaaaccuccuguggaaacagaucgcaaaugagcuuaacuauauauugugggaaaauaacaucaagcugacggucgugguuggagacauuaucggcgugcucgagcaggggaaaagaacccugacuccacagccuauggaguuaaaguacucauggaaaacauggggaaaggcuaagauugucaccgccgaaacacaaaacaguuccuucaucauagauggccccaauacuccagagugccccagcgcgucuagggccuggaacgugugggaaguugaggacuaugguuuugggguguucucaaccaauauuuggcugaaacuucgggaaguauacacgcaguugugugaccaccgccucaugagugcugcagucaaggaugagagagccgugcacgcugacaugggauacuggaucgagagccagaaaaacggcuccuggaagcuggaaaaagccucucuaauugaggugaagacaugcaccuggccuaagucgcauacucuguggagcaaugguguccucgaauccgauaugaucauaccaaaaucacuggcaggcccgaucagucagcacaacuauaggcccggguaccauacccaaacagcgggaccuuggcaccuuggcaaguuggagcuggacuuuaauuauugcgaggggacuaccguugugauuacagaaaacuguggaacgcguggcccaucuuuacggaccacuacaguaagcgguaaacucauccacgaguggugcugucgauccugcacccugcccccucuuagauacaugggggaagauggauguugguauggcauggagauuaggccaaucucagaaaaggaggagaauauggugaaaagccuggucucugccgguuccggcaagguggacaacuucacuaugggggcuuugugccucgccauacuguuugaagagguuaugcgcggaaaguucggcaaaaagcauaugauugcagggguguucuuuacauucguccuacugcucaguggacagaucaccuggcgggauauggcucacacgcugaucaugauuggcagcaaugccucugacagaauggguaugggggugacuuaccuugcauugaucgccaccuuuaaaauucagcccuuccuggcuuuaggauuuuuccucaggaagcugacaucccgcgaaaaccuucugcuaggcguuggccucgcgauggccaccacucugcaauugccggaggauauagaacagauggcaaaugggaucgcucugggauuaauggcccucaaacugauuacacaguuugagaccuaucagcuuuggacagcccugaucucauugacuuguaguaacaccauuuucacgcucacaguggcuuggcgaaccgcaacucugauccuagccggugucagccugcuuccuguaugccaaucguccucuaugcggaagaccgacuggcucccaaugacaguggcggcuaugggcguucccccucugcccuuguuuauauucagccugaaggauacuuuaaaacguagaucauggccacucaaugagggggugauggccgucggacuggugaguauccuugcauccucucuguugaggaacgacguaccuauggccggcccccucguggcuggugggcugcuaauugcauguuacgucaucaccggaacgagcgccgaucugacaguugaaaaggcggcugacgugaccugggaggaagaggccgaacagacuggcgugucccauaaccuuaugauuacagucgacgaugacggcaccaugcgcaucaaagaugacgagacugagaauauacucacagugcuguugaagaccgcauuacugauuguuucagggaucuuuccauacagcaucccggccacgcuccugguauggcacacuuggcagaaacagacccaacggaguggagugcuuugggaugucccuucucccccagaaacacagaaggcugagcuggaagaggguguguauagaauuaaacagcagggcauauucgggaagacccaaguuggagugggcguccagaaggaggguguguuucauacaauguggcacguaacuaggggggccgucuugaccuacaacggaaaacgacuagaacccaauugggcauccgugaagaaagaccugaucagcuauggcggcggguggcgccucucggcucaguggcaaaagggagaggaaguucaggugauugccgucgagccugguaaaaacccaaagaauuuccagacgaugcccggcacauuccagacuaccacaggggaaaucggagcgauugcccuggauuuuaagccuggcaccucagguucuccgaucauaaaccgggaggggaaagugguuggacuuuacggcaauggcguggucacuaagaacgggggauaugugagugguaucgcacaaaccaaugcugagccagacggccccacaccugaauuagaggaagagauguucaaaaagagaaaccugacgauuauggaucuccacccaggguccggaaaaacuaggaaguacuugcccgccaucguacgugaagcuauuaagcgccggcugagaacccucauccuggcaccuacaagggugguugccgccgagauggaggaagcucuuaaaggccugccgauacgauaucagaccacugcgacaaagagcgagcauaccggucgggaaauugucgacuugaugugccacgcaacguuuacuaugcgccuacugucucccgugagagugccaaauuacaaccucaucaucauggaugaggcccauuucacagacccugcuagcauugccgcaaggggguacaucuccacccgggucggaaugggcgaagccgcugcgauauuuaugaccgccacucccccaggcacagcagaugcuuucccucagucaaaugcccccauucaggacgaggagcgagacaucccagaaagaaguuggaacagcgggaaugaguggauuaccgauuuugcaggaaaaacaguaugguucgugccgucuaucaaggccgguaacgacauagcuaacuguuuacgcaaaaauggcaagaagguuauucaacuguccaggaaaacuuuugauacggaauaucagaagaccaaacuuaacgacugggauuucguggucacaacugacaucucagagaugggggccaauuuuaaggcggaucgugugaucgacccucggagaugccugaaacccguuauucucaccgauggaccagagagggugaucuuggcaggccccaugccugucacagccgcuagugccgcucagcgccgagguagaguggggcggaacccacagaaggaaaaugaccaauacauuuucaccggccagccccugaacaaugaugaggaccacgcacauuggacugaagccaagaugcuccuggacaacauaaauacgccugagggaaucauuccggcucuuuucgaaccagagagggagaaaagcgccgcaaucgauggcgaauaucgccuaaagggggagucccguaaaaccuuuguagaacugaugagacggggagacuugcccgugugguuagcgcacaagguugccucugaggguaucaaauacacagauaggaaguggugcuucgacggccagcgcaacaaucagauucuggaagagaacauggaugucgagauauggacuaaagaaggggagaagaagaaacuccgaccuagauggcuggacgcucggaccuauucggauccccuugcccugaaggaauuuaaagacuucgcagcuggaaggaagagcaucgcccucgauuuggugacagagauuggccgcgugccaucacaccuggcacauagaaccaggaaugcccuagacaaccuggucaugcuccacacuuccgaacauggugggaaagcuuaccggcacgcgguugaggagcuuccugaaacaauggagacgcuguuauugcugggccucaugauccugcuuaccggaggcgccaugcuguuucucauuagugggaagggaaucgguaagacuucuauaggcuugaucugugugauugcaagcuccgggaugcuguggauggcugaaauccccuuacaauggauugccucagccaucguacuagaguucuuuaugauggugcugcucauaccagagccugaaaaacagcguacaccgcaggauaaucaacuugcauaugucgugauuggaauccugaccuuggcugccauuaucgcggcuaacgagaugggccugcucgaaaccacaaagcgcgaccuggguaugucuaaagagcccgggguugugagcccaacuaguuaccuugaugucgaccuccacccugccuccgcauggacgcuguacgccguagcuaccacagugauaacucccauguugcgacauaccaucgaaaauagcacagcaaacguuucucuggccgcgauugcuaaccaggccguggucuuaaugggccuagacaagggauggccaaucucaaaaauggaucugggcgugccucuccuugcacuggggugcuauucccaggucaaucccuugacccugacugccgcugugcuccugcuuauuacgcacuacgccaucauaggaccgggcuuacaggcaaaggcuacaagagaggcccaaaagaggaccgcggccgguauuaugaaaaacccaacuguugacgggaucaugaccaucgaucuggacccugugauuuaugauaguaaguucgagaaacagcucggacagguaauguugcuggugcuaugugcaguccagcugcuccuuaugcggacaagcugggcucugugcgaagccuugacucuggcaaccggccccaucacaacgcucugggaggguucgccaggcaaguuuuggaauaccacuauagcuguuucuauggccaacauuuuccgcggguccuaccuggccggagcgggcuuagcuuuuagcaucaugaaaucaguggggacaggaaagagaggcaccgguagucaaggggaaacucuuggagagaaguggaaaaagaaacugaaucagcucucuaggaaggaauucgaccuauauaaaaaguccggcauuacagaggucgaucggaccgaggcaaaagaaggucugaagcgaggcgagaucacgcaucacgccgugagcagagggucagcuaaguugcagugguuuguagaacgcaacauggugauacccgagggaaggguuaucgaccugggcugugggcggggaggcuggaguuacuauugcgccggucucaaaaaggugaccgaaguccguggguacacaaaaggaggcccuggccaugaggagccggugcccaugagcacuuacggguggaauauugucaagcuuauguccggaaaagauguguucuaucugccaccugaaaagugugacaccuugcugugcgauaucggugagucuagccccuccccuacaguugaagagucaagaacuauuaggguacucaagaugguggagccaugguuaaaaaacaaucaguucuguaucaagguccugaaccccuacaugccuaccgugauugaacaccuugagcgccugcaacggaaacacggcgggaugcuaguucgaaauccacucucuagaaacaguacacaugaaauguauuggaucucgaauggaaccggcaacauaguggcaagcgucaauaugguguccaggcuguugcugaaccgcuuuacuaugacgcaccggagacccacaauugagaaggacguagaucucggugccgggacccgucaugugaacgcugaaccggagacuccuaauauggacguuaucggagagaggaucaaacggauuaaggaagagcacaacucuaccuggcacuacgacgaugaaaauccauauaagacaugggcguaccauggcucauaugaggucaaagccacgggcagcgcauccaguaugauaaacgggguggugaagcuucugaccaaacccugggacgucguuccuauggugacucagauggcuaugacagauaccacuccauucggacagcaacgcguauuuaaggaaaaaguggacacacgaacccccagaucuaugccggguacaaggcgggucaugggcaucacugccgagugguuauggcgcacccuggggagaaauaagaagccuagguugugcacgcgagaggaauucaccaaaaaggugcggacaaacgcagccaugggagcuguuuuuacugaggaaaaucagugggauagcgccaaagcggcaguggaggacgaagauuucuggacccucgucgaccgugagagagagcugcacaagcuaggcaaaugugguucaugcguguacaacaugauggggaagcgcgaaaaaaagcuuggagaguuuggcaaggccaaaggcuccagggcuauuugguacauguggcugggggcccgguaucucgaauucgaggcacugggauuuuugaaugaggaucauugguucaguagagaaaacagcuacucugguguagagggcgaagggcugcacaagcucggauauauccuucgcgacauuuccaaaauccccggcggugcuauguacgccgaugacacagcugggugggacacuaggauaaccgaggaugaccugcauaaugaagagaagaucacgcagcagauggauccagagcaccgacaauuagccaacgcaauuuuuaaacugacauaucagaauaagguugugaagguccagcggccuacccccacuggaacagugauggacaucauuucaagaaaagaucagaggggcagcggccaaguggggaccuacggauugaacacuuucaccaauauggaagcgcagcucauccgccagauggagggugaaggcguccugucgaaggccgaccuagagaacccacaccuucccgaaaaaaagauaacacaguggcuggagacgaaagggguugagcgucucaagcggauggcuauuucuggagaugacugcgugguaaagccuaucgaugacagauuugccaacgcacuguuggcuuuaaaugauaugggcaaagugaggaaggacaucccacaauggcagccgaguaaagguuggcaugauuggcagcagguccccuucuguucccaccauuuccacgaacugauuaugaaggacgggcgcaaacucgugguuccuugccgaccacaagacgagcuuauaggacgggccagaaucagccagggcgcaggcuggucacugagggaaaccgccugucuagggaaggcguaugcucagauguggucccugauguacuuucaccgcagagaucuccgguuggccucuaacgcaauuugcagcgccgugcccguccauugggugccuacuaguaggacaaccugguccauccacgcucaucaccaauggaugacuacagaggacaugcugaccguauggaaucguguuuggauugaagauaacccauggauggaggacaagacgcccgugacaaccugggagaaugucccuuaccuuggaaaacgagaagaucaguggugugguagccugaucggccucacuucucgcgccaccugggcacagaacauaccgacagcuauccagcaagugagaucauuaauugggaaugaggaauuccuggacuauaugccaaguaugaagcgguuuaggaaagaggaggaauccgagggagccaucugguga

SEQ ID NO: 15404 - RNA, 9873 nt, Artificial Sequence
  derived and/or modified CDS sequence (opt3) from DENV-3__EU529703__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugccuugccagaggaacaggaccagaauuaugucuguaaacacacuuacguugaucgcgguugggggaacggaugcggccucuucggcaaggggagucuggugaccugcgcaaaguuucaauguuuagagcccauagagggaaaaguagugcaguaugaaaaucugaaguacacagucauuaucacugugcauaccggugaccagcaccagguuggcaacgagacacaaggggugaccgcugaaauuacuccucaggccuccacgacagaggcgauccucccagaauauggaacccuuggccuggagugcucuccgcgaacugguuuggacuucaaugagaugauccuacugaccaugaaaaacaaggccuggaugguccauagacagugguuuuucgaucucccccugccuuggacaagcggggcaaccacugaaacaccaacguggaauaggaaagagcuucuggugaccuuuaagaacgcucacgccaaaaagcaagaaguaguuguguugggcucccaggagggagcuaugcacacugcccucacaggcgcaaccgaaauucagaauucagggggaacaaguauauucgccggucaucugaagugucgguuaaaaauggacaagcuggagcuaaaaggcaugagcuacgcuaugugcacuaacaccuuuguccucaagaaagaggugucugaaacgcagcacgggaccauccugauuaaggucgaguacaagggagaagaugcgcccuguaaaaucccuuucuccacagaggacggccaagguaaggcacauaacgggcgucuuauaacugccaauccagugguuaccaaaaaggaggaacccgugaacauugaggcugaaccgccuuucggcgagucaaauaucguaaucggaauuggcgauaacgccuugaaaaucaauugguauaagaaggggagcaguauuggaaaaauguuugaagcaacagcccgcggugcuagaaggauggccauacugggcgacacugcaugggauuucgggucugucggaggcgugcucaacucccuggguaagaugguucaccagaucuuugggagcgcguacaccgcucuuuucucgggcgugucuugggucaugaaaauuggaaucggcgugcuguugacguggaucgggcucaauuccaagaacacaucaaugaguuuuagcugcauugccauaggaaucauuacccuguauuuaggcgcaguagugcaggccgacauggguuguguuaucaauuggaaagggaaggagcugaagugcggauccggcauuuucgucacuaacgaggugcauacauggaccgaacaguacaaauuucaagcugauucucccaagcggcuagccacugcaaucgcuggugccugggagaauggcgugugugggauacgaagcaccacacgcauggaaaaccuccuguggaaacagaucgcgaaugagcuuaacuauauuuugugggaaaauaacaucaagcugacggucguugugggagacauuaucggcgugcucgagcaggggaaaagaacccugacuccacagccuauggaguuaaaguacucauggaaaacauggggaaaggccaagauaguaaccgcugaaacacaaaacaguuccuucauuaucgauggccccaauacuccagagugccccagcgcaucuagggccuggaacgucugggaaguggaggacuaugguuuugggguuuucaccacgaauauuuggcugaaacuucgggaaguguacacacaguugugugaccaccgccucaugucagcugccgucaaggaugagagagcagugcacgcggacaugggauacuggaucgagagucagaaaaacggcagcuggaagcuggaaaaagccucccuaauagagguuaagaccugcacuuggccuaagucucauacccuguggucgaauggugugcucgaaagcgauaugaucauuccaaaaucccuggcuggcccgaucucacagcacaaccauaggcccggguaucacacacaaacugccggaccuuggcaccuuggcaaguuggagcuggacuuuaauuacugcgaggggaccacaguagucauuacggaaaacuguggaacccguggcccaaguuuacggacuacaaccgugucugguaaacucauccaugaguggugcugucgaagcugcacucugcccccucuuagauauaugggggaagauggauguugguacggcauggagauaaggccaauuuccgaaaaggaggagaauauggugaaaucacuggucagcgcagguucuggcaagguugacaacuucacaauggggguguugugccucgcuauccuguuugaagagguaaugcgcggaaaguucggcaaaaagcacaugaucgccgggguguucuuuaccuucguccuacugcucuccggacagauuacguggcgggauauggcacauacucugaucaugauuggcaguaaugccagcgacagaauggguaugggggugaccuaucuugcuuugauagcgacauuuaaaauccagcccuuccuggccuuaggauuuuuccucaggaagcugaccucucgcgaaaaccuucugcuaggcguuggccucgcaauggcuacuacacugcaauugccggaggauauugaacagauggccaaugggaucgcccugggauuaauggcucucaaacugauuacccaguuugagacauaccagcuuuggacugcacugaucuccuugaccuguucaaacacgauauucacacucaccguggccuggcgaacugcgacccugauccuagcuggugucagucugcuuccugugugccaaagcucguccaugcggaagacagacuggcucccaauggccguugcagccaugggcgugcccccucugcccuuguuuauuuucucucugaaggauacuuuaaaacguagaagcuggccacucaaugagggggucauggcuguaggacuggugucaauccuugcaaguucccuguugaggaacgacguuccuauggccggcccccucguggcgggugggcugcuaauugcuuguuaugucaucaccggaacgucugccgaucugacaguggaaaaggcagccgacauaaccugggaggaagaggcugaacagacuggcguaagccacaaccuuaugauuacaguggacgaugacggcaccaugcgcaucaaagaugacgagacugagaauauccucacaguccuguugaagaccgccuuacugauuguuuccgggauauuuccauacucaaucccggcaacgcuccugguguggcauacuuggcagaaacagacccaacggagcggagugcuuugggaugucccuagucccccagaaacacagaaggcugagcuggaagaggguguguacagaauuaaacagcagggcaucuucgggaagacccaaguuggaguaggcgugcagaaggagggugucuuucacacaauguggcacgugacuaggggggccguuuugaccuauaacggaaaacgacuagaacccaauugggcgucugugaagaaagaccugauuuccuacggcggcggguggcgccucagcgcccaguggcaaaagggagaggaaguccaggugaucgcaguagagccugguaaaaacccaaagaauuuccagacgaugcccggcacauuccagacuaccacaggggaaauaggagcuaucgcccuggauuuuaagccuggcaccucggguucaccgauuaucaaccgggaggggaaagucgugggacuuuauggcaauggcguugugacuaagaacgggggauacgucucugguauugcucaaaccaaugcagagccagacggccccacaccugaauuagaggaagagauguucaaaaagagaaaccugacgaucauggaucuccauccagggaguggaaaaacuaggaaguauuugcccgccauagugcgugaagccauuaagcgccggcugagaacccucauccuggcuccuacaaggguuguggcggcagagauggaggaagcccuuaaaggccugccgauccgauaccagaccacugcuacaaaguccgagcacaccggucgggaaauugucgacuugaugugccaugccacguuuacuaugcgccuacugagccccgugagaguaccaaauuauaaccucaucauaauggaugaggcacacuucacagacccugccucuauugcugcgaggggguacaucagcacccgggugggaaugggcgaagccgcagcuauuuuuaugaccgccacucccccaggcacagcagaugccuucccucaguccaaugcucccauccaggacgaggagcgagacauaccagaaagaucauggaacagugggaaugaguggauuaccgauuuugccggaaaaacaguuugguucgucccgagcaucaaggcggguaacgacaucgcaaacuguuuacgcaaaaauggcaagaaggugauucaacugucuaggaaaacuuuugauacggaauaccagaagaccaaacuuaacgacugggauuucguggucacaacugacaucuccgagaugggggccaauuuuaaggcugaucguguaauugacccucggagaugccugaaacccgugauacucaccgauggaccagagaggguuaucuuggccggccccaugccugugacagcugcaucagccgcucagcgccgagguagagucgggcggaacccacagaaggaaaaugaccaauauauuuucaccggccagccccugaacaaugaugaggaccaugcccacuggacugaagcaaagaugcuccuggacaacaucaauacgccugagggaaucauuccggcgcuuuucgaaccagagagggagaaaagugccgcuauagauggcgaauaccgccuaaagggggagagccguaaaaccuuuguggaacugaugagacggggagacuugcccguuugguuagcccacaagguggcauccgaggguaucaaauauacagauaggaaguggugcuucgacggccagcgcaacaaucagauucuggaagagaacauggaugucgagaucuggacuaaagaaggggagaagaagaaacuccgaccuagauggcuggacgcucggaccuacucugauccccuugcccugaaggaauuuaaagacuucgcagccggaaggaagucgauugcucucgauuuggugacagagaucggccgcguaccaagccaucuggcgcacagaaccaggaaugcccuagacaaccuggugaugcuccauacuucagaacacggugggcgggcauaucgucacgcuguugaggagcuuccugaaacaauggagacgcuguuauugcugggccucaugauacugcuuaccggaggcgccaugcuguuucucaucuccgggaaaggaauugguaagacuaguaucggcuugauuugugucaucgccucuagcgggaugcuguggauggcagaaauacccuuacaauggauugcuuccgccaucgugcuagaguucuuuaugauggugcugcucauuccagagccugaaaagcagcgcacaccgcaggauaaucaacuugcguacgucguuaucggaauacugaccuuggcugccaucauugcagccaacgagaugggccugcucgaaaccacaaaacgagaccuggguaugucaaaggagcccggggugguaucuccaacuagcuaucuugauguggaccuccauccugcuagugcauggacgcuguacgccgucgcgaccacagugaucacucccauguugagacacaccauugaaaauuccacagcuaacguuagccuggccgcaaucgccaaccaggcuguggucuuaaugggccuagacaaaggauggccaauaucuaagauggaucugggcguaccucuccuugcccuggggugcuacucacaggugaaucccuugacccugacugcagcuguucuccugcuuauuacgcauuaugccaucaucggaccgggcuuacaggcgaaagccacaagggaggcacaaaagcggaccgcugccgguauuaugaagaacccaacuguggacgggaucaugaccauagaucuggacccugucauuuacgauuccaaauucgagaagcagcucggacaggugauguugcugguccuaugugcagugcagcugcuccuuaugcgcacaaguugggcucugugcgaagccuugacucuggccaccggccccaucacaacgcucugggaggguagcccaggcaaauuuuggaauaccacuauugcgguuucgauggcuaacaucuucagagggucuuaucuggcaggagccggcuuagcuuuuuccauaaugaagagcguggggacaggaaaaaggggcaccgguucacaaggggaaacucuuggagagaaguggaagaaaaagcugaaucagcucagucggaaagaauucgaccuauacaagaaaucuggcaucacagagguagaucgaaccgaggccaaggaaggucugaaaagaggcgagauuacgcaccaugcagugucccgcgggagcgccaaguugcagugguuugucgaaaggaacaugguuauccccgagggacgggugauugaccugggcugugggcguggaggcuggucauauuacugcgcuggucucaagaaagucaccgaagugagaggguauacaaagggaggcccuggccacgaggagccgguacccaugaguacuuacggguggaauaucgugaaacuuaugagcggaaaggauguuuucuaccugccaccugaaaaaugugacaccuugcugugcgauauuggugaguccucucccagcccuacaguggaagaguccaggacuauccgcguccucaagaugguggagccaugguuaaagaacaaucaguucuguauaaaaguccugaaccccuauaugccuaccgugauugaacaccuugagcggcugcaacgaaagcauggcgggaugcuaguuagaaauccacucucaaggaacucuacacacgaaauguacuggaucaguaauggaaccggcaacaucguagcgucggugaauauggucagccgccuguugcugaaccgguuuacuaugacgcauagacgucccacaauugagaaagacguggaucucggugccgggaccaggcacguuaacgcagaaccggagacuccuaauauggacgugauaggagagcggaucaagcgcauuaaagaagagcacaacuccaccuggcauuaugacgaugaaaauccauacaagacaugggcuuaucacggcucuuacgaggucaaggccacgggcucagcaagcuccaugaucaacggggugguaaaacuucugaccaagcccugggacgugguuccuauggucacucagauggccaugacagauaccacuccauucggacagcaacgaguguuuaaagaaaagguggacacaagaacccccaggaguaugccggguacacggcgcgucaugggcauuacugcugagugguuauggagaacccuggggaggaauaaaaagccucgauugugcacgcgggaggaauucaccaagaaaguucguacaaacgccgcgaugggagcaguguuuacugaggaaaaucagugggauucugccaaggcugccguagaggacgaagauuucuggaaacucguggacagagagcgcgagcugcauaagcuaggcaaaugugguagcugcgucuauaacaugauggggaagagggaaaaaaagcuuggagaguuuggcaaggcaaaaggcucacgggcuaucugguacauguggcugggggccagauaccucgaauucgaggcucugggauuuuugaaugaggaucacugguucucccgcgaaaacaguuauagcgguguggagggcgaagggcugcauaagcucggauacauacuuagggacaucucuaaaauucccggcggugccauguaugcagaugacaccgcggggugggacacacgaaucacugaggaugaccugcacaaugaagagaagauuacccagcagauggauccagagcaccggcaauuagccaacgcuaucuuuaaacugacguaccagaauaagguugugaagguccagagaccuacacccaccggaacugugauggacauaauuuccaggaaagaucagcgcggcucaggccaaguagggacauauggauugaacaccuucacuaauauggaagcccagcucauccgucagauggagggugaaggcguucugagcaaggcagaccuagagucgcaucaccuuccagaaaaaaagaucacccaguggcuggagacaaaagggguggagcggcucaagagaauggcuauuucuggagaugacugcgucgugaagcccauagaugacagguuugccaacgcacuguuggccuuaaacgauaugggcaaagugcgcaaggacaucccucaauggcagccaaguaaagguuggcaugauuggcagcaggucccguucuguucccaccacuuccaugaacugauuaugaaggacgggcgaaaacucguugugcccugccggccucaagacgagcuuaucggaagagcgaggauuagccagggcgcuggcuggucacugcgcgaaacggccugucuagggaaggcauacgcccagauguggucccugauguauuuucacagacgggaucucagguuggcuucuaaugccaucugcagcgcaguaccagugcauuggguccccaccagucguacuacaugguccauacacgcucaucaccaauggaugaccacugaggacaugcugacaguguggaaccgaguuuggaucgaagauaauccuuggauggaggacaagaccccagugacgacaugggagaacguccccuaccuuggaaaacgcgaagaucaguggugugguagccugauuggccucaccucuagagccacuugggcgcagaauaucccuaccgcuauucagcaagugcggucauuaaucgggaacgaggaauuccuggacuacaugccgaguaugaagagguuucgcaaagaggaggaauccgagggagccauuugguga

SEQ ID NO: 15405 - RNA, 9873 nt, Artificial Sequence
  derived and/or modified CDS sequence (opt3) from DENV-3__EU529705__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcauugggaacagagacuuuguagaaggauugucaggugccaccuggguugaugugguccuggagcacggcgggugcgugacgacuauggcgaagaauaaacccacacuagacaucgagcuccagaagaccgaagcaacucaacuggccacacuuaggaaacuguguauugagggaaagaucaccaacauaacgaccgauagccggugcccuacacagggcgaagcuguguugccagaggaacaggaccagaauuaugucuguaaacacacuuacguugaucgcgguugggggaacggaugcggccucuucggcaaggggagucuggugaccugcgccaaguuucaauguuuagagcccauugagggaaaaguagugcaguaugaaaaucugaaguacacagucaucauuacugugcauaccggugaccagcaccagguuggcaacgagacacaaggggugaccgcagaaaucacuccucaggcuuccacgacagaggccauccucccagaauauggaacccuuggccuggagugcucuccgcgaacugguuuggacuucaaugagaugauucuacugaccaugaaaaacaaggcguggaugguccauagacagugguuuuucgaucucccccugccuuggacaagcggggccaccacugaaacaccaacguggaauaggaaagagcuucuggugaccuuuaagaacgcacacgcuaaaaagcaagaaguaguuguguugggcucccaggagggagccaugcacacugcucucacaggcgccaccgaaauacagaauucagggggaacaaguaucuucgcaggucaucugaagugucgguuaaaaauggacaagcugggccuaaaagggaugagcuacgccaugugcacuaacaccuuuguccucaagaaagaggugucugagacgcagcacggaaccauucugaucaaggucgaauacaagggcgaggaugugcccuguaaaguuccuuucuccacagaagacggucaagggaaggcucauucaggccgucuuauaacugcgaacccagugguaaccaaaaaggaggagcccgucaauauugaagcagagccgccuuucggagaaagcaacaucgugaucggcauuggggauaaugccuugaaaaucaacugguauaagaagggaaguucuauugguaaaauguuugaggcuacagcccgcggcgcaagaaggauggccauacugggggacacugcuugggauuucggauccguuggcggugugcucaauagccuggggaagaugguccaccagaucuuuggcucggccuacaccgcacuuuucucuggaguguccuggguaaugaaaauuggcaucgggauccuguugacguggauuggacucaacucaaagaauacaaguaugagcuuuuccugcauagugaucggcauuaucacccuguauuuaggugcgguuguccaggcugacauggggugugugauuaacuggaaaggaaaggaacugaagugcggcucugguaucuucgugacuaaugagguccauacauggaccgagcaguacaaauuucaagccgauagccccaagcggcuagcaacugccauagcuggcgccugggaaaacgggguuuguggaauccgaucaaccacacgcauggagaaucuccuguggaaacagauugcaaacgaacuuaauuauaucuugugggagaacaauauuaagcugacgguggugguaggcgacaucauagggguccucgaacagggaaaaagaacccugacuccacagccuauggaguuaaaguacaguuggaaagcuuggggcaaggccaagauugugacagcggagacccaaaacuccagcuucaucauugauggucccaacacaccagaaugccccucugccucaagggcuuggaauguuugggagguggaagacuauggguuuggagucuucacuaccaacaucuggcugaaacuucgggagguguacacgcaguugugugaccaccgccucaugagugcagccguuaaggaugaaagagcugugcacgccgacaugggcuacuggauagagagccagaaaaaugguuccuggaagcuggagaaagcaucucuaaucgaaguaaagacaugcaccuggccuaagucgcauacucuguggagcaacggcguccucgaguccgauaugauuaucccaaaaucacuggcggggccgauuagucagcacaauuauaggcccggauaccauacccaaacagccggcccuuggcaccuugggaaguuggaacuggacuuuaacuauugcgagggaacuaccguggugaucacagagaauuguggcacgcgugguccaucuuuacggaccacuacagucagcgggaaacucauacacgaauggugcugucgauccugcacccugcccccucuuagauacaugggagaggauggcuguugguaugguauggaaauuaggccaaucucagagaaggaagagaacaugguuaaaagccuggugucugcuggcuccgggaagguagacaauuucacuaugggaguguugugccucgccauccuguuugaggaagucaugcgcggcaaguucgggaaaaagcauaugauugcaggaguguucuuuacauucguucuacugcucaguggccagaucaccuggcgggauauggcucacacgcugauuaugauagguagcaacgccucugacagaauggggaugggagugacuuaccuugcauugaucgccaccuuuaaaauucagcccuuccuggcuuuaggcuuuuuccucaggaagcugacaucccgcgagaaucuucugcuaggcgucgggcucgcgauggccaccacucugcaauugccggaagauaucgagcagauggcaaacggaauugcucuggguuuaauggcccucaaacugaucacacaguuugaaaccuaucagcuuuggacagcccugauaucauugacuuguaguaauaccaucuucacgcucacaguggcuuggcgaaccgcaacucugauucuagccggcguuagccugcuuccugugugccaaucguccucuaugcggaagaccgacuggcucccaaugacagucgcggcuauggggguacccccucugcccuuguuuaucuucagccugaaggauacuuuaaaacguagaucauggccacucaacgagggagugauggccguuggccuggugaguauucuugcauccucucuguugaggaaugacgucccuauggccgguccccucguggcugggggacugcuaaucgcauguuacguaauaaccggcacgagcgccgaucugacaguggagaaggcggcugacgucaccugggaagaggaagccgagcagacuggcguuucccauaaccuuaugauuacaguggacgaugacgggaccaugcgcaucaaagaugacgaaacugagaacauccucacagugcuguugaagaccgcauuacugauugucucaggaauauuuccauacagcaucccggccacgcuccugguguggcacacuuggcagaaacagacccaacggagugguguucuuugggauguaccuucucccccagagacacagaaggcugaacuggaggaaggcguguauagaauuaaacagcaggggaucuucggaaagacccaagucggcguggguguucagaaggaggggguguuucauacaauguggcacgucacuaggggagccguguugaccuacaauggcaaacgacuagagcccaacugggcauccguaaagaaagaccugauuagcuauggcgggggauggcgccucucggcucaguggcaaaagggugaagagguccaggugaucgccguugaaccuggcaaaaauccaaagaacuuccagacgaugcccgggacauuccagacuaccacaggagagauaggcgcgaucgcccuggauuuuaagccugguaccucagggucuccgauuaucaaucgggaaggaaaaguggucggccuuuacggcaacggggugguuacuaagaauggagguuaugugaguggcauugcacaaaccaacgcugagccagacgggcccacaccugaguuagaagaggaaauguucaaaaagagaaaucugacgaucauggaucuccacccaggauccggcaaaacuaggaaguacuugcccgccauaguccgugaggcuauuaagcgccggcugagaacccucauccuggcaccuacaagggugguagccgccgaaauggaggaggcucuuaaaggucugccgauccgauaucagaccacugcgacaaagagcgaacauaccgggcgggagauuguggacuugaugugccacgcaacguuuacuaugcgccuacugucucccguuagagucccaaacuacaaucucaucauaauggaugaagcccauuucacagacccugcuagcauugccgcaaggggauacaucuccacccgggugggcaugggcgaggccgcugcgauuuuuaugaccgccacucccccagggacagcagaugcuuucccucagucaaacgcccccauccaggacgaagagcgagacauaccagagagaaguuggaauagcggaaacgaauggauuaccgauuuugcagguaaaacagugugguucgucccgucuaucaaggccggcaaugacaucgcuaacuguuuacgcaaaaacgggaagaagguaauucaacuguccaggaaaacuuuugauacggaguaucagaagaccaaacuuaaugacugggauuucgugguuacaacugacaucucagaaaugggagccaacuuuaaggcggaucgugugauugacccucggagaugccugaaacccgucauacucaccgauggcccagagagggugaucuuggcaggucccaugccuguuacagccgcuagugccgcucagcgccgagggagagugggccggaauccacagaaggagaacgaccaauacauuuucaccggacagccccugaauaacgaugaagaccacgcacauuggacugaggccaagaugcuccuggacaauaucaacacgccugaaggcaucauuccggcucuuuucgagccagaaagggagaaaagcgccgcaauagauggggaguaucgccuaaagggagaaucccguaaaaccuuugucgagcugaugagacggggugacuugcccgugugguuagcgcacaagguagccucugaaggcaucaaauacacagauaggaaguggugcuucgacgggcagcgcaauaaccagauucuggaggaaaauauggauguggagaucuggacuaaagagggagaaaagaagaaacuccgaccuagauggcuggacgcucggaccuauucggauccccuugcccugaaggaguuuaaagacuucgcagcuggcaggaagagcauugcccucgauuugguuacagaaaucggucgcgucccaucacaccuggcacauagaaccaggaacgcccuagacaaucuggugaugcuccacacuuccgagcaugggggccgggcuuaccgucacgcgguggaagagcuuccugagacaauggaaacgcuguuauugcugggacucaugauacugcuuaccggcggggccaugcuguuucucaucaguggaaaagguauuggcaagacuucuaucggguugauuugugucaucgcaagcuccggaaugcuguggauggcugagauacccuuacaauggauugccucagccaucguucuagaauucuuuaugauggugcugcucauuccagagccugagaagcagcgcacaccgcaggauaaccaacuugcauauguagugaucggcauacugaccuuggcugccaucauugcggcuaaugaaaugggucugcucgagaccacaaaacgagaccuggggaugucuaaggaacccggcgucgugagcccaacuaguuaccuugauguugaccuccacccugccuccgcauggacgcuguacgccguggcuaccacagucaucacucccauguugagacauaccauugagaacagcacagcaaauguaucucuggccgcgaucgcuaaccaggccgugguuuuaaugggacuagacaaaggcuggccaauaucaaagauggaucugggggugccucuccuugcacugggaugcuauucccaggucaaccccuugacccugacugccgcugugcuccugcuuauuacgcacuacgccaucaucggcccggguuuacaggcaaaagcuacaagggaagcccaaaagcggaccgcggccgggauuaugaagaauccaacugucgacggaaucaugaccauagaucuggacccugugauuuaugauaguaaauucgagaagcagcucggccagguuauguugcuggugcuaugugcaguacagcugcuccuuaugcgcacaagcugggcucugugcgaggccuugacucuggcaaccggucccaucacaacgcucugggaaggcucgccagggaaauuuuggaacaccacuauugcugugucuauggccaauaucuucagaggauccuaccuggccggcgcgggguuagcuuuuagcauaaugaagucagucggaacaggcaaaagggguaccgggagucaaggagagacucuuggcgaaaaguggaagaaaaagcugaaccagcucucucggaaagaguucgaccuauauaagaaauccgguaucacagaaguugaucgaaccgaggcaaaggagggccugaaaagaggggaaauuacgcaucacgccgugagccgcggaucagcuaaguugcagugguuugucgagaggaauauggugauccccgaaggccggguaauugaccugggguguggacguggcgguuggaguuacuauugcgccgggcucaagaaagugaccgagguuagaggauacacaaagggcggcccugggcaugaagagccggugcccaugagcacuuacggauggaacaucgucaaacuuauguccgguaaggauguguucuaucugccaccugagaaaugugacaccuugcugugcgauauuggcgaaucuagccccuccccuacagucgaggaaucaaggacuauccgcgugcucaagaugguugagccaugguuaaagaauaaccaguucuguauaaaaguacugaaucccuacaugccuaccgugauugagcaccuugaacggcugcaacgaaagcacgggggaaugcuagucagaaacccacucucuaggaauaguacacaugagauguauuggaucucgaacggcaccgguaauaucguggcaagcguuaacauggugucccgccuguugcugaaucgguuuacuaugacgcacagacgucccacaauugaaaaagacgucgaucucggggccggaaccaggcaugugaacgcugagccggaaacuccuaacauggacguaauaggcgagcggaucaagcgcauuaaagaggaacacaauucuaccuggcacuacgacgaugagaacccauauaagacaugggcguaccauggcucauaugaagugaaggccacggggagcgcauccaguaugaucaauggaguugucaaacuucugaccaagcccugggacguggugccuauggucacucagauggcuaugacagauaccacuccauucggucagcaacgaguuuuuaaagagaagguggacacaagaacccccaggucuaugccgggcacacggcgcguaauggggauuacugccgaaugguuauggagaacccugggaaggaacaaaaagccucgauugugcacgcgggaggaguucaccaagaaagugcguacaaaugcagccaugggcgcugucuuuacugaagagaaccagugggauagcgccaaggcggcaguggaagacgaggauuucuggauccucguugacagagaacgcgagcugcacaaacuagguaagugugggucaugcguguacaauaugaugggaaaaagggagaagaaacuuggcgaauuuggcaaggccaaggggucccgggcuauaugguacauguggcugggagccagauaucucgaguucgaagcacuggguuuuuugaacgaggaucauugguucagucgcgagaauagcuacucuggcgucgaaggggagggacugcacaaacucggcuauauccuuagggacauuuccaagauccccgguggggcuauguacgccgaugacaccgcuggaugggacacacgaauuacugaagaugaccugcauaacgaggaaaaaaucacccagcagauggauccagagcaccggcaauuagccucagcaauauuuaagcugacguaucagaauaaagugguaaagguucagagaccuacacccaccggcacugugauggacauuaucagcaggaaggaucagcgcggcucggggcaagucggaacauacgguuugaacaccuucacuaauauggaggcgcagcucauccgucagauggaaggcgagggggugcugucuaaagccgaccuagaaaacccacaccuucccgagaagaaaauuacccaguggcuggaaacaaagggaguggagcggcucaaaagaauggcuauaaguggcgaugacugcgucguuaagccuaucgaugacagguuugccaaugcacuguuggcuuuaaacgauauggguaaggugcgcaaagacauuccacaauggcagccguccaagggguggcaugauuggcagcagguacccuucuguagccaccauuuccacgagcugaucaugaaagacggacgaaagcucguggucccuugccggccacaagacgaacuuauuggcagagccaggaucucacagggcgcaggguggucccugcgcgagacggccugucuaggaaaagcguaugcucagauguggucucugauguacuuucacagacgggaucucagguuggccagcaacgcaauaugcagugccgugcccguucauugggugccuaccucccguacuacauggagcauccacgcucaucaccaauggaugaccacugaagacaugcugacagucuggaaucgaguguggauugaggauaacccauggauggaagacaagacccccguaacgacaugggagaauguuccuuaccuugguaagcgcgaggaucagugguguggcucucugaucgggcucaccucaagagccacuugggcacagaacauuccgaccgcuauccagcaagugcggaguuuaauuggaaaugaagaguuccuggacuauaugccauccaugaaaagguuucgcaaggaagaggagagcgaaggcgccauaugguga

SEQ ID NO: 15406 - RNA, 9873 nt, Artificial Sequence
  derived and/or modified CDS sequence (opt3) from DENV-3__EU596492__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauugcugaaguugagccggaagacaucgauugcugguguaaccugacuaguaccugggugacauaugggaccugcaaucaggccggagagcaccgccgagacaagcguagcguagcacuugccccccaugugggcaugggucuggauacuagaacacaaaccuggauguccgcugagggggcauggaggcaggucgaaaaaguggagacgugggccuugcggcacccuggauucacuauucucgcucuguuucuggcccauuacaucggcaccucucucacacagaagguugugauauucgucuuacugaugcuugugacuccaucgaugaccaugcgcuguguaggcguugggaacagagacuuuguggaaggauugucaggugcgacaugggucgauguggugcuggagcacggcgggugcgucaccacgauggcaaagaauaaacccacucuagacaucgagcuccagaagacagaagccacccaacuggcuacucuuaggaaacuguguauugagggaaagaucacaaacauuaccacggauagccggugcccuacccagggcgaagccgcauugccagaggaacaggaccagaauuauguuuguaaacacacauacguggaucgcgguugggggaacggaugcggccucuucggcaaggggagucugguaacuugcgcuaaguuucaauguuuagagcccaucgagggaaaagugguccaguaugaaaaucugaaguacaccgugauaauuacaguucauacuggugaccagcaccaggugggcaacgagacccaaggggucacagccgaaaucaccccucaggcguccacuacggaggccauucucccagaauauggaacacuuggccuggagugcucuccgcgaaccgguuuggacuucaaugagaugauccuacugacuaugaaaaacaaggcauggauggugcauagacagugguuuuucgaucucccccugccuuggaccagcggggcuacaaccgaaacuccaacauggaauaggaaagagcuucugguaacguuuaagaacgcccacgcuaaaaagcaagaaguuguggucuugggcucccaggagggagccaugcacaccgcacucacuggcgccacagaaauccagaauucagggggaaccaguauuuucgcuggucaucugaagugucgguuaaaaauggacaagcuggagcuaaaaggcaugagcuacgcgaugugcacaaacacuuuugugcucaagaaagaggucucugaaacccagcacgggacgauacugaucaagguggaguacaagggagaagaugcacccuguaaaauuccuuucuccaccgaggacggccaagguaaggcccauaacgggcgucuuaucacagcuaauccaguugugacuaaaaaggaggaacccguaaacauagaggccgaaccgccuuucggcgagucaaauauugucaucggaaucggcgauaacgcauugaaaauuaauugguauaagaaggggagcaguaucggaaaaauguuugaagccaccgcucgcggugccagaaggauggcaauucugggcgacacagcgugggauuucgggucugugggaggcguucucaacucccuggguaagauggugcaccagauauuugggagcgcuuacacugcccuuuucucgggcgucucuugggugaugaaaaucggaauuggcguacuguugaccuggaucgggcucaauuccaagaacacgucaaugaguuuuagcugcaucgcaauuggaauaaucacacuguauuuaggcgccgugguucaggcugacaccgguugugucgugaauuggaaagggaaggagcugaagugcggauccggcauuuucgugacuaacgagguccauacauggaccgaacaguacaaauuucaagccgauucucccaagcggcuagcaacugcuaucgccggugcgugggagaauggcguuugugggauucgaagcaccacacgcauggaaaaccuccuguggaaacagguggccaaugagcuuaacuauaucuugugggaaaauaacauaaagcugacggugguagucggagacaucauuggcgugcucgagcaggggaaaagaacccugacuccacagccuauggaguuaaaguacucauggaaaacauggggaaaggcuaagaucguuaccgcagaaacacaaaacaguuccuucauuaucgauggccccaauacuccagagugccccagcgccucuagggcuuggaacgugugggaagucgaggacuaugguuuugggguguucaccacgaauauauggcugaaacuucgggaaguuuacacacaguugugugaccaccgccucaugucagccgcagugaaggaugagagagcgguacacgccgacaugggauacuggauugagagucagaaaaacggcagcuggaagcuggaaaaagcuucccuaaucgaggucaagaccugcacuuggccuaagucucauacccuguggucgaauggugugcucgaaagcgauaugauuaucccaaaaucccuggccggcccgauaucacagcacaacuauaggcccggguaccauacacaaacugcaggaccuuggcaccuuggcaaguuggagcuggacuuuaauuauugcgaggggaccacaguggucaucacggaaaacuguggaacccguggcccaaguuuacggacuacaaccguuucugguaaacucauucacgaguggugcugucgaagcugcacucugcccccucuuagauacaugggggaagauggauguugguauggcauggagaucaggccaauuuccgaaaaggaggagaauauggugaaaucacugguaagcgcugguucuggcaagguggacaacuucacaaugggggucuugugccucgccauccuguuugaagaggugaugcgcggaaaguucggcaaaaagcauaugauagcagggguuuucuuuaccuucgugcuacugcucuccggacagauuacguggcgggauauggcccacacucugaucaugaucggcaguaaugcuagcgacagaauggguaugggggucaccuaccuugcguugauugccacauuuaaaauccagcccuuccuggcauuaggauuuuuccucaggaagcugaccucucgcgaaaaccuucugcuaggcgugggccucgcuauggccacuacacugcaauugccggaggauauugaacagauggccaaugggauagcucugggauuaauggcacucaaacugaucacccaguuugagacauaucagcuuuggacugcccugauuuccuugaccuguucaaacacgaucuucacacucaccguugcguggcgaacugcuacccugauucuagccggugugagucugcuuccugucugccaaagcucguccaugcggaagucugacuggcucccaaugacaguagcagccaugggcgugcccccucugcccuuguuuaucuucagccugaaggauacuuuaaaacguagaucauggccacucaaugaggggguuauggcugugggacuggucaguauacuugcauccucucuguugaggaacgacgugccuauggccggcccccucguagcgggugggcugcuaaucgcuuguuacgugauuaccggaacgagcgccgaucugacagucgaaaaggcagccgacguuaccugggaggaagaggcugaacagacuggcgugucccauaaccuuaugaucacaguggacgaugacggcaccaugcgcauuaaagaugacgagacugagaauauccucacaguccuguugaagaccgccuuacugauagugucagggauuuuuccauacagcaucccggcaacgcuccugguuuggcacacuuggcagaaacagacccggagaaguggaguacuuugggaugugccuucucccccagaaacacaaaaggcugagcuggaagagggugucuauaggaucaaacagcagggcauuuucgggaagacccaggugggaguuggcgugcaaaaggagggugucuuucauacaauguggcacgugacucgaggggccguauugaccuacaacggaaaacgccuagaacccaauugggcguccgucaagaaagaccugauaagcuauggcggcggguggcggcucucggcccaguggcagaagggagaggaagugcaaguuaucgcaguggagccugguaaaaacccaaagaauuuccagacgaugcccggcacauuccagacuaccacaggggaaauuggagcuaucgcccuggauuuuaagccuggcaccucagguucuccgauuaucaacagagaggggaaagucgugggacuuuacggcaauggcguugugacuaagaacgggggauaugucagugguauagcucagaccaaugcagagccagacggccccacaccugaauuagaggaagagauguucaaaaagaggaaccugacgaucauggaucuccacccaggguccggaaaaacucguaaguacuugcccgccauugugcgcgaagccaucaagcggagacugaggacccucauucuggcuccuacacgaguaguggcggcagagauggaggaagcccuuaaaggccugccgauccgguaucaaaccacugcuacaaagagcgagcauaccggucgcgaaauaguugacuugaugugccacgccacguuuacuaugagacuacugucucccgucagggugccaaauuacaaccucauuaucauggaugaggcacauuucacagacccugccagcaucgcugcgcggggguacauuuccacccgagugggaaugggcgaagccgcagcuaucuuuaugaccgccacucccccaggcacagcagaugccuucccucagucaaaugcucccauacaggacgaggagagagacauuccagaacgcaguuggaacagcgggaaugaguggaucaccgauuuugccggaaaaacagucugguucguaccgucuauuaaggcggguaacgacaucgcaaacuguuuaaggaaaaauggcaagaaggugauacagcugucccguaaaacuuuugauacggaauaucaaaagaccaaacuuaacgacugggauuucguugugacaacugacauuucagagaugggggccaauuuuaaggcugaucgggucaucgacccuagaaggugccugaaacccgugauccucaccgauggaccagagcgcguuauuuuggccggccccaugccugugacagcugcaagugccgcucagcgaagaggucgggucgggaggaacccacagaaggaaaaugaccaguacaucuucaccggccaaccccugaacaaugaugaggaccacgcccauuggacugaagcaaagaugcuccuggacaacauuaauacgccugagggaauaaucccggcgcuuuucgaaccagagcgcgagaaaagcgccgcuauugauggcgaauaucgucuaaagggggaguccagaaaaaccuuuguggaacugaugcggaggggagacuugcccguaugguuagcccacaagguggcaucugaggguaucaaauacacagaucgcaaguggugcuucgacggccagcgaaacaaucagauccuggaagagaacauggauguugagauuuggacuaaagaaggggagaagaagaaacucagaccucgguggcuggacgcuaggaccuauucggauccccuugcccugaaggaauuuaaagacuucgcagccggacgcaagagcauagcucucgauuuggucacagagaucggcagagugccaucacaccuggcgcauaggacccggaaugcccuagacaaccuggugaugcuccacacuuccgaacauggugggaaagcauaccgucacgcugucgaggagcuuccugaaacaauggagacgcuguuauugcugggccucaugauucugcuuaccggaggcgccaugcuguuucucaucagugggaagggaauugguaagacuucuaucggcuugauauguguuaucgccagcuccgggaugcuguggauggcagaaauucccuuacaguggaucgcuucagccauugugcuagaguucuuuaugaugguacugcucaucccagagccugaaaaacaacgcacaccgcaggauaaucagcuugcguauguggucauaggaauucugaccuuggcugccaucauugcagccaacgagaugggccugcucgaaaccacaaagcgagaccuggguaugucuaaagagcccggggugguuagcccaacuaguuaccuugauguggaccuccacccugcuuccgcauggacgcuguacgccgucgcgaccacaguaaucacucccauguugagacauaccauagaaaauagcacagcuaacgugucucuggccgcaaucgccaaccaagcuguuguguuaaugggccuaaauaagggauggccaauuucaaaaauggaccugggcgucccucuccuugcccuggggugcuauucccaggugaaccccuugacccugacugcagcuguccuccugcuuaucacgcacuacgccauuaucggaccgggcuuacaggcgaaggccacaagggaggcacagaagcggaccgcugccgguauaaugaaaaauccaacuguggaugggauuaugaccaucgaccuggauccuguuaucuaugacaguaaguucgagaaacaacucggacaggugauguugcugguacuaugugcagugcagcugcuccuuaugcgcacaagcugggcucugugcgaagccuugacucuggccaccggccccauuacaacgcucugggaggguucgccaggcaaguuuuggaacaccacuaucgcggucucuauggcuaauauauucagaggguccuaccuggcaggagccggcuuagcuuuuagcauuaugaaaucaguugggacaggaaagaggggcaccgguagucagggggaaacucuuggagagaaguggaaaaagaaacugaaccaacucucucggaaggaauucgaucuauauaaaaaguccggcaucacagagguggaccgaaccgaggccaaagaaggucugaagagaggcgagauuacgcaucacgcagucagccgcgggucagccaaguugcagugguuuguggaaaggaauaugguaauccccgagggacgggugauagaucugggcugugggcguggaggcuggaguuacuauugcgcuggucucaaaaagguuaccgaagugagaggguacacaaaaggaggcccuggccaugaggagccgguccccaugagcacuuacggguggaacaucgugaagcuuauguccggaaaagacgucuucuaucugccaccugaaaagugugauaccuugcugugcgacauuggugagucuagccccuccccuacaguggaagagucaaggacuauccgcguucucaagaugguagagccaugguuaaaaaauaaccaguucuguauuaaggugcugaaucccuacaugccuaccgucaucgaacaccuugagcggcugcagcgaaaacacggcgggaugcuagugagaaacccacucucuaggaauaguacacaugaaauguauuggauuucgaacggaaccggcaauaucguugcgagcgugaacauggucucccgccuguugcugaaccgguuuacuaugacgcacagacgucccacaauagagaaggauguggaccucggugccgggaccaggcauguaaaugcagaaccggagacuccuaacauggaugugauuggagagcggaucaaacgcaucaaggaagagcacaauucuaccuggcacuacgacgacgaaaacccauauaagacaugggcuuaccauggcucauaugagguuaaagccacgggcagcgcauccaguaugauuaauggggucgugaagcuucugaccaaacccugggauguggucccuaugguuacucaaauggccaugacagacaccacuccauucggacagcagcgaguguuuaaggaaaaaguagauacaagaacccccaggucuaugccggguacacggcgcgugaugggcauaacugcugagugguuauggagaacccuggggaggaacaagaagccucgauugugcacgcgggaggaauucaccaaaaagguccguacaaaugccgcgaugggagcaguguuuacugaggaaaaccaaugggacagcgccaaagcugccguugaggaugaagacuucuggaagcucguggauagagagcgcgagcugcacaaacuaggcaagugugguucaugcgucuacaauaugauggggaaaagggaaaagaagcuuggagaguuuggcaaagcaaagggcucccgggcuaucugguacauguggcugggggccagauaucucgaauucgaggcucugggauuuuugaacgaggaccauugguucagucgcgaaaauagcuacucugguguggagggcgaagggcugcacaaacucggauauauucuuagggauaucuccaagauucccggcggugccauguacgcagacgauaccgcggggugggacacacgaaucacugaggacgaucugcauaacgaagagaaaauaacccagcagauggacccagagcaccggcaguuagccaaugcuaucuuuaagcugacguaucaaaacaagguaguuaaagugcagagaccuacacccaccggaacugucauggauauuaucucaaggaaggaccagcgcggcagcggccagguggggacauacggauugaauaccuucacuaacauggaagcccaacucauucgucagauggagggugaaggcgugcugaccaaagcagaucuagagaacccacaccuuucggaaaagaaaaucacacaguggcuggagacgaagggggucgagcggcucaagagaauggcuauaucuggagacgauugcguugugaaacccauugacgauagguuugccaaugcacuguuggccuuaaacgacaugggcaagguacgcaaagauaugccucaguggcaaccaaguaaggguuggcaugacuggcagcaggugccguucuguucccaccauuuccacgaacugaucaugaaagaugggcgaaagcucgucgugcccugccggccucaggacgagcuuaucggaagagcgaggauuagccaaggcgcuggcuggucacugcgcgaaaccgccugucuagggaaggcauaugcccagauguggucccugauguacuuucacagacgggaccucagguuggcuucuaaugccauaugcagcgcaguuccagugcauuggguccccacuagucguacaaccugguccauccacgcucaucaccaguggaugacuacagaggauaugcugaccguguggaaccgaguauggauugaagacaauccuuggauggaggauaaaacgccaguuacaaccugggagaacgugcccuaccuuggaaagcgcgaagaccaauggugugguagccugaucggccucacuucuagagccaccugggcgcagaauauuccuacagcuauccagcagguccggucauuaauagggaacgaggaauuccuggauuauaugccgaguaugaaaagguuucgcaaggaggaggaauccgagggagccaucugguga

SEQ ID NO: 15407 - RNA, 9873 nt, Artificial Sequence
  derived and/or modified CDS sequence (opt3) from DENV-3__EU596493__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauugcugaaguugagccggaagacaucgauugcugguguaaccugacuaguaccugggugacauaugggaccugcaaucaggccggagagcaccgccgagacaagcguagcguagcacuugccccccaugugggcaugggucuggauacuagaacacaaaccuggauguccgcugagggggcauggaggcaggucgaaaaaguggagacgugggccuugcggcacccuggauucacuauucucgcucuguuucuggcccauuacaucggcaccucucucacacagaagguugugauauucgucuuacugaugcuugugacuccaucgaugaccaugcgcuguguaggcguugggaacagagacuuuguggaaggauugucaggugcgacaugggucgauguggugcuggagcacggcgggugcgucaccacgauggcaaagaauaaacccacucuagacaucgagcuccagaagacagaagccacccaacuggcuacucuuaggaaacuguguauugagggaaagaucacaaacauuaccacggauagccggugcccuacccagggcgaagccguuuugccagaggaacaggaccagaauuauguguguaaacacacauacguagaucgcgguugggggaacggaugcggccucuucggcaaggggagucuggugacuugcgcaaaguuucaauguuuagagcccaucgagggaaaagucgugcaguaugaaaaucugaaguacaccguuauaauuacagugcauacuggugaccagcaccaggucggcaacgagacccaaggggugacagcugaaaucaccccucaggccuccacuacggaggcgauucucccagaauauggaacacuuggccuggagugcucuccgcgaaccgguuuggacuucaaugagaugauccuacugacuaugaaaaacaaggccuggaugguacauagacagugguuuuucgaucucccccugccuuggaccagcggggcaacaaccgaaacuccaacauggaauaggaaagagcuucugguuacguuuaagaacgcucacgccaaaaagcaagaaguggucguguugggcucccaggagggagcuaugcacaccgcccucacuggcgcaacagaaauccagaauucagggggaaccaguauuuucgccggucaucugaagugucgguuaaaaauggacaagcuggagcuaaaaggcaugagcuacgcuaugugcacaaacacuuuuguccucaagaaagaggugucugaaacccagcacgggacgauacugaucaagguugaguacaagggagaagaugcgcccuguaaaauuccuuucuccaccgaggacggccaagguaaggcacauaacgggcgucuuaucacagccaauccagugguaacuaaaaaggaggaacccgucaacauagaggcugaaccgccuuucggcgagucaaauauugugaucggaaucggcgauaacgccuugaaaauuaauugguauaagaaggggagcaguaucggaaaaauguuugaagcaaccgcccgcggugcuagaaggauggccauucugggcgacacagcaugggauuucgggucuguuggaggcgugcucaacucccuggguaagaugguccaccagauauuugggagcgcguacacugcucuuuucucgggcgugucuuggguaaugaaaaucggaauuggcgugcuguugaccuggaucgggcucaauuccaagaacacgucaaugaguuuuagcugcaucgccauuggaauaaucacacuguauuuaggcgcaguuguccaggccgacaccgguugugugauuaauuggaaagggaaggagcugaagugcggauccggcaucuucgugacuaacgagguccauacauggaccgaacaguacaaauuucaagcugauucucccaagcggcuagccacugcaauugcuggugccugggagaauggcguuugugggauccgaagcaccacacgcauggaaaaccuccuguggaaacagguggcgaaugagcuuaacuauauauugugggaaaauaacaucaagcugacggugguagucggagacauuaucggcgugcucgagcaggggaaaagaacccugacuccacagccuauggaguuaaaguacucauggaaaacauggggaaaggccaagauuguuaccgcugaaacacaaaacaguuccuucaucauagauggccccaauacuccagagugccccagcgcaucuagggccuggaacgugugggaagucgaggacuaugguuuugggguguucaccacgaauauuuggcugaaacuucgggaaguuuacacacaguugugugaccaccgccucaugucagcugccgugaaggaugagagagcaguacacgcggacaugggauacuggaucgagagucagaaaaacggcagcuggaagcuggaaaaagccucccuaauugaggucaagaccugcacuuggccuaagucucauacccuguggucgaauggugugcucgaaagcgauaugaucauaccaaaaucccuggcuggcccgaucucacagcacaacuauaggcccggguaccauacacaaacugccggaccuuggcaccuuggcaaguuggagcuggacuuuaauuauugcgaggggaccacaguggucauuacggaaaacuguggaacccguggcccaaguuuacggacuacaaccguuucugguaaacucauccacgaguggugcugucgaagcugcacucugcccccucuuagauacaugggggaagauggauguugguauggcauggagauuaggccaaucuccgaaaaggaggagaauauggugaaaucacugguaagcgcagguucuggcaagguggacaacuucacaaugggggucuugugccucgcuauacuguuugaagaggugaugcgcggaaaguucggcaaaaagcauaugauugccgggguuuucuuuaccuucgugcuacugcucuccggacagaucacguggcgggauauggcacacacucugaucaugauuggcaguaaugccagcgacagaauggguaugggggucaccuaccuugcuuugaucgcgacauuuaaaauucagcccuuccuggccuuaggauuuuuccucaggaagcugaccucucgcgaaaaccuucugcuaggcgugggccucgcaauggcuacuacacugcaauugccggaggauauagaacagauggccaaugggaucgcccugggauuaauggcucucaaacugauuacccaguuugagacauaucagcuuuggacugcacugaucuccuugaccuguucaaacacgauuuucacacucaccguugccuggcgaacugcgacccugauccuagcuggugugagucugcuuccugucugccaaagcucguccaugcggaagucugacuggcucccaaugacaguagccgcaaugggcgugcccccucugcccuuguuuauauucagccugaaggauacuuuaaaacguagaucauggccacucaaugaggggguuauggccgugggacuggucaguauccuugcuuccucucuguugaggaacgacgugccuauggcaggcccccucguagccggugggcugcuaauugcguguuacgugaucaccggaacgagcgcugaucugacagucgaaaaggccgcagacguuaccugggaggaagaggccgaacagacuggcgugucccauaaccuuaugauuacaguggacgaugacggcaccaugcgcaucaaagaugacgagacugagaauauacucacaguccuguugaagaccgcuuuacugauugugucagggaucuuuccauacagcaucccggccacgcuccugguuuggcacacuuggcagaaacagacccggagaaguggaguacuuugggaugugccuucucccccagaaacacaaaaggcagagcuggaagagggugucuauaggauuaaacagcagggcauauucgggaagacccaggugggaguuggcgugcaaaaggagggugucuuucauacaauguggcacgugacucgaggggcuguauugaccuacaacggaaaacgccuagaacccaauugggccuccgucaagaaagaccugaucagcuauggcggcggguggcggcucaacgcgcaguggcagaagggagaggaagugcaaguuauugccguggagccugguaaaaauccaaagaacuuccagacgaugcccggcacauuccagacuaccacaggggaaaucggagcaauugcucuggauuuuaagccuggcaccucggguucaccgaucauaaauagagaggggaaagucgugggacuuuacggcaacggcguugugacuaagaaugggggauaugucucugguaucgcccagaccaacgcugagccagacggccccacaccugaauuagaggaagagauguucaaaaagaggaaucugacgauuauggaucuccacccagggaguggaaaaacucguaaguacuugcccgcaaucgugcgcgaagccauuaagcggagacugaggacccucauccuggccccuacacgaguaguggcugcggagauggaggaagcacuuaaaggccugccgauacgguaucaaaccacugccacaaaguccgagcauaccggucgcgaaauuguugacuugaugugccacgcuacguuuacuaugagacuacugagccccgucagggugccaaacuacaaucucaucaucauggaugaggcccauuucacagacccugcaucuauugccgcucggggguacaucagcacccgagugggaaugggcgaagcggccgcaauauuuaugaccgcuacucccccaggcacagccgaugcauucccucaguccaacgcccccauucaggacgaggagagagacaucccagaacgcucauggaauagugggaacgaguggauuaccgauuuugcuggaaaaacagucugguucguaccgagcaucaaggccgguaacgacauagcgaauuguuuaaggaaaaacggcaagaaggugauucagcugucucguaaaacuuuugauacggaauaucaaaagaccaaacuuaaugacugggauuucguugugacaacugacaucuccgagaugggggcaaacuuuaaggccgaucgggucaucgacccuagaaggugccugaaacccgugauucucaccgauggaccagagcgcguuaucuuggcuggccccaugccugugacagccgcuucagcagcccagcgaagaggucgggucgggaggaauccacagaaggaaaacgaccaguacauuuucaccggccaaccccugaauaacgaugaggaccacgcucauuggacugaagccaagaugcuccuggacaauauaaacacgccugagggaaucauuccggcacuuuucgaaccagagcgcgagaaaagugcggccaucgauggcgaauaucgucuaaagggggagagcagaaaaaccuuuguggaacugaugcggaggggagacuugcccguaugguuagcucacaagguggccuccgaggguaucaaauacacagaucgcaaguggugcuucgacggccagcgaaauaaccagauucuggaagagaauauggauguugagauauggacuaaagaaggggagaagaagaaacucagaccucgguggcuggacgcaaggaccuauucugauccccuugcucugaaggaauuuaaagacuucgccgcaggacgcaagucgaucgcccucgauuuggucacagagauuggcagagugccaagccaccuggcucauaggacccggaacgcgcuagacaaucuggugaugcuccacacuucagaacauggugggaaagccuaccgucacgcagucgaggagcuuccugaaacaauggagacgcuguuauugcugggccucaugauccugcuuaccggaggcgcuaugcuguuucucauuuccgggaagggaaucgguaagacuaguauaggcuugaucuguguuauugccucuagcgggaugcuguggauggccgaaauccccuuacaguggauugcauccgcuaucgugcuagaguucuuuaugaugguacugcucauaccagagccugaaaaacaacgcacaccgcaggauaaccagcuugccuauguggucauuggaauccugaccuuggcggcuauuaucgccgcaaaugagaugggccugcucgaaaccacaaagcgagaccuggguaugucaaaagagcccggggugguuucuccaacuagcuaccuugauguggaccuccacccugccagugcuuggacgcuguacgcagucgccaccacaguaauaacucccauguugagacauaccaucgaaaacuccacagcgaacgugagccuggcugccauugcaaaucaagccguuguguuaaugggccuagacaagggauggccaaucucuaaaauggaucugggcgucccucuccuugcucuggggugcuauucacaggugaaccccuugacccugacugccgcaguccuccugcuuauuacgcacuacgcuaucauaggaccgggcuuacaggccaaggcgacaagggaggcccagaagcggaccgcagcugguauuaugaaaaauccaacuguggacgggaucaugaccaucgaucuggacccuguuauuuaugauuccaaguucgagaaacaacucggacaggugauguugcugguacuaugugccgugcagcugcuccuuaugcgcacaaguugggcacugugcgaagcuuugacucuggccaccggccccaucacaacgcucugggaggguagcccaggcaaguuuuggaacaccacuauagccgucucgauggcgaauauuuucagagggucuuaccuggcuggagcaggcuuagccuuuuccaucaugaaaagcguugggacaggaaagaggggcaccgguucacagggggaaacucuuggagagaaguggaaaaagaaacugaaccaacucagucggaaggaauucgaccuauauaaaaagucuggcauuacagagguggaucgaaccgaggcuaaagaaggucugaagagaggcgagaucacgcaucacgccgucucccgcgggagcgcaaaguugcagugguuuguggaaaggaauaugguaauacccgagggacgggugaucgaccugggcugugggcguggaggcuggucauacuauugcgccggucucaaaaagguuaccgaagugagaggguacacaaaaggaggcccuggccaugaggagccgguccccaugaguacuuacggguggaacauugugaagcuuaugagcggaaaagaugucuucuaucugccaccugaaaagugugacaccuugcugugcgauaucggugaguccucucccagcccuacaguggaagaguccaggacuauucgcguucucaagaugguagagccaugguuaaaaaauaaccaguucuguaucaaggugcugaaucccuacaugccuaccgucauugaacaccuugagcggcugcagcgaaaauauggcgggaugcuagugagaaacccacucucaaggaauucuacacacgaaauguacuggaucaguaacggaaccggcaauauaguugcuucggugaacauggucagccgccuguugcugaaccgguuuacuaugacgcauagacgucccacaauugagaaggacguggaucucggugcggggaccaggcacguaaaugccgaaccggagacuccuaacauggacgugaucggagagcggaucaaacgcauuaaggaagagcauaauuccaccuggcacuaugacgaugaaaacccauacaagacaugggcauaucacggcucuuacgagguuaaagcuacgggcucagccagcuccaugauaaauggggucgugaagcuucugaccaaacccugggacguggucccuaugguuacucaaauggcaaugacagauaccacuccauucggacagcagcgaguguuuaaggaaaaaguagacacaagaacccccaggaguaugccggguacacggcgcgugaugggcaucacugccgagugguuauggagaacccuggggaggaacaagaagccucgauugugcacgcgggaggaauucaccaaaaagguccguacaaaugcugccaugggagcgguguuuacugaggaaaaccaaugggauucugcaaaagccgcuguugaggacgaagauuucuggaagcucguggacagagagcgcgagcugcauaaacuaggcaagugugguagcugcgucuacaauaugauggggaaaagggaaaagaagcuuggagaguuuggcaaagccaagggcucacgggcaauuugguauauguggcugggggcuagauaccucgaauucgaggcccugggauuuuugaacgaggaucacugguucucccgcgaaaauaguuauagcgguguggagggcgaagggcugcauaaacucggauacauccuuagggacauuucuaagauccccggcggugcuauguaugccgaugacaccgcagggugggacacacgaauaacugaggaugaccugcacaacgaagagaaaaucacccagcagauggauccagagcaucggcaguuagcgaaugccauuuuuaagcugacguaccaaaacaagguaguuaaagugcagagaccuacacccaccggaacugucauggacaucauuuccaggaaggaucagcgcggcucaggccagguggggacauauggauugaauaccuucacuaacauggaagcucaacucauccgucagauggagggugaaggcgugcugaccaaagccgaccuagagaacccacaccuuagcgaaaagaaaauaacacaguggcuggagacgaagggggucgagcggcucaagagaauggcaauuucgggagaugacugcguugugaaacccaucgaugacagguuugcuaaugcccuguuggcauuaaacgauaugggcaagguacgcaaagacaucccucaguggcaaccaucuaaggguuggcacgauuggcagcaggugccguucuguagucaucacuuccaugaacugauuaugaaagacgggcgaaagcucgucgugcccugccggccucaggacgagcuuauaggaagagccaggaucucccaaggcgcgggcuggagccugcgcgaaaccgcuugucuagggaaggccuacgcacagauguggucacugauguacuuucacagacgggaucucagguuggccuccaaugcuauuugcucugccguuccagugcacuggguccccacuagccguacaaccuggaguauccaugcacaccaucaguggaugacuacagaggacaugcugaccguguggaaccgaguauggauugaagauaauccuuggauggaggacaaaacgccaguuacaaccugggagaacgugcccuaucuuggaaagcgcgaagaucaauggugugguucccugaucggccucacuagcagagcuaccugggcccagaauauaccuacagcgauccagcagguccggucuuuaauugggaacgaggaauuccuggacuacaugccgucaaugaaaagguuucgcaaggaggaggaaagugagggagcuaucugguga

SEQ ID NO: 15408 - RNA, 9873 nt, Artificial Sequence
  derived and/or modified CDS sequence (opt3) from DENV-3__EU596494__SS-prME
accucccugugccucaugaugauccuucccgcagcucuggcauuccacuugacuuccagagacggcgaaccuaggaugauuguggggaagaacgaacggggaaaaucuuuacuguuuaagacugccucagguauaaauauguguacgcuaaucgcgauggaucucggcgaaaugugcgacgauaccgucacuuacaaauguccacauauugcugaaguugaaccggaagacaucgauugcugguguaaccugacaaguaccugggugaccuaugggaccugcaaucaggccggagaacaccgccgagacaagcguagcguagcacuugcaccccaugugggcaugggucuggauacuagaacacaaaccuggauguccgcugaaggggcauggaggcaggucgaaaaaguggagacgugggccuugcggcacccuggauucacuauucucgcucuguuucuggcccauuacaucggcaccucucucacacagaagguugugauauucgucuuacugaugcuugugacuccaucgaugaccaugcgcuguguaggcguugggaacagagacuuuguggaaggauugucaggugcgacaugggucgauguggugcuggagcacggcgggugcgucaccacgauggcaaagaauaaacccacucuagacaucgagcuccagaagacagaagccacccaacuggcuacucuuaggaaacuguguauugagggaaagaucacaaacauuaccacggauagccggugcccuacccagggcgaagccguuuugccagaggaacaggaccagaauuauguguguaaacacacauacguagaucgcgguugggggaacggaugcggccucuucggcaaggggagucuggugacuugcgcaaaguuucaauguuuagagcccaucgagggaaaagucgugcaguaugaaaaucugaaguacaccguuauaauuacagugcauacuggugaccagcaccaggucggcaacgagacccaaggggugacagcugaaaucaccccucaggccuccacuacggaggcgauucucccagaauauggaacacuuggccuggagugcucuccgcgaaccgguuuggacuucaaugagaugauccuacugacuaugaaaaacaaggccuggaugguacauagacagugguuuuucgaucucccccugccuuggaccagcggggcaacaaccgaaacuccaacauggaauaggaaagagcuucugguuacguuuaagaacgcucacgccaaaaagcaagaaguggucguguugggcucccaggagggagcuaugcacaccgcccucacuggcucaacagaaauccagaauagugggggaaccagcauuuucgcaggucaucugaagugucgguuaaaaauggacaagcuggagcuaaaaggcaugucuuacgccaugugcacaaacacuuuuguccucaagaaagagguguccgaaacccagcacgggacgauacugaucaagguugaguacaagggagaagaugcucccuguaaaauuccuuucucaaccgaggacggccaagguaaggcgcauaacgggcgucuuaucacagcaaauccagugguaacuaaaaaggaggaacccgucaacauagaggccgaaccgccuuucggcgagagcaauauugugaucggaaucggcgauaacgcuuugaaaauuaauugguauaagaaggggaguucuaucggaaaaauguuugaagccaccgcacgcggugccagaaggauggcuauucugggcgacacagccugggauuucggguccguuggaggcgugcucaacagccuggguaagaugguccaccagauauuugggucggcauacacugcgcuuuucucuggcguguccuggguaaugaaaaucggaauuggcgugcuguugaccuggaucgggcucaauucaaagaacacgaguaugagcuuuuccugcaucgcuauuggaauaaucacacuguauuuaggcgccguuguccaggcagacaccgguugugugauuaauuggaaagggaaggagcugaagugcggaucuggcaucuucgugacuaacgagguccauacauggaccgaacaguacaaauuucaagccgauagccccaagcggcuagcuacugccauugccggugcuugggagaauggcguuugugggauccgaucaaccacacgcauggaaaaccuccuguggaaacagguggccaaugagcuuaacuauauauugugggaaaauaacaucaagcugacggugguagucggagacauuaucggcgugcucgagcaggggaaaagaacccugacuccacagccuauggaguuaaaguacaguuggaaaacauggggaaaggcgaagauuguuaccgccgaaacacaaaacuccagcuucaucauagauggccccaauacuccagagugccccucugcuucaagggcauggaacgugugggaagucgaggacuaugguuuugggguguucaccacgaauauuuggcugaaacuucgggaaguuuacacacaguugugugaccaccgccucaugagugccgcugugaaggaugagagagccguacacgcagacaugggauacuggaucgagagccagaaaaacggcuccuggaagcuggaaaaagcgucucuaauugaggucaagaccugcacuuggccuaagucgcauacccuguggagcaauggugugcucgaauccgauaugaucauaccaaaaucacuggccggcccgaucagucagcacaacuauaggcccggguaccauacacaaacugcuggaccuuggcaccuuggcaaguuggagcuggacuuuaauuauugcgaggggaccacaguggucauuacggaaaacuguggaacccguggcccaucuuuacggacuacaaccguuagcgguaaacucauccacgaguggugcugucgauccugcacucugcccccucuuagauacaugggggaagauggauguugguauggcauggagauuaggccaaucucagaaaaggaggagaauauggugaaaagccugguaucugccgguuccggcaagguggacaacuucacaaugggggucuugugccucgcaauacuguuugaagaggugaugcgcggaaaguucggcaaaaagcauaugauugcugggguuuucuuuaccuucgugcuacugcucaguggacagaucacguggcgggauauggcccacacucugaucaugauuggcagcaaugcaucugacagaauggguaugggggucaccuaccuugccuugaucgcuacauuuaaaauucagcccuuccuggcguuaggauuuuuccucaggaagcugaccucccgcgaaaaccuucugcuaggcgugggccucgccauggcaacuacacugcaauugccggaggauauagaacagauggcuaaugggaucgcccugggauuaauggcccucaaacugauuacccaguuugagacauaucagcuuuggacugcucugaucucauugaccuguaguaacacgauuuucacacucaccguugcauggcgaacugccacccugauccuagcgggugugagccugcuuccugucugccaaucguccucuaugcguaagagcgacuggcucccaaugacaguagcugccaugggcgugcccccucugcccuuguuuauauucucacugaaggauacuuuaaaacggagaaguuggccacucaaugaggggguuauggcagugggacuggucuccauccuugccucuagccuguugaggaacgacgugccuauggcuggcccccucguagccggugggcugcuaauugccuguuacgugaucaccggaacguccgcggaucugacagucgaaaaggcugccgacguuaccugggaggaagaggcagaacagacuggcgugucacauaaccuuaugauuacaguggacgaugacggcaccaugcgcaucaaagaugacgagacugagaauauacucacaguccuguugaagaccgccuuacugauugugagcgggaucuuuccauacaguaucccggcuacgcuccugguuuggcacacuuggcagaaacagacccggagaucuggaguacuuugggaugugccuucgcccccagaaacacaaaaggccgagcuggaagagggugucuauaggauuaaacagcagggcauauucgggaagacccaggugggaguuggcgugcaaaaggagggugucuuucauacaauguggcacgugacucgaggggcaguauugaccuacaacggaaaacgccuagaacccaauugggcuagcgucaagaaagaccugaucagcuauggcggcggguggcggcucucagcccaguggcagaagggagaggaagugcaaguuauugcgguggagccugguaaaaacccaaagaauuuccagacgaugcccggcacauuccagacuaccacaggggaaaucggagccauugcacuggauuuuaagccuggcaccucugguaguccgaucauaaacagagaggggaaagucgugggacuuuacggcaauggcguugugacuaagaacgggggauaugucuccgguaucgcucagaccaaugccgagccagacggccccacaccugaauuagaggaagagauguucaaaaagaggaaccugacgauuauggaucuccacccagggagcggaaaaacucguaaguacuugcccgcuaucgugcgcgaagcaauuaagcggagacugaggacccucauccuggccccuacacgaguaguggccgcugagauggaggaagcgcuuaaaggccugccgauacgguaucaaaccacugcaacacgcucugagcauaccgguagagaaauuguugacuugaugugccacgccacguuuacuaugaggcuacugagccccguccgggugccaaauuacaaccucaucaucauggaugaggcucauuucacagacccugccuccauugcagcccgaggguacaucucaaccagagugggaaugggcgaagcugcggccauauuuaugaccgcaacucccccaggcacagcugaugccuucccucagaguaaugcacccauucaggacgaggagcgcgacaucccagaaaggagcuggaacucugggaaugaguggauuaccgauuuugccggaaagacagucugguucguaccguccaucaaagcugguaacgacauagccaacuguuuacguaagaauggcaaaaaggugauucagcugucacggaagacuuuugauacggaauaucagaagaccaaacuuaacgacugggauuucguugugacaacugacaucagugagaugggggcgaauuuuaaagcagauagagucaucgacccuaggcgcugccugaagcccgugauucucaccgauggaccagagcgaguuaucuuggccggccccaugccugugacagcugccagcgcugcacagagacgggguagggucgggcgcaacccacagaaagaaaaugaccaguacauuuucaccggccaaccccugaacaaugaugaggaccacgcccauuggacugaagcuaagaugcuccuggacaacauaaauacgccugagggaaucauuccggcccuuuucgaaccagagcgugagaaguccgcagcgaucgauggcgaauauagacuaaaaggggagucucggaagaccuuuguggaacugaugaggcgcggagacuugcccguaugguuagcccacaaaguggcuucggaggguaucaaguacacagaucgaaaauggugcuucgacggccagagaaacaaucagauucuggaagagaacauggauguugagauauggacuaaggaaggggagaaaaagaagcuccggccuagguggcuggacgcccgcaccuauagcgauccccuugcacugaaagaauuuaaggacuucgcugccggaagaaaaucaaucgcacucgauuuggucacagagauuggcagggugccaucccaccuggcccaucggacccguaaugcucuagacaaccuggugaugcuccacacaagugaacauggugggaaggcguaccgccacgccgucgaggagcuuccugaaacaauggagacgcuguuauugcugggccucaugauccugcuuaccggaggcgcaaugcuguuucucauuucugggaaaggaaucgguaagacuagcauaggcuugaucuguguuauugcuuccucagggaugcuguggauggccgaaauccccuuacaguggauugccucugcaaucgugcuagaguucuuuaugaugguacugcucauaccagagccugaaaagcaacgaacaccgcaggauaaucagcuugcuuauguggucauuggaauccugaccuuggccgcgauuaucgcugccaacgagaugggccugcucgaaaccacaaaaagagaccuggguaugagcaaggagcccggggugguuaguccaacuuccuaccuugauguggaccuccacccugcaagcgccuggacgcuguacgcugucgcaaccacaguaauaacucccauguugaggcauaccaucgaaaauucuacagccaacgugucacuggcggcuauugccaaccaagcaguuguguuaaugggccuagacaaaggauggccaaucuccaagauggaucugggcgucccucuccuugcccuggggugcuauagucaggugaaucccuugacccugacugcugccguccuccugcuuauuacgcacuacgcaaucauaggaccgggcuuacaggcuaaagccacacgggaggcgcagaagcgcaccgccgcagguauuaugaagaacccaacuguggacgggaucaugaccaucgaucuggacccuguuauuuaugauagcaaauucgagaagcaacucggacaggugauguugcugguacuaugugcugugcagcugcuccuuaugagaacaucgugggcccugugcgaagcauugacucuggcuaccggccccaucacaacgcucugggaggguucuccaggcaaauuuuggaauaccacuauagccgucuccauggccaacauuuucagggggagcuaccuggcgggagcuggcuuagcauuuucaaucaugaagaguguugggacaggaaaacggggcaccgguucucagggggaaacucuuggagagaaguggaagaaaaagcugaaucaacucucccgaaaagaguucgaccuauauaagaaaagcggcauuacagagguggauagaaccgaggccaaggaaggucugaaacgcggcgagaucacgcaucacgcugucucaagggggagugccaaguugcagugguuuguggaacggaacaugguaauacccgagggacgugugaucgaccugggcugugggagaggaggcuggagcuacuauugcgcaggucucaagaaaguuaccgaagugaggggguacacaaagggaggcccuggccaugaggagccgguccccauguccacuuacggguggaauauugugaaacuuaugucuggaaaggaugucuucuaucugccaccugaaaaaugugacaccuugcugugcgauaucggugagagcucccccucaccuacaguggaagagucucgcacuauucggguucucaagaugguagagccaugguuaaagaacaaucaguucuguaucaaagugcugaaccccuacaugccuaccgucauugaacaccuugagcgacugcagagaaagcacggcgggaugcuagugaggaauccacucagucgcaacucgacacaugaaauguauuggaucagcaauggaaccggcaacauaguugccuccgugaauauggucucucggcuguugcugaacagauuuacuaugacgcaccguaggcccacaauugagaaagacguggaucucggugcugggacccggcauguaaacgcggaaccggagacuccuaauauggacgugaucggagagcgcaucaagcgaauuaaagaagaacacaacucaaccuggcacuacgacgaugaaaauccauauaagacaugggccuaccauggcagcuaugagguuaaggcaacgggcuccgcuaguucuaugauaaacggggucgugaaacuucugaccaagcccugggacguggucccuaugguuacucaaauggccaugacagauaccacuccauucggacagcagagaguguuuaaagaaaagguagacacaaggacaccccggagcaugccggguacacgcagagugaugggcaucacugcagagugguuauggaggacccuggggcgaaauaaaaagccucgguugugcacgcgugaggaguucaccaagaaagucagaacaaacgccgcuaugggagccguguuuacugaggaaaaucaaugggauucagcgaaggcagccguugaggacgaagauuucuggaaacucguggaccgcgagagggagcugcacaagcuaggcaaaugugguuccugcgucuacaacaugauggggaagcgggagaagaaacuuggagaguuuggcaaggcuaaaggcaguagagccauuugguacauguggcugggggcacgcuaucucgaguucgaggcucugggauuuuugaaugaggaucauugguucagcagggaaaacucuuacuccgguguggagggcgaagggcugcacaagcucggauauauccuucgagacauuucaaaaauccccggcggugccauguacgcugaugacaccgccgggugggacacacggauaacugaggaugaccugcauaaugaagagaagaucacccagcagauggauccagagcacagacaguuagcaaacgcgauuuuuaaacugacguaucaaaauaagguaguuaaggugcagaggccuacacccaccggaacugucauggacaucauuagccgcaaagaucagcguggcucgggccagguggggacauacggauugaacaccuucacuaauauggaagcccaacucauccggcagauggagggugaaggcgugcugaccaaggcugaccuagagaacccacaccuuucugagaaaaagauaacacaguggcuggagacgaaaggggucgagagacucaagaggauggccauuaguggagaugacugcguugugaagcccaucgaugaccgcuuugcaaacgcucuguuggccuuaaaugauaugggcaaaguacgaaaggacaucccucaguggcaaccauccaaagguuggcaugauuggcaacaggugccguucuguagccaccauuuccacgaacugauuaugaaggacgggcggaaacucgucgugcccugcagaccucaggacgagcuuauaggaagggcacgcaucucacaaggcgccggcuggucccugagagaaaccgcgugucuagggaaggcuuaugcccagauguggucucugauguacuuucaccggagggaucuccguuuggcaagcaacgccauuugcagugcuguuccagugcauuggguccccacuucccgaacaaccuggagcauccacgcccaucaccaguggaugacuacagaggacaugcugaccguguggaaucgcguauggauugaagauaacccuuggauggaggacaagacgccaguuacaaccugggagaaugugcccuaccuuggaaaaagagaagaucaauggugugguucucugaucggccucacuucacgggcaaccugggcucagaacauaccuacagccauccagcaggucaggaguuuaauugggaaugaggaguuccuggacuauaugccguccaugaagcgcuuuagaaaagaggaggaaagcgagggagcgaucugguga

SEQ ID NO: 15409 - RNA, 9873 nt, Artificial Sequence
  derived and/or modified CDS sequence (opt3) from DENV-3__EU687218__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaaaaauacaaguuucaggcagauucucccaaacggcuagccacugcuaucgccggugcaugggagaauggcguuugugggauacgaagcaccacacgcauggaaaaccuccuguggaagcaaaucgcuaaugagcuuaacuauauuuugugggaaaauaacaucaaacugacgguggugguaggagacauuaucggcguccucgagcaggggaagagaacccugacuccacagccuauggaguuaaaauacucauggaagacauggggaaaggccaaaauagugaccgcggaaacacagaacaguuccuucauuaucgauggccccaauacuccagagugccccagcgccucuagggcuuggaacguuugggaaguggaggacuaugguuuuggggucuucaccacgaauauuuggcugaagcuucgggaaguguacacacaauugugugaccaccgccucaugucagcagccguuaaagaugagagagcugugcacgccgacaugggauacuggaucgagagucagaagaacggcagcuggaaacuggaaaaggcaucccuaauagagguaaagaccugcacuuggccuaaaucucauacccuguggucgaaugguguccucgaaagcgauaugaucauuccaaagucccuggcgggcccgaucucacagcacaacuauaggcccggguaccauacacagacugccggaccuuggcaccuuggcaaauuggagcuggacuuuaauuauugcgaggggaccacaguggugauuacggaaaacuguggaacccguggcccaaguuuacggacuacaaccgucucugguaagcucauccacgaguggugcugucgaagcugcacucugcccccucuuagauacaugggggaagauggauguugguauggcauggagauaaggccaauuuccgaaaaagaggagaauaugguuaagucacuggugagcgcugguucuggcaagguagacaacuucacaauggggguguugugccucgccauccuguuugaagaggucaugcgcggaaaauucggcaagaaacauaugaucgcagggguguucuuuaccuucguucuacugcucuccggacaaauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgaaaaccuucugcuaggcgucggccucgcgauggccacuacacugcaguugccggaggauauugaacaaauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccagagcucguccaugcggaagacagacuggcucccaaugacugucgcggcuaugggcguacccccucugcccuuguuuauuuucucucugaaagauaccuuaaagcguagaagcuggccacucaaugagggggugauggccguuggacuggugucaauccuugcaaguucccuguugaggaacgacgucccuauggccggcccccucguggcuggugggcugcuaauugcauguuacguaaucacgggaacaucugccgaucugaccguggaaaaagcggcugacgucacuugggaggaagaggccgaacaaacaggcguuagccauaaccuuaugauaaccguggacgaugacggcacuaugcgcauuaaggaugacgagacagagaauauccucaccgugcuguugaaaacggcauuacugaucgucuccgggauuuuuccauacucaauaccggccacucuccugguguggcacaccuggcagaagcagacacagcggagcggaguucuuugggauguaccuagucccccagaaacccaaaaagcugagcuggaagaggguguguauagaaucaagcagcagggcauuuucgggaagacacaggucggagugggcguucaaaaagaggguguguuucauacuauguggcacgucaccaggggggccguguugacguacaacggaaagcgacuagaacccaauugggcaucuguaaaaaaggaccugaucuccuauggcggcggguggcgccucagcgcucaguggcagaaaggagaggaaguccaagugauugccguugagccugguaagaacccaaagaauuuccagacaaugcccggcacuuuccagaccacaaccggggaaaucggagcgauagcccuggauuuuaaaccuggcacuucggguucaccgaucauuaaccgggaggggaagguggucggacuuuacggcaauggcgugguuaccaaaaacgggggauaugugucugguaucgcacagacaaaugcugagccagacggccccacgccugaauuagaggaagagauguucaagaaaagaaaccugacuauuauggaucuccacccagggaguggaaagaccaggaaguacuugcccgccaucguccgugaagcuauaaaacgccggcugagaacacucauucuggcaccuaccagggugguagccgccgagauggaggaagcucuuaagggccugccgauccgauaucaaacuacagcgaccaaauccgagcauacgggucgggaaaucguggacuugaugugccacgcaacuuuuacaaugcgccuacugagccccguuagagucccaaauuacaaccucauuaucauggaugaggcccauuucaccgacccugcuucuauagccgcaaggggguacauuagcacccgggugggaaugggcgaagccgcugcgaucuuuaugacugccacacccccaggcaccgcagaugcuuucccucaguccaaugcccccauucaggacgaggagcgagacaucccagaaagaucauggaacagugggaaugaguggauaacagauuuugcaggaaagacugugugguucgucccgagcauuaaagccgguaacgacaucgcuaacuguuuacgcaagaauggcaagaaaguaauccagcugucuaggaagacguuugauaccgaauaucaaaaaacaaagcuuaacgacugggauuucgugguuacuaccgacauuuccgagaugggggccaauuuuaaagcggaucgugugaucgacccucggagaugccugaagcccgucauucucacagauggaccagagagggugauauuggcaggccccaugccuguuaccgccgcuucagccgcucagcgccgagguagaguggggcggaacccacagaaggaaaaugaccaguacaucuucacuggccaaccccugaacaaugaugaggaccacgcacauuggacggaagccaaaaugcuccuggacaacauuaauaccccugagggaaucaucccggcucuuuucgaaccagagagggagaagagugccgcaauugauggcgaauaucgccuaaaaggggagagccguaagacauuugucgaacugaugagacggggagacuugcccgugugguuagcgcacaaaguagccuccgaggguauaaaguacacugauaggaaauggugcuucgacggccagcgcaacaaucagauccuggaagagaacauggauguggagauuuggaccaaggaaggggagaagaaaaagcuccgaccuagauggcuggacgcucggacauauucugauccccuugcccugaaagaauuuaaggacuucgcagcuggaaggaaaucgaucgcccucgauuugguuaccgagauuggccgcgucccaagccaccuggcacauagaacuaggaaugcccuagacaaccuggugaugcuccacacaucagaacauggugggaaggcuuaccggcacgcgguggaggagcuuccugaaacgauggagacccuguuauugcugggccucaugauccugcuuacuggaggcgccaugcuguuucucauauccgggaagggaaucgguaaaacaaguauuggcuugaucugugucauugcaucuagcgggaugcuguggauggcugaaauccccuuacaguggauagccuccgccauuguucuagaguucuuuaugauggugcugcucaucccagagccugaaaagcaacguaccccgcaggauaaucagcuugcauauguagugauuggaauccugaccuuggcugccauaaucgcggcuaacgagaugggccugcucgaaacaacuaaacgcgaccuggguaugucaaaggagcccggggucgugucuccaacgagcuaccuugauguugaccuccacccugccagugcauggacccuguacgccguggcuacaacugucauuacccccauguugcgacauacaaucgaaaauuccaccgcaaacguaagccuggccgcgauugcuaaccaagccgugguuuuaaugggccuagacaaaggauggccaaucucuaagauggaucugggcgugccucuccuugcacuggggugcuauucacaggucaaucccuugacucugacggccgcugugcuccugcuuauaacacacuacgccauuaucggaccgggcuuacaggcaaaggcuaccagagaggcccagaaaaggacugcggccgguaucaugaagaacccaaccgucgacgggauuaugacaaucgaucuggacccugugauauaugauuccaaauucgagaagcaacucggacagguuauguugcuggugcuaugugcaguacagcugcuccuuaugcggacuaguugggcucugugcgaagccuugacccuggcaacaggccccauuacgacccucugggaggguagcccaggcaaauuuuggaauacuacaaucgcugugucgauggccaacauuuuccgcgggucuuaccuggccggagcgggcuuagcuuuuuccaucaugaagagcgucgggaccggaaagagaggcacugguucacagggggaaacacuuggagagaaauggaagaaaaagcugaaucaacucaguaggaaagaauucgaccuauauaagaaaucuggcauaaccgagguugaucggacggaggcaaaggaaggucugaagcgaggcgagaucacccaucacgccguguccagagggagcgcuaaauugcagugguuugucgaacgcaacauggugauucccgagggaaggguaaucgaccugggcugugggcggggaggcuggucauacuauugcgccggucucaagaaagugacagaaguucguggguacacuaagggaggcccuggccaugaggagccggugcccaugaguaccuacggguggaauauugucaaacuuaugagcggaaaggauguguucuaucugccaccugaaaagugugacacauugcugugcgauaucggugaguccucucccagcccuacugucgaagaguccagaaccauuagggugcucaaaaugguugagccaugguuaaagaacaaucaguucuguaucaaaguacugaaccccuacaugccuacagugauagaacaccuugagcgccugcagcggaagcacggcgggaugcuaguccgaaauccacucucaagaaacucuacccaugaaauguauuggauuaguaauggaacuggcaacaucguggcaucgguuaauauggugagcaggcuguugcugaaccgcuuuacgaugacacaccggagacccaccaucgagaaagacgucgaucucggugccgggacucgucaugugaacgcugaaccggagaccccuaauauggacguaauuggagagaggauaaagcggaucaaggaagagcacaacuccacauggcacuacgacgaugaaaauccauauaaaacgugggcguaccauggcucuuaugaggugaaggccaccggcucagcaagcuccaugauuaacgggguugucaaacuucugacuaagcccugggacguggugccuauggucacacaaauggcuaugaccgauacuacaccauucggacagcagcgcguuuuuaaagaaaagguggacacccgaacacccagaaguaugccggguacuaggcggguaaugggcaucaccgccgagugguuauggcgcacgcuggggagaaauaagaaaccuagguugugcacccgagaggaauucacaaagaaagugcggacuaacgcagccaugggagcugucuuuaccgaggaaaaucaaugggauucugccaaggcggcaguggaggacgaagauuucuggaaacucguugaccgugagagagagcugcacaagcuaggcaaaugugguagcugcguguacaacaugauggggaagcgcgaaaagaaacuuggagaguuuggcaaggccaaaggcucaagggcuauuugguacauguggcugggggcccgguaucucgaauucgaggcacugggauuuuugaaugaggaucauugguucuccagagaaaacaguuacagcggugucgagggcgaagggcugcacaagcucggauauauccuucgcgacauaucuaaaauccccggcggugcuauguacgccgaugacacagcugggugggacacuaggauuaccgaggaugaccugcauaaugaagagaagaucacgcagcagauggauccagagcaccgacaguuagccaacgcaauuuuuaagcugacauaucaaaauaaagugguaaagguucagcggccuacccccacuggaacagugauggacaucauauccagaaaagaucagaggggcucaggccaggucgggaccuacggauugaacacuuucaccaauauggaagcgcaacucauucgccagauggagggugaaggcgugcugagcaaggccgaccuagagaacccacaccuucccgaaaaaaagaucacacaguggcuggagacgaaggggguggagcgucucaaacggauggcuaucucgggagaugacugcgucguuaagccuauugaugacagauuugccaacgcacuguuggcuuuaaaugauaugggcaaagugaggaaggacauaccacaguggcaaccgucuaaagguuggcaugauuggcagcagguacccuucuguagucaccauuuccacgaacugaucaugaaggacgggcgcaagcucguggucccuugccgaccacaggacgagcuuauuggacgggccagaaucucccaaggcgcaggcuggagccugagggaaaccgccugucuagggaaagcguaugcucagauguggucacugauguacuuucaccgcagagaucuccgguuggccuccaacgcaauuugcucugccgugcccguucauugggugccuacuagcaggacaaccuggaguauccacgcucaucaccaguggaugacuacagaggacaugcugaccgucuggaaucguguguggauagaagauaacccauggauggaggacaagacgcccguaacaaccugggagaauguuccuuaccuuggaaaacgagaagaucaauggugugguucccugaucggccucacuagccgcgccaccugggcacagaacauuccgacagcuauccagcaggugagaucuuuaauugggaaugaggaauuccuggacuauaugccaucaaugaagcgguuuaggaaagaggaggaaagugagggagccaucugguga

SEQ ID NO: 15410 - RNA, 9873 nt, Artificial Sequence
  derived and/or modified CDS sequence (opt3) from DENV-3__EU726772__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcaagguagacaacuucacaauggggguguugugccucgccauccuguuugaagaggucaugcgcggaaaguucggcaaaaagcauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaaaauccagcccuuccuggcuuuaggauuuuuccucaggaagcugaccucucgcgaaaaccuucugcuaggcgucggccucgcgauggccacuacacugcaauugccggaggauauugaacagauggcaaaugggaucgcucugggauuaauggcccucaaacugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaagacagacuggcucccaaugacugucgcggcuaugggcguacccccucugcccuuguuuauuuucucucugaaggauaccuuaaaacguagaagcuggccacucaaugagggggugauggccguuggacuggugucaauccuugcaaguucccuguugaggaacgacgucccuauggccggcccccucguggcuggugggcugcuaauugcauguuacguaaucacgggaacaucugccgaucugaccguggaaaaggcggcugacgucacuugggaggaagaggccgaacagacaggcguuagccauaaccuuaugauaaccguggacgaugacggcacuaugcgcauuaaagaugacgagacagagaauauccucaccgugcuguugaagacggcauuacugaucgucuccgggauuuuuccauacucaauaccggccacucuccugguguggcacaccuggcagaaacagacacaacggagcggaguucuuugggauguaccuagucccccagaaacccagaaggcugagcuggaagaggguguguauagaaucaaacagcagggcauuuucgggaagacacaagucggagugggcguucagaaggaggguguguuucauacuauguggcacgucaccaggggggccguguugacguacaacggaaaacgacuagaacccaauugggcaucuguaaagaaagaccugaucuccuauggcggcggguggcgccucagcgcucaguggcaaaagggagaggaaguccaggugauugccguugagccugguaaaaacccaaagaauuuccagacaaugcccggcacuuuccagaccacaaccggggaaaucggagcgauagcccuggauuuuaagccuggcacuucggguucaccgaucauuaaccgggaggggaaaguggucggacuuuacggcaauggcgugguuaccaagaacgggggauaugugucugguaucgcacaaacaaaugcugagccagacggccccacgccugaauuagaggaagagauguucaaaaagagaaaccugacuauuauggaucuccacccagggaguggaaaaaccaggaaguacuugcccgccaucguccgugaagcuauaaagcgccggcugagaacacucauucuggcaccuaccagggugguagccgccgagauggaggaagcucuuaaaggccugccgauccgauaucagacuacagcgaccaaguccgagcauacgggucgggaaaucguggacuugaugugccacgcaacuuuuacaaugcgccuacugagccccguuagagucccaaauuacaaccucauuaucauggaugaggcccauuucaccgacccugcuucuauagccgcaaggggguacauuagcacccgggugggaaugggcgaagccgcugcgaucuuuaugacugccacacccccaggcaccgcagaugcuuucccucaguccaaugcccccauucaggacgaggagcgagacaucccagaaagaucauggaacagugggaaugaguggauaacagauuuugcaggaaaaacugugugguucgucccgagcauuaaggccgguaacgacaucgcuaacuguuuacgcaaaaauggcaagaagguaauccaacugucuaggaaaacguuugauaccgaauaucagaagacaaaacuuaacgacugggauuucgugguuacuaccgacauuuccgagaugggggccaauuuuaaggcggaucgugugaucgacccucggagaugccugaaacccgucauucucacagauggaccagagagggugauauuggcaggccccaugccuguuaccgccgcuucagccgcucagcgccgagguagaguggggcggaacccacagaaggaaaaugaccaauacaucuucacuggccagccccugaacaaugaugaggaccacgcacauuggacggaagccaagaugcuccuggacaacauuaauaccccugagggaaucaucccggcucuuuucgaaccagagagggagaaaagugccgcaauugauggcgaauaucgccuaaagggggagagccguaaaacauuugucgaacugaugagacggggagacuugcccgugugguuagcgcacaagguagccuccgaggguauaaaauacacugauaggaaguggugcuucgacggccagcgcaacaaucagauccuggaagagaacauggauguggagauuuggaccaaagaaggggagaagaagaaacuccgaccuagauggcuggacgcucggacauauucugauccccuugcccugaaggaauuuaaagacuucgcagcuggaaggaagucgaucgcccucgauuugguuaccgagauuggccgcgucccaagccaccuggcacauagaacuaggaaugcccuagacaaccuggugaugcuccacacaucagaacauggugggaaagcuuaccggcacgcgguggaggagcuuccugaaacgauggagacccuguuauugcugggccucaugauccugcuuacuggaggcgccaugcuguuucucauauccgggaagggaaucgguaagacaaguauuggcuugaucugugucauugcaucuagcgggaugcuguggauggcugaaauccccuuacaauggauagccuccgccauuguucuagaguucuuuaugauggugcugcucaucccagagccugaaaaacagcguaccccgcaggauaaucaacuugcauauguagugauuggaauccugaccuuggcugccauaaucgcggcuaacgagaugggccugcucgaaacaacuaagcgcgaccuggguaugucaaaagagcccggggucgugucuccaacgagcuaccuugauguugaccuccacccugccagugcauggacccuguacgccguggcuacaacugucauuacccccauguugcgacauacaaucgaaaauuccaccgcaaacguaagccuggccgcgauugcuaaccaggccgugguuuuaaugggccuagacaagggauggccaaucucuaaaauggaucugggcgugccucuccuugcacuggggugcuauucacaggucaaucccuugacucugacggccgcugugcuccugcuuauaacacacuacgccauuaucggaccgggcuuacaggcaaaggcuaccagagaggcccaaaagaggacugcggccgguaucaugaaaaacccaaccgucgacgggauuaugacaaucgaucuggacccugugauauaugauuccaaguucgagaaacagcucggacagguuauguugcuggugcuaugugcaguacagcugcuccuuaugcggacuaguugggcucugugcgaagccuugacccuggcaacaggccccauuacgacccucugggaggguagcccaggcaaguuuuggaauacuacaaucgcugugucgauggccaacauuuuccgcgggucuuaccuggccggagcgggcuuagcuuuuuccaucaugaaaagcgucgggaccggaaagagaggcacugguucacaaggggaaacacuuggagagaaguggaaaaagaaacugaaucagcucaguaggaaggaauucgaccuauauaaaaagucuggcauaaccgagguugaucggacggaggcaaaagaaggucugaagcgaggcgagaucacccaucacgccguguccagagggagcgcuaaguugcagugguuugucgaacgcaacauggugauucccgagggaaggguaaucgaccugggcugugggcggggaggcuggucauacuauugcgccggucucaaaaaggugacagaaguucguggguacacuaaaggaggcccuggccaugaggagccggugcccaugaguaccuacggguggaauauugucaagcuuaugagcggaaaagauguguucuaucugccaccugaaaagugugacacauugcugugcgauaucggugaguccucucccagcccuacugucgaagaguccagaaccauuagggugcucaagaugguugagccaugguuaaaaaacaaucaguucuguaucaagguacugaaccccuacaugccuacagugauagaacaccuugagcgccugcaacggaaacacggcgggaugcuaguccgaaauccacucucaagaaacucuacccaugaaauguauuggauuaguaauggaacuggcaacaucguggcaucgguuaauauggugagcaggcuguugcugaaccgcuuuacgaugacacaccggagacccaccaucgagaaggacgucgaucucggugccgggacucgucaugugaacgcugaaccggagaccccuaauauggacguaauuggagagaggauaaaacggaucaaggaagagcacaacuccacauggcacuacgacgaugaaaauccauauaagacgugggcguaccauggcucuuaugaggugaaagccaccggcucagcaagcuccaugauuaacgggguugucaagcuucugacuaaacccugggacguggugccuauggucacacagauggcuaugaccgauacuacaccauucggacagcaacgcguuuuuaaggaaaaaguggacacccgaacacccagaaguaugccggguacuaggcggguaaugggcaucaccgccgagugguuauggcgcacgcuggggagaaauaagaagccuagguugugcacccgagaggaauucacaaaaaaggugcggacuaacgcagccaugggagcugucuuuaccgaggaaaaucagugggauucugccaaagcggcaguggaggacgaagauuucuggaagcucguugaccgugagagagagcugcacaaacuaggcaagugugguagcugcguguacaacaugauggggaaacgcgaaaagaagcuuggagaguuuggcaaagccaagggcucaagggcuauuugguacauguggcugggggcccgguaucucgaauucgaggcacugggauuuuugaaugaggaucauugguucuccagagaaaacaguuacagcggugucgagggcgaagggcugcacaaacucggauauauccuucgcgacauaucuaagauccccggcggugcuauguacgccgaugacacagcugggugggacacuaggauuaccgaggaugaccugcauaaugaagagaaaaucacgcagcagauggauccagagcaccgacaauuagccaacgcaauuuuuaagcugacauaucagaauaaggugguaaaaguucagcggccuacccccacuggaacagugauggacaucauauccagaaaggaucagaggggcucaggccaagucgggaccuacggauugaacacuuucaccaauauggaagcgcagcucauucgccagauggagggugaaggcgugcugagcaaagccgaccuagagaacccacaccuucccgaaaagaaaaucacacaguggcuggagacgaaggggguggagcgucucaagcggauggcuaucucgggagaugacugcgucguuaaaccuauugaugacagauuugccaacgcacuguuggcuuuaaaugauaugggcaaggguaggaaagacauaccacaauggcagccgucuaagggguggcaugauuggcagcaggugcccuucuguagucaccauuuccacgaacugaucaugaaagacggacgcaagcucguagugccuugccgaccacaagacgagcuuauuggccgggccagaaucucccagggcgcaggguggagccugagggaaaccgccugucuaggaaaggcguaugcucagauguggucacugauguacuuucaccgcagagaucuccgguuggccuccaacgcaauuugcucugccguccccgugcauuggguuccuacuagcaggacaaccuggaguauccacgcucaucaccaauggaugacuacagaggacaugcugaccguguggaaucgugucuggauagaagauaacccauggauggaggacaaaacgcccgugacaaccugggagaauguaccuuaccuugguaagcgagaagaucagugguguggcucccugaucgggcucacuagccgcgccaccugggcacagaacauuccgacagcuauccagcaaguuagaucuuuaauuggaaaugaggaauuccuggacuauaugccaucaaugaaacgguuuaggaaggaggaggaaagugagggcgccaucugguga

SEQ ID NO: 15411 - RNA, 9873 nt, Artificial Sequence
  derived and/or modified CDS sequence (opt3) from DENV-3__FJ182013__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacguuggcacaucucucacucagaagguggucaucuucauauuacugaugcuugugaccccaucgaugacaaugcgcuguguaggcguugggaacagagacuuuguggaaggauugucaggugccaccugggucgauguggugcuggagcacggcgggugcgucacgacuauggcgaagaauaaacccacacuagacaucgagcuccagaagaccgaagcaacucaacuggccacacuuaggaaacuguguauugagggaaagaucaccaacauuacgaccgauagccggugcccuacacagggcgaagcuguuuugccagaggaacaggaccagaauuauguguguaaacacacuuacguagaucgcgguugggggaacggaugcggccucuucggcaaggggagucuggugaccugcgccaaguuucaauguuuagagcccaucgagggaaaagucgugcaguaugaaaaucugaaguacacaguuauaauuacugugcauaccggugaccagcaccaggucggcaacgagacacaaggggugaccgcagaaaucacuccucaggcuuccacgacagaggccauucucccagaauauggaacccuuggccuggagugcucuccgcgaacugguuuggacuucaaugagaugauccuacugaccaugaaaaacaaggcguggaugguacauagacagugguuuuucgaucucccccugccuuggacaagcggggccaccacugaaacaccaacguggaauaggaaagagcuucugguuaccuuuaagaacgcacacgcuaaaaagcaagaaguggucguguugggcucccaggagggagccaugcacacugcucucacaggcgccaccgaaauccagaauucagggggaacaaguauuuucgcaggucaucugaagugucgguuaaaaauggacaagcuggagcuaaaaggcaugagcuacgccaugugcacuaacaccuuuguccucaagaaagaggugucugaaacgcagcacgggaccauacugaucaagguugaguacaagggagaagaugugcccuguaaaauuccuuucuccacagaggacggccaagguaaggcucauaacgggcgucuuaucacugcgaauccaguagucaccaaaaaggaggaacccgugaacauagaggcagaaccgccuuucggcgagucaaauauuguuaucggaaucggcgauaacgccuugaaaauuaauugguauaagaaggggagcaguaucggaaaaauguuugaagcuacagcccgcggugcaagaaggauggccauucugggcgacacugcuugggauuucgggucugugggaggcguccucaacucccuggguaagauggugcaccagauauuugggagcgccuacaccgcacuuuucucgggcguaucuugggugaugaaaaucggaauuggcguucuguugacguggaucgggcucaauuccaagaacacaucaaugaguuuuagcugcaucgcgauuggaauaaucacccuguauuuaggcgcugucgugcaggccgacauggguugugugauuaauuggaaagggaaggagcugaagugcggauccggcaucuucgucacuaacgagguucauacauggaccgaacaguacaaauuucaagcagauucucccaagcggcuagccacugcuauugccggugcaugggagaauggcgugugugggauccgaagcaccacacgcauggaaaaccuccuguggaaacagauagcuaaugagcuuaacuauaucuugugggaaaauaacauuaagcugacggugguagucggagacaucauuggcgugcucgagcaggggaaaagaacccugacuccacagccuauggaguuaaaguacucauggaaaacauggggaaaggccaagaucguuaccgcggaaacacaaaacaguuccuucauaauugauggccccaauacuccagagugccccagcgccucuagggcuuggaacgugugggaagucgaggacuaugguuuugggguguucaccacgaauaucuggcugaaacuucgggaaguuuacacacaguugugugaccaccgccucaugucagcagccgugaaggaugagagagcuguacacgccgacaugggauacuggauugagagucagaaaaacggcagcuggaagcuggaaaaagcaucccuaaucgaggucaagaccugcacuuggccuaagucucauacccuguggucgaauggugugcucgaaagcgauaugauaaucccaaaaucccuggcgggcccgauuucacagcacaacuauaggcccggguaccauacacaaacugccggaccuuggcaccuuggcaaguuggagcuggacuuuaauuauugcgaggggaccacaguggucaucacggaaaacuguggaacccguggcccaaguuuacggacuacaaccguuucugguaaacucauucacgaguggugcugucgaagcugcacucugcccccucuuagauacaugggggaagauggauguugguauggcauggagaucaggccaauauccgaaaaggaggagaauauggugaaaucacugguaagcgcugguucuggcaagguggacaacuucacaaugggggucuugugccucgccauucuguuugaagaggugaugcgcggaaaguucggcaaaaagcauaugaucgcagggguuuucuuuaccuucgugcuacugcucuccggacagaucacguggcgggauauggcucacacucugauuaugaucggcaguaaugccagcgacagaauggguaugggggucaccuaccuugcauugauugccacauuuaaaauacagcccuuccuggcuuuaggauuuuuccucaggaagcugaccucucgcgaaaaccuucugcuaggcgugggccucgcgauggccacuacacugcaauugccggaggauaucgaacagauggcaaaugggauugcucugggauuaauggcccucaaacugaucacccaguuugagacauaucagcuuuggacugcccugauuuccuugaccuguucaaacacgaucuucacacucaccguugcuuggcgaacugcaacccugauacuagccggugugagucugcuuccugucugccaaagcucguccaugcggaagacagacuggcucccaauggcgguagcugccaugggcgugcccccucugcccuuguuuaucuucucucugaaggauacuuuaaaacguagaagcuggccacucaaugaggggguuauggcagugggacuggucucaauucuugccaguucccuguugaggaacgacgugccuauggcuggcccccucguagcaggugggcugcuaaucgccuguuacgugauuaccggaacgucugcggaucugacagucgaaaaggcugccgacguuaccugggaggaagaggcagaacagacuggcgugagccauaaccuuaugaucacaguggacgaugacggcaccaugcgcauaaaagaugacgagacugagaauauucucacaguccuguugaagaccgccuuacugaucguguccgggaucuuuccauacucaauuccggcuacgcuccugguuuggcacacuuggcagaaacagacccaacggagcggaguacuuugggaugugccuagucccccagaaacacagaaggccgagcuggaagagggugucuauagaauaaaacagcagggcaucuucgggaagacccaagugggaguuggcgugcagaaggagggugucuuucauacaauguggcacgugacuaggggggcaguauugaccuacaacggaaaacgacuagaacccaauugggcuucugucaagaaagaccugauuuccuauggcggcggguggcgccucagcgcccaguggcaaaagggagaggaagugcagguuaucgcgguggagccugguaaaaacccaaagaauuuccagacgaugcccggcacauuccagacuaccacaggggaaauuggagccaucgcacuggauuuuaagccuggcaccucggguucaccgauaaucaaccgggaggggaaagucgugggacuuuacggcaauggcguugugacuaagaacgggggauaugucucugguauugcucaaaccaaugccgagccagacggccccacaccugaauuagaggaagagauguucaaaaagagaaaccugacgaucauggaucuccacccagggaguggaaaaacuaggaaguacuugcccgcuauugugcgugaagcaaucaagcgccggcugagaacccucauacuggccccuacaaggguaguggccgcugagauggaggaagcgcuuaaaggccugccgauucgauaucagaccacugcaacaaaguccgagcauaccggucgggaaaucguugacuugaugugccacgccacguuuacuaugcgccuacugagccccgucagagugccaaauuacaaccucaucauuauggaugaggcucauuucacagacccugccucuaucgcagccaggggguacauaagcacccgggugggaaugggcgaagcugcggccauuuuuaugaccgcaacucccccaggcacagcugaugccuucccucaguccaaugcacccauccaggacgaggagcgagacauuccagaaagaucauggaacagugggaaugaguggaucaccgauuuugccggaaaaacagucugguucguaccgagcauaaaggcugguaacgacauugccaacuguuuacgcaaaaauggcaagaaggugauccaacugucuaggaaaacuuuugauacggaauaucagaagaccaaacuuaacgacugggauuucguugugacaacugacaucuccgagaugggggcgaauuuuaaggcagaucgugucauugacccucggagaugccugaaacccgugauccucaccgauggaccagagaggguuauuuuggccggccccaugccugugacagcugccucagcugcacagcgccgagguagagucgggcggaacccacagaaggaaaaugaccaauacauauucaccggccagccccugaacaaugaugaggaccacgcccauuggacugaagcuaagaugcuccuggacaacaucaauacgccugagggaauuaucccggcccuuuucgaaccagagagggagaaaagugcagcgaucgauggcgaauaucgccuaaagggggagagccguaaaaccuuuguggaacugaugagacggggagacuugcccguaugguuagcccacaagguggcuuccgaggguauuaaauacacagauaggaaguggugcuucgacggccagcgcaacaaucagauacuggaagagaacauggauguugagaucuggacuaaagaaggggagaagaagaaacuccgaccuagauggcuggacgcccggaccuauucugauccccuugcacugaaggaauuuaaagacuucgcugccggaaggaagucgauugcacucgauuuggucacagagaucggccgcgugccaagccaccuggcccauagaaccaggaaugcucuagacaaccuggugaugcuccacacuucagaacauggugggaaagcguaccggcacgccgucgaggagcuuccugaaacaauggagacgcuguuauugcugggccucaugauucugcuuaccggaggcgcaaugcuguuucucaucuccgggaagggaauagguaagacuaguaucggcuugauuuguguuaucgcuucuagcgggaugcuguggauggccgaaauucccuuacaauggaucgccuccgcaauagugcuagaguucuuuaugaugguacugcucauuccagagccugaaaaacagcguacaccgcaggauaaucaacuugcuuauguggucaucggaauucugaccuuggccgcgaucauagcugccaacgagaugggccugcucgaaaccacaaagcgcgaccuggguaugucaaaagagcccggggugguuucuccaacuagcuaccuugauguggaccuccacccugcaagugccuggacgcuguacgcugucgcaaccacaguaaucacucccauguugcgacauaccauugaaaauuccacagccaacgugagccuggcggcuaucgccaaccaggcaguuguguuaaugggccuagacaagggauggccaauuucuaaaauggaucugggcgucccucuccuugcccuggggugcuauucacaggugaaucccuugacccugacugcugccguccuccugcuuaucacgcacuacgcaauaauuggaccgggcuuacaggcuaaggccacaagagaggcgcaaaagaggaccgccgcagguaucaugaaaaacccaacuguggacgggaucaugaccauugaucuggacccuguuaucuaugauuccaaguucgagaaacagcucggacaggugauguugcugguacuaugugcugugcagcugcuccuuaugcggacaaguugggcccugugcgaagcauugacucuggcuaccggccccauaacaacgcucugggaggguagcccaggcaaguuuuggaauaccacuauugccgucucgauggccaacaucuuccgcgggucuuaccuggcgggagcuggcuuagcauuuuccauuaugaaaagcguugggacaggaaagagaggcaccgguucacaaggggaaacucuuggagagaaguggaaaaagaaacugaaucagcucaguaggaaggaauucgaccuauauaaaaagucuggcaucacagagguggaucggaccgaggccaaagaaggucugaagcgaggcgagauaacgcaucacgcugucuccagagggagcgccaaguugcagugguuuguggaacgcaacaugguaauccccgagggaagggugauugaccugggcugugggcggggaggcuggucauacuauugcgcaggucucaaaaagguuaccgaagugcguggguacacaaaaggaggcccuggccaugaggagccgguccccaugaguacuuacggguggaauaucgugaagcuuaugagcggaaaagaugucuucuaucugccaccugaaaagugugacaccuugcugugcgauauuggugaguccucucccagcccuacaguggaagaguccagaacuaucaggguucucaagaugguagagccaugguuaaaaaacaaucaguucuguauuaaggugcugaaccccuacaugccuaccgucaucgaacaccuugagcgccugcaacggaaacacggcgggaugcuagugcgaaauccacucucaagaaacucuacacaugaaauguauuggauaaguaauggaaccggcaacauuguugccucggugaauauggucagcaggcuguugcugaaccgcuuuacuaugacgcaccggagacccacaaucgagaaggacguggaucucggugcugggacccgucauguaaacgcggaaccggagacuccuaauauggacgugaucggagagaggauuaaacggauaaaggaagagcacaacuccaccuggcacuacgacgaugaaaauccauauaagacaugggccuaccauggcucuuaugagguuaaagcaacgggcucagcuagcuccaugaucaacggggucgugaagcuucugaccaaacccugggacguggucccuaugguuacucagauggccaugacagauaccacuccauucggacagcaacgcguguuuaaggaaaaaguagacacacgaacccccagaaguaugccggguacaaggcgggugaugggcauuacugcagagugguuauggcgcacccuggggagaaauaagaagccuagguugugcacgcgagaggaauucaccaaaaagguccggacaaacgccgcuaugggagccguguuuacugaggaaaaucagugggauucugcgaaagcagccguugaggacgaagauuucuggaagcucguggaccgugagagagagcugcacaaacuaggcaagugugguagcugcgucuacaacaugauggggaaacgcgaaaagaagcuuggagaguuuggcaaagcuaagggcucaagggccaucugguacauguggcugggggcacgguaucucgaauucgaggcucugggauuuuugaaugaggaucauugguucuccagagaaaacaguuacagcgguguggagggcgaagggcugcacaaacucggauauauucuucgcgacaucucuaagauacccggcggugccauguacgcugaugacaccgccgggugggacacaaggaucacugaggaugaccugcauaaugaagagaaaauuacccagcagauggauccagagcaccgacaauuagcaaacgcgaucuuuaagcugacguaucagaauaagguaguuaaagugcagcggccuacacccaccggaacugucauggacauuaucuccagaaaggaucagaggggcucaggccaaguggggacauacggauugaacaccuucacuaauauggaagcccagcucauacgccagauggagggugaaggcgugcugagcaaagcugaccuagagaacccacaccuucccgaaaagaaaauuacccaguggcuggagacaaagggggucgagcgucucaagcggauggccaucucgggagaugacugcguugugaaaccuaucgaugacagauuugcaaacgcucuguuggccuuaaaugauaugggcaagguaaggaaagacauuccacaauggcagccgucuaaggguuggcaugauuggcagcaggugcccuucuguagucaccauuuccacgaacugauaaugaaagacgggcgcaagcucgucgugccuugccgaccacaagacgagcuuaucggacgggcaagaauuucccagggcgccggcuggagccugagggaaacggcgugucuagggaaggcuuaugcccagauguggucacugauguacuuucaccgcagagaucuccgguuggcauccaacgccaucugcucugcuguucccgugcauugggucccuaccagcaggacuacauggaguauucacgcccaucaccaauggaugaccacugaggacaugcugacaguguggaaucguguauggaucgaagauaacccauggauggaggacaaaacccccguuacgacaugggagaaugugccuuaccuuggaaagcgagaagaucaguggugugguucccugauaggccucaccagccgcgcaacuugggcucagaacaucccgaccgccauucagcaagucagaucuuuaaucgggaaugaggaauuccuggacuauaugccaucaaugaaacgguuuaggaaggaggaggaaagugagggagcgauuugguga

SEQ ID NO: 15412 - RNA, 9873 nt, Artificial Sequence
  derived and/or modified CDS sequence (opt3) from DENV-3__EU781136__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguuguguggugaauuggaaagggaaggagcugaagugcggauccggcaucuucgucacuaacgagguucauacauggaccgaacaguacaaauuucaagcagauucucccaagcggcuagccacugcuauugccggugcaugggagaauggcgugugugggauccgaagcaccacacgcauggaaaaccuccuguggaaacagauagcuaaugagcuuaacuauaucuugugggaaaauaacauuaagcugacggugguagucggagacaucauuggcgugcucgagcaggggaaaagaacccugacuccacagccuauggaguuaaaguacucauggaaaacauggggaaaggccaagaucguuaccgcggaaacacaaaacaguuccuucauaauugauggccccaauacuccagagugccccagcgccucuagggcuuggaacgugugggaagucgaggacuaugguuuugggguguucaccacgaauaucuggcugaaacuucgggaaguuuacacacaguugugugaccaccgccucaugucagcagccgugaaggaugagagagcuguacacgccgacaugggauacuggauugagagucagaaaaacggcagcuggaagcuggaaaaagcaucccuaaucgaggucaagaccugcacuuggccuaagucucauacccuguggucgaauggugugcucgaaagcgauaugauaaucccaaaaucccuggcgggcccgauuucacagcacaacuauaggcccggguaccauacacaaacugccggaccuuggcaccuuggcaaguuggagcuggacuuuaauuauugcgaggggaccacaguggucaucacggaaaacuguggaacccguggcccaaguuuacggacuacaaccguuucugguaaacucauucacgaguggugcugucgaagcugcacucugcccccucuuagauacaugggggaagauggauguugguauggcauggagaucaggccaauauccgaaaaggaggagaauauggugaaaucacugguaagcgcugguucuggcaagguggacaacuucacaaugggggucuugugccucgccauucuguuugaagaggugaugcgcggaaaguucggcaaaaagcauaugaucgcagggguuuucuuuaccuucgugcuacugcucuccggacagaucacguggcgggauauggcucacacucugauuaugaucggcaguaaugccagcgacagaauggguaugggggucaccuaccuugcauugauugccacauuuaaaauacagcccuuccuggcuuuaggauuuuuccucaggaagcugaccucucgcgaaaaccuucugcuaggcgugggccucgcgauggccacuacacugcaauugccggaggauaucgaacagauggcaaaugggauugcucugggauuaauggcccucaaacugaucacccaguuugagacauaucagcuuuggacugcccugauuuccuugaccuguucaaacacgaucuucacacucaccguugcuuggcgaacugcaacccugauacuagccggugugagucugcuuccugucugccaaagcucguccaugcggaagacagacuggcucccaaugacuguagcggcuaugggcgugcccccucugcccuuguuuaucuucucucugaaggauaccuuaaaacguagaagcuggccacucaaugaggggguuauggccgugggacuggucucaauucuugcaaguucccuguugaggaacgacgugccuauggccggcccccucguagcuggugggcugcuaaucgcauguuacgugauuacgggaacaucugccgaucugaccgucgaaaaggcggcugacguuacuugggaggaagaggccgaacagacaggcgugagccauaaccuuaugaucaccguggacgaugacggcacuaugcgcauaaaagaugacgagacagagaauauucucaccguccuguugaagacggcauuacugaucguguccgggaucuuuccauacucaauuccggccacucuccugguuuggcacaccuggcagaaacagacacaacggagcggaguacuuugggaugugccuagucccccagaaacccagaaggcugagcuggaagagggugucuauagaauaaaacagcagggcaucuucgggaagacacaagugggaguuggcgugcagaaggagggugucuuucauacuauguggcacgugaccaggggggccguauugacguacaacggaaaacgacuagaacccaauugggcaucugucaagaaagaccugauuuccuauggcggcggguggcgccucagcgcucaguggcaaaagggagaggaagugcagguuaucgccguggagccugguaaaaacccaaagaauuuccagacaaugcccggcacuuuccagaccacaaccggggaaauuggagcgaucgcccuggauuuuaagccuggcacuucggguucaccgauaaucaaccgggaggggaaagucgugggacuuuacggcaauggcguugugaccaagaacgggggauaugucucugguauugcacaaacaaaugcugagccagacggccccacgccugaauuagaggaagagauguucaaaaagagaaaccugacuaucauggaucuccacccagggaguggaaaaaccaggaaguacuugcccgccauugugcgugaagcuaucaagcgccggcugagaacacucauacuggcaccuaccaggguaguggccgccgagauggaggaagcucuuaaaggccugccgauucgauaucagacuacagcgaccaaguccgagcauacgggucgggaaaucguugacuugaugugccacgcaacuuuuacaaugcgccuacugagccccgucagagugccaaauuacaaccucaucauuauggaugaggcccauuucaccgacccugcuucuaucgccgcaaggggguacauaagcacccgggugggaaugggcgaagccgcugcgauuuuuaugacugccacacccccaggcaccgcagaugcuuucccucaguccaaugcccccauccaggacgaggagcgagacauuccagaaagaucauggaacagugggaaugaguggaucacagauuuugcaggaaaaacugucugguucguaccgagcauaaaggccgguaacgacauugcuaacuguuuacgcaaaaauggcaagaaggugauccaacugucuaggaaaacguuugauaccgaauaucagaagacaaaacuuaacgacugggauuucguugugacuaccgacaucuccgagaugggggccaauuuuaaggcggaucgugucauugacccucggagaugccugaaacccgugauccucacagauggaccagagaggguuauuuuggcaggccccaugccugugaccgccgcuucagccgcucagcgccgagguagagucgggcggaacccacagaaggaaaaugaccaauacauauucacuggccagccccugaacaaugaugaggaccacgcacauuggacggaagccaagaugcuccuggacaacaucaauaccccugagggaauuaucccggcucuuuucgaaccagagagggagaaaagugccgcaaucgauggcgaauaucgccuaaagggggagagccguaaaacauuuguggaacugaugagacggggagacuugcccguaugguuagcgcacaagguggccuccgaggguauuaaauacacugauaggaaguggugcuucgacggccagcgcaacaaucagauacuggaagagaacauggauguugagaucuggaccaaagaaggggagaagaagaaacuccgaccuagauggcuggacgcucggacauauucugauccccuugcccugaaggaauuuaaagacuucgcagcuggaaggaagucgauugcccucgauuuggucaccgagaucggccgcgugccaagccaccuggcacauagaacuaggaaugcccuagacaaccuggugaugcuccacacaucagaacauggugggaaagcuuaccggcacgcggucgaggagcuuccugaaacgauggagacccuguuauugcugggccucaugauucugcuuacuggaggcgccaugcuguuucucaucuccgggaagggaauagguaagacaaguaucggcuugauuuguguuaucgcaucuagcgggaugcuguggauggcugaaauucccuuacaauggaucgccuccgccauagugcuagaguucuuuaugaugguacugcucauuccagagccugaaaaacagcguaccccgcaggauaaucaacuugcauauguggucaucggaauucugaccuuggcugccaucauagcggcuaacgagaugggccugcucgaaacaacuaagcgcgaccuggguaugucaaaagagcccggggugguuucuccaacgagcuaccuugauguggaccuccacccugccagugcauggacccuguacgccgucgcuacaacuguaaucacccccauguugcgacauacaauugaaaauuccaccgcaaacgugagccuggccgcgaucgcuaaccaggccguuguguuaaugggccuagacaagggauggccaauuucuaaaauggaucugggcgucccucuccuugcacuggggugcuauucacaggugaaucccuugacucugacggccgcuguccuccugcuuaucacacacuacgccauaauuggaccgggcuuacaggcaaaggcuaccagagaggcccaaaagaggacugcggccgguaucaugaaaaacccaaccguggacgggaucaugacaauugaucuggacccuguuaucuaugauuccaaguucgagaaacagcucggacaggugauguugcugguacuaugugcagugcagcugcuccuuaugcggacuaguugggcucugugcgaagccuugacccuggcaacaggccccauaacgacccucugggaggguagcccaggcaaguuuuggaauacuacaauugcugucucgauggccaacaucuuccgcgggucuuaccuggccggagcgggcuuagcuuuuuccauuaugaaaagcguugggaccggaaagagaggcacugguucacaaggggaaacacuuggagagaaguggaaaaagaaacugaaucagcucaguaggaaggaauucgaccuauauaaaaagucuggcaucaccgagguggaucggacggaggcaaaagaaggucugaagcgaggcgagauaacccaucacgccgucuccagagggagcgcuaaguugcagugguuuguggaacgcaacaugguaauccccgagggaagggugauugaccugggcugugggcggggaggcuggucauacuauugcgccggucucaaaaagguuacagaagugcguggguacacuaaaggaggcccuggccaugaggagccgguccccaugaguaccuacggguggaauaucgugaagcuuaugagcggaaaagaugucuucuaucugccaccugaaaagugugacacauugcugugcgauauuggugaguccucucccagcccuacuguggaagaguccagaaccaucaggguucucaagaugguagagccaugguuaaaaaacaaucaguucuguauuaaggugcugaaccccuacaugccuacagucaucgaacaccuugagcgccugcaacggaaacacggcgggaugcuagugcgaaauccacucucaagaaacucuacccaugaaauguauuggauaaguaauggaacuggcaacauuguugcaucggugaauauggucagcaggcuguugcugaaccgcuuuacgaugacacaccggagacccaccaucgagaaggacguggaucucggugccgggacucgucauguaaacgcugaaccggagaccccuaauauggacgugaucggagagaggauuaaacggauaaaggaagagcacaacuccacauggcacuacgacgaugaaaauccauauaagacgugggcguaccauggcucuuaugagguuaaagccaccggcucagcaagcuccaugaucaacggggucgugaagcuucugacuaaacccugggacguggucccuaugguuacacagauggcuaugaccgauacuacaccauucggacagcaacgcguguuuaaggaaaaaguagacacccgaacacccagaaguaugccggguacuaggcgggugaugggcauuaccgccgagugguuauggcgcacgcuggggagaaauaagaagccuagguugugcacccgagaggaauucacaaaaaagguccggacuaacgcagccaugggagcuguguuuaccgaggaaaaucagugggauucugccaaagcggcaguugaggacgaagauuucuggaagcucguggaccgugagagagagcugcacaaacuaggcaagugugguagcugcgucuacaacaugauggggaaacgcgaaaagaagcuuggagaguuuggcaaagccaagggcucaagggcuaucugguacauguggcugggggcccgguaucucgaauucgaggcacugggauuuuugaaugaggaucauugguucuccagagaaaacaguuacagcgguguggagggcgaagggcugcacaaacucggauauauucuucgcgacaucucuaagauacccggcggugcuauguacgccgaugacacagcugggugggacacuaggaucaccgaggaugaccugcauaaugaagagaaaauuacgcagcagauggauccagagcaccgacaauuagccaacgcaaucuuuaagcugacauaucagaauaagguaguuaaagugcagcggccuacccccacuggaacagucauggacauuaucuccagaaaggaucagaggggcucaggccaaguggggaccuacggauugaacacuuucaccaauauggaagcgcagcucauacgccagauggagggugaaggcgugcugagcaaagccgaccuagagaacccacaccuucccgaaaagaaaauuacacaguggcuggagacgaagggggucgagcgucucaagcggauggcuaucucgggagaugacugcguugugaaaccuaucgaugacagauuugccaacgcacuguuggcuuuaaaugauaugggcaagguaaggaaagacauuccacaauggcagccgucuaaggguuggcaugauuggcagcaggugcccuucuguagucaccauuuccacgaacugauaaugaaagacgggcgcaagcucgucgugccuugccgaccacaagacgagcuuaucggacgggccagaauuucccagggcgcaggcuggagccugagggaaaccgccugucuagggaaggcguaugcucagauguggucacugauguacuuucaccgcagagaucuccgguuggccuccaacgcaaucugcucugccguucccgugcauugggucccuacuagcaggacaaccuggaguauucacgcucaucaccaauggaugacuacagaggacaugcugaccguguggaaucguguauggaucgaagauaacccauggauggaggacaaaacgcccguuacaaccugggagaaugugccuuaccuuggaaagcgagaagaucaguggugugguucccugauaggccucacuagccgcgccaccugggcacagaacaucccgacagcuauucagcaagucagaucuuuaaucgggaaugaggaauuccuggacuauaugccaucaaugaaacgguuuaggaaggaggaggaaagugagggagccauuugguga

SEQ ID NO: 15413 - RNA, 9873 nt, Artificial Sequence
  derived and/or modified CDS sequence (opt3) from DENV-3__EU781137__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaccuuacugaugcuugucacaccaucgaugaccaugcgcugugugggcguagggaacagagacuuuguugaaggauugucaggugccacguggguggaugucgugcuggagcacggcgggugcgugacuacaauggcgaagaauaaacccacccuagacaucgagcuccagaagacugaagcaacacaacuggccacccuuaggaaacuguguauugagggaaagaucacgaacauuaccacagauagccggugcccuacucagggcgaagcugucuugccagaggaacaggaccagaauuauguuuguaaacacaccuacguggaucgcgguugggggaacggaugcggccucuucggcaaggggagucugguaacaugcgccaaguuucaauguuuagagcccaucgagggaaaagugguccaguaugaaaaucugaaguacacugugauaauuaccguucauacaggugaccagcaccaggugggcaacgagacccaaggggucacugcagaaaucacgccucaggcuuccacaaccgaggccauucucccagaauauggaacucuuggccuggagugcucuccgcgaaccgguuuggacuucaaugagaugauccuacugacaaugaaaaacaaggcguggauggugcauagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcacacagcucucaccggcgccacagaaauccagaauucagggggaacuaguauuuucgcaggucaucugaagugucgguuaaaaauggacaagcuggagcuaaaaggcaugagcuacgccaugugcaccaacacguuugugcucaagaaagaggucucugaaacccagcacgggacaauacugaucaagguggaguacaagggagaagauguucccuguaaaauuccuuucuccacugaggacggccaagguaaggcucauaacgggcgucuuaucaccgcgaauccagugguaacaaaaaaggaggaacccgucaacauagaggcagaaccgccuuucggcgagucaaauauugugaucggaaucggcgauaacgccuugaaaauuaauugguauaagaaggggagcaguaucggaaaaauguuugaagcuacugcccgcggugcaagaaggauggccauucugggcgacaccgcuugggauuucgggucuguuggaggcgugcucaacucccuggguaagaugguccaccagauauuugggagcgccuacacggcacuuuucucgggcgugucuuggguaaugaaaaucggaauuggcgugcuguugacauggaucgggcucaauuccaagaacaccucaaugaguuuuagcugcaucgcgauuggaauaaucacucuguauuuaggcgcuguuguccaggccgacauggguugugugauuaauuggaaagggaaggagcugaagugcggauccggcaucuucgugacaaacgagguccauaccuggacugaacaguacaaauuucaagcagauucucccaagcggcuagccaccgcuauugccggugcaugggagaauggcguuugugggauccgaagcacaacgcgcauggaaaaccuccuguggaaacagauagcuaaugagcuuaacuauaucuugugggaaaauaacauuaagcugaccguggugguaggagacaucauuggcguccucgagcaggggaaaagaacucugacaccacagccuauggaguuaaaguacucauggaaaaccuggggaaaggccaagaucgugacagcggaaacucaaaacaguuccuucauaauugauggccccaauaccccagagugccccagcgccucuagggcuuggaacguuugggaaguggaggacuaugguuuuggggucuucacgacaaauaucuggcugaaacuucgggaaguguacacccaguugugugaccaccgccucaugucagcagccguuaaggaugagagagcugugcacgccgacaugggauacuggauugagagucagaaaaacggcagcuggaagcuggaaaaagcaucccuaaucgagguaaagacuugcaccuggccuaagucucauacacuguggucgaaugguguccucgaaagcgauaugauaaucccaaaaucccuggcgggcccgauuucacagcacaacuauaggcccggguaccauacucaaaccgccggaccuuggcaccuuggcaaguuggagcuggacuuuaauuauugcgaggggacaacgguggugaucaccgaaaacuguggaacucguggcccaaguuuacggacaaccacugucucugguaaacucauucacgaguggugcugucgaagcugcacacugcccccucuuagauacaugggggaagauggauguugguauggcauggagaucaggccaauauccgaaaaggaggagaauaugguuaaaucacuggugagcgcugguucuggcaagguagacaacuucaccauggggguguugugccucgccauucuguuugaagaggucaugcgcggaaaguucggcaaaaagcauaugaucgcagggguguucuuuacguucguucuacugcucuccggacagaucacuuggcgggauauggcucacacccugauuaugaucggcaguaaugccagcgacagaauggguaugggggugacauaccuugcauugauugccaccuuuaaaauacagcccuuccuggcuuuaggauuuuuccucaggaagcugacuucucgcgaaaaccuucugcuaggcgucggccucgcgauggccacaacccugcaauugccggaggauaucgaacagauggcaaaugggauugcucugggauuaauggcccucaaacugaucacacaguuugagacuuaucagcuuuggaccgcccugauuuccuugacguguucaaacacaaucuucacccucacuguggcuuggcgaaccgcaacacugauacuagccgguguuagucugcuuccugugugccaaagcucguccaugcggaagacugacuggcucccaaugaccgucgcggcuaugggcguacccccucugcccuuguuuaucuucucucugaaggauacguuaaaacguagaagcuggccacucaaugagggggugauggccguuggacuggugucaauucuugcaaguucccuguugaggaacgacgucccuauggccggcccccucguggcuggugggcugcuaaucgcauguuacguaauuacaggaaccucugccgaucugacuguggaaaaggcggcugacgucacaugggaggaagaggccgaacagaccggcguuagccauaaccuuaugaucacuguggacgaugacggcacaaugcgcauaaaagaugacgagaccgagaauauucucacggugcuguugaagacugcauuacugaucgucuccgggaucuuuccauacucaauuccggccacccuccugguguggcacacauggcagaaacagacccaacggagcggaguucuuugggauguaccuagucccccagaaacacagaaggcugagcuggaagaggguguguauagaauaaaacagcagggcaucuucgggaagacucaagucggagugggcguucagaaggaggguguguuucauaccauguggcacgucacgaggggggccguguugacauacaacggaaaacgacuagaacccaauugggcaucuguaaagaaagaccugauuuccuauggcggcggguggcgccucagcgcucaguggcaaaagggagaggaaguccaggugaucgccguugagccugguaaaaacccaaagaauuuccagacuaugcccggcaccuuccagacaaccacuggggaaauuggagcgaucgcccuggauuuuaagccuggcaccucggguucaccgauaaucaaccgggaggggaaaguggucggacuuuacggcaauggcgugguuacaaagaacgggggauaugugucugguauugcacaaacgaaugcugagccagacggccccacuccugaauuagaggaagagauguucaaaaagagaaaccugaccaucauggaucuccacccagggaguggaaaaacaaggaaguacuugcccgccauuguccgugaagcuaucaagcgccggcugagaacccucauacuggcaccuacuagggugguagccgccgagauggaggaagcucuuaaaggccugccgauucgauaucagacaaccgcgacgaaguccgagcauacuggucgggaaaucguggacuugaugugccacgcaacauuuaccaugcgccuacugagccccguuagagucccaaauuacaaccucaucauuauggaugaggcccauuucaccgacccugcuucuaucgccgcaaggggguacauaagcacucgggugggaaugggcgaagccgcugcgauuuuuaugacagccacccccccaggcacagcagaugcuuucccucaguccaaugcccccauccaggacgaggagcgagacauuccagaaagaucauggaacagugggaaugaguggaucacugauuuugcaggaaaaacggugugguucgucccgagcauaaaggccgguaacgacauugcuaacuguuuacgcaaaaauggcaagaagguaauccaacugucuaggaaaaccuuugauacagaauaucagaagacuaaacuuaacgacugggauuucgugguuaccacagacaucuccgagaugggggccaauuuuaaggcggaucgugugauugacccucggagaugccugaaacccgucauccucaccgauggaccagagagggugauuuuggcaggccccaugccuguuacugccgcuucagccgcucagcgccgagguagaguggggcggaacccacagaaggaaaaugaccaauacauauucacgggccagccccugaacaaugaugaggaccacgcacauuggaccgaagccaagaugcuccuggacaacaucaauacaccugagggaauuaucccggcucuuuucgaaccagagagggagaaaagugccgcaaucgauggcgaauaucgccuaaagggggagagccguaaaacuuuugucgaacugaugagacggggagacuugcccgugugguuagcgcacaagguagccuccgaggguauuaaauacaccgauaggaaguggugcuucgacggccagcgcaacaaucagauacuggaagagaacauggauguggagaucuggacaaaagaaggggagaagaagaaacuccgaccuagauggcuggacgcucggaccuauucugauccccuugcccugaaggaauuuaaagacuucgcagcuggaaggaagucgauugcccucgauuugguuacugagaucggccgcgucccaagccaccuggcacauagaacaaggaaugcccuagacaaccuggugaugcuccacacgucagaacauggugggaaagcuuaccggcacgcgguggaggagcuuccugaaaccauggagacucuguuauugcugggccucaugauucugcuuacaggaggcgccaugcuguuucucaucuccgggaagggaauagguaagaccaguaucggcuugauuugugucaucgcaucuagcgggaugcuguggauggcugaaauucccuuacaauggaucgccuccgccauaguucuagaguucuuuaugauggugcugcucauuccagagccugaaaaacagcguaccccgcaggauaaucaacuugcauauguagugaucggaauucugacauuggcugccaucauagcggcuaacgagaugggccugcucgaaacuacgaagcgcgaccuggguaugucaaaagagcccggggucgugucuccaaccagcuaccuugauguugaccuccacccugccagugcauggacacuguacgccguggcuacuaccgucaucacacccauguugcgacauaccauugaaaauuccacugcaaacguaagccuggccgcgaucgcuaaccaggccgugguuuuaaugggccuagacaagggauggccaauuucuaaaauggaucugggcgugccucuccuugcacuggggugcuauucacaggucaaucccuugacgcugacagccgcugugcuccugcuuaucacccacuacgccauaauuggaccgggcuuacaggcaaaggcuacuagagaggcccaaaagaggaccgcggccgguaucaugaaaaacccaacagucgacgggaucaugacuauugaucuggacccugugaucuaugauuccaaguucgagaaacagcucggacagguuauguugcuggugcuaugugcaguacagcugcuccuuaugcggaccaguugggcucugugcgaagccuugacacuggcaacgggccccauaaccacucucugggaggguagcccaggcaaguuuuggaauacaaccauugcugugucgauggccaacaucuuccgcgggucuuaccuggccggagcgggcuuagcuuuuuccauuaugaaaagcgucgggacuggaaagagaggcacagguucacaaggggaaacccuuggagagaaguggaaaaagaaacugaaucagcucaguaggaaggaauucgaccuauauaaaaagucuggcaucacggagguugaucggaccgaggcaaaagaaggucugaagcgaggcgagauaacacaucacgccguguccagagggagcgcuaaguugcagugguuugucgaacgcaacauggugauccccgagggaaggguaauugaccugggcugugggcggggaggcuggucauacuauugcgccggucucaaaaaggugacugaaguucguggguacaccaaaggaggcccuggccaugaggagccggugcccaugaguacauacggguggaauaucgucaagcuuaugagcggaaaagauguguucuaucugccaccugaaaagugugacacuuugcugugcgauauuggugaguccucucccagcccuaccgucgaagaguccagaacaaucagggugcucaagaugguugagccaugguuaaaaaacaaucaguucuguauuaagguacugaaccccuacaugccuaccgugaucgaacaccuugagcgccugcaacggaaacacggcgggaugcuaguccgaaauccacucucaagaaacucuacucaugaaauguauuggauaaguaauggaacgggcaacauuguggcaucgguuaauauggugagcaggcuguugcugaaccgcuuuacaaugacccaccggagacccacuaucgagaaggacgucgaucucggugccgggacccgucaugugaacgcugaaccggagacaccuaauauggacguaaucggagagaggauuaaacggauaaaggaagagcacaacuccacguggcacuacgacgaugaaaauccauauaagaccugggcguaccauggcucuuaugaggugaaagccacuggcucagcaagcuccaugaucaacgggguugucaagcuucugacaaaacccugggacguggugccuauggucacccagauggcuaugacugauacaaccccauucggacagcaacgcguuuuuaaggaaaaaguggacacacgaacucccagaaguaugccggguaccaggcggguaaugggcauuacggccgagugguuauggcgcacccuggggagaaauaagaagccuagguugugcacacgagaggaauucacuaaaaaggugcggaccaacgcagccaugggagcugucuuuacagaggaaaaucagugggauucugccaaagcggcaguggaggacgaagauuucuggaagcucguugaccgugagagagagcugcacaaacuaggcaagugugguagcugcguguacaacaugauggggaaacgcgaaaagaagcuuggagaguuuggcaaagccaagggcucaagggcuaucugguacauguggcugggggcccgguaucucgaauucgaggcacugggauuuuugaaugaggaucauugguucuccagagaaaacaguuacagcggugucgagggcgaagggcugcacaaacucggauauauucuucgcgacaucucuaagauacccggcggugcuauguacgccgaugacacugcugggugggacaccaggaucacggaggaugaccugcauaaugaagagaaaauuacacagcagauggauccagagcaccgacaauuagccaacgcaaucuuuaagcugaccuaucagaauaaggugguaaaaguucagcggccuacucccacaggaaccgugauggacauuaucuccagaaaggaucagaggggcucaggccaagucgggacuuacggauugaacaccuucacaaauauggaagcgcagcucauacgccagauggagggugaaggcgugcugagcaaagccgaccuagagaacccacaccuucccgaaaagaaaauuacgcaguggcuggagaccaaggggguggagcgucucaagcggauggcuaucucgggagaugacugcgucguuaaaccuaucgaugacagauuugccaacgcacuguuggcuuuaaaugauaugggcaaggugaggaaagacauuccacaauggcagccgucuaaggguuggcaugauuggcagcagguacccuucuguagucaccauuuccacgaacuggugaugaaagacgggcgcaagcucgucgugccuugccgaccacaagacgagcuuauaggacgggccagaaucucccagggcgcaggcuggagccugagggaaacugccugucuagggaaggcguaugcucagauguggucacugauguacuuucaccgcagagaucuccgguuggccuccaacgcaauuugcucugccguucccgugcauugggucccuacaagcaggaccacuuggaguauccacgcucaucaccaauggaugacaaccgaggacaugcugacgguguggaaucguguauggauugaagauaacccauggauggaggacaaaacacccguuaccacuugggagaaugugccuuaccuuggaaagcgagaagaucaguggugugguucccugaucggccucaccagccgcgccacaugggcacagaacauaccgacugcuauccagcaagucagaucuuuaauugggaaugaggaauuccuggacuauaugccaucaaugaaacgguuuaggaaggaggaggaaagugagggagccaucugguga

SEQ ID NO: 15414 - RNA, 9873 nt, Artificial Sequence
  derived and/or modified CDS sequence (opt3) from DENV-3__EU726773__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauuguuauaggaaucauuacccuguauuuaggcgcggucgugcaggcugacauggguugugugaucaauuggaaagggaaggagcugaagugcggauccggcauuuucgucacuaacgagguucauacauggaccgaacaguacaaauuucaagccgauucucccaagcggcuagcaacugccaucgcuggugccugggagaauggcgugugugggauacgaagcaccacacgcauggaaaaccuccuguggaaacagaucgcaaaugagcuuaacuauauuuugugggaaaauaacaucaagcugacggugguagucggagacauuaucggcgugcucgagcaggggaaaagaacccugacuccacagccuauggaguuaaaguacucauggaaaacauggggaaaggcuaagauaguuaccgccgaaacacaaaacaguuccuucauuaucgauggccccaauacuccagagugccccagcgcgucuagggccuggaacgugugggaagucgaggacuaugguuuugggguguucaccacgaauauuuggcugaaacuucgggaaguuuacacacaguugugugaccaccgccucaugucagcugcagugaaggaugagagagccguacacgcugacaugggauacuggaucgagagucagaaaaacggcagcuggaagcuggaaaaagccucccuaauagaggucaagaccugcacuuggccuaagucucauacccuguggucgaauggugugcucgaaagcgauaugaucauuccaaaaucccuggcaggcccgaucucacagcacaacuauaggcccggguaccauacacaaacugcgggaccuuggcaccuuggcaaguuggagcuggacuuuaauuauugcgaggggaccacaguggucauuacggaaaacuguggaacccguggcccaaguuuacggacuacaaccguuucugguaaacucauccacgaguggugcugucgaagcugcacucugcccccucuuagauacaugggggaagauggauguugguauggcauggagauaaggccaauuuccgaaaaggaggagaauauggugaaaucacugguaagcgccgguucuggcaagguggacaacuucacaaugggggucuugugccucgcuauccuguuugaagaggugaugcgcggaaaguucggcaaaaagcauaugaucgccgggguuuucuuuaccuucgugcuacugcucuccggacagauuacguggcgggauauggcacacacucugaucaugauuggcaguaaugcuagcgacagaauggguaugggggucaccuaccuugccuugauagcaacauuuaaaauccagcccuuccuggccuuaggauuuuuccucaggaagcugaccucucgcgaaaaccuucugcuaggcgugggccucgcuauggcgacuacacugcaauugccggaggauauugaacagauggccaaugggaucgcacugggauuaauggcucucaaacugauuacccaguuugagacauaucagcuuuggacugcccugaucuccuugaccuguucaaacacgauauucacacucaccguugccuggcgaacugcuacccugauccuagcaggugugagucugcuuccugucugccaaagcucguccaugcggaagacagacuggcucccaaugacuguagccgcgaugggcgugcccccucugcccuuguuuauuuucucucugaaggauaccuuaaaacguagaagcuggccacucaaugaggggguuauggcugugggacuggucucaauccuugccaguucccuguugaggaacgacgugccuauggcaggcccccucguagccggugggcugcuaauugcuuguuacgugaucacgggaacaucugcagaucugaccgucgaaaaggccgcggacguuacuugggaggaagaggcugaacagacaggcgugagccauaaccuuaugauaaccguggacgaugacggcacuaugcgcauuaaagaugacgagacagagaauauccucaccguccuguugaagacggccuuacugaucguguccgggauuuuuccauacucaauaccggcaacucuccugguuuggcacaccuggcagaaacagacacaacggagcggaguacuuugggaugugccuagucccccagaaacccagaaggccgagcuggaagagggugucuauagaaucaaacagcagggcauuuucgggaagacacaagugggaguuggcgugcagaaggagggugucuuucauacuauguggcacgugaccaggggggcuguauugacguacaacggaaaacgacuagaacccaauugggccucugucaagaaagaccugaucuccuauggcggcggguggcgccucagcgcacaguggcaaaagggagaggaagugcagguuauugcuguggagccugguaaaaacccaaagaauuuccagacaaugcccggcacuuuccagaccacaaccggggaaaucggagccauagcgcuggauuuuaagccuggcacuucggguucaccgaucauuaaccgggaggggaaagucgugggacuuuacggcaauggcguugugaccaagaacgggggauaugucucugguaucgcccaaacaaaugcagagccagacggccccacgccugaauuagaggaagagauguucaaaaagagaaaccugacuauuauggaucuccacccagggaguggaaaaaccaggaaguacuugcccgcuaucgugcgugaagccauaaagcgccggcugagaacacucauucuggcuccuaccaggguaguggcagccgagauggaggaagcccuuaaaggccugccgauccgauaucagacuacagcuaccaaguccgagcauacgggucgggaaaucguugacuugaugugccacgcgacuuuuacaaugcgccuacugagccccgucagagugccaaauuacaaccucauuaucauggaugaggcacauuucaccgacccugccucuauagcugccaggggguacauuagcacccgggugggaaugggcgaagcagccgcuaucuuuaugacugcgacacccccaggcaccgccgaugcauucccucaguccaaugcucccauucaggacgaggagaaagacaucccagaacgaucauggaacagugggaaugaguggauaacagauuuugccggaaagacugucugguucguaccgagcauuaaagcagguaacgacaucgccaacuguuuaagaaagaauggcaagaaagugauccaacugucucgcaagacguuugauaccgaauaucagaaaacaaagcuuaacgacugggauuucguugugacuaccgacauuuccgagaugggggcuaauuuuaaagccgauagggucaucgacccucgucggugccugaagcccgugauucucacagauggaccagagagaguuauauuggcgggccccaugccugugaccgcagccucagcugcccagaggcgcggucgagucgggagaaacccacagaaggaaaaugaccaauacaucuucacuggccagccccugaacaaugaugaggaccacgcucauuggacggaagcaaaaaugcuccuggacaacauuaauaccccugagggaaucaucccggcccuuuucgaaccagagcgggagaagagugcugccauugauggcgaauauaggcuaaaaggggagagccgcaagacauuuguggaacugaugcguagaggagacuugcccguaugguuagcacacaaaguggcguccgaggguauaaaguacacugaucggaaauggugcuucgacggccagaggaacaaucagauccuggaagagaacauggauguugagauuuggaccaaggaaggggagaagaaaaagcuccgcccucgauggcuggacgccagaacauauucugauccccuugcucugaaagaauuuaaggacuucgccgcaggacggaaaucgaucgcucucgauuuggucaccgagauuggcagggugccaagccaccuggcccaucgcacuagaaaugcacuagacaaccuggugaugcuccacacaucagaacauggugggaaggccuacaggcacgcugucgaggagcuuccugaaacgauggagacccuguuauugcugggccucaugauccugcuuacuggaggcgcgaugcuguuucucauauccgggaagggaaucgguaaaacaaguauuggcuugaucuguguuauugccucuagcgggaugcuguggauggcagaaauccccuuacaauggauagcuuccgccauugugcuagaguucuuuaugaugguacugcucaucccagagccugaaaagcagcggaccccgcaggauaaucaacuugccuauguggucauuggaauccugaccuuggcagcuauaaucgccgcgaacgagaugggccugcucgaaacaacuaaacgugaccuggguaugucaaaggagcccggggugguuucuccaacgagcuaccuugauguggaccuccacccugcuagugccuggacccuguacgcagucgccacaacuguaauuacccccauguugcgccauacaaucgaaaauuccaccgcuaacgugagccuggcagccauugcgaaccaggcuguuguguuaaugggccuagacaaaggauggccaaucucuaagauggaucugggcgucccucuccuugcccuggggugcuauucacaggugaaucccuugacucugacggcagccguccuccugcuuauaacacacuacgcuauuaucggaccgggcuuacaggccaaggcaacccgagaggcucaaaaaagaacugccgcggguaucaugaagaacccaaccguggacgggauuaugacaaucgaucuggacccuguuauauaugauuccaaauucgagaagcagcucggacaggugauguugcugguacuaugugccgugcagcugcuccuuaugaggacuaguugggcacugugcgaagcuuugacccuggccacaggccccauuacgacccucugggaggguagcccaggcaaauuuuggaauacuacaaucgcagucucgauggcuaacauuuuccgggggucuuaccuggccggagccggcuuagcguuuuccaucaugaagagcguugggaccggaaagcgcggcacugguucacaaggggaaacacuuggagagaaauggaagaaaaagcugaaucagcucaguagaaaagaauucgaccuauauaagaaaucuggcauaaccgagguggauaggacggaggcuaaggaaggucugaagcggggcgagaucacccaucacgcagucucccgagggagcgccaaauugcagugguuuguggaaagaaacaugguaauucccgagggacgcgugaucgaccugggcugugggaggggaggcuggucauacuauugcgcuggucucaagaaaguuacagaagugcggggguacacuaagggaggcccuggccaugaggagccgguccccaugaguaccuacggguggaauauugugaaacuuaugagcggaaaggaugucuucuaucugccaccugaaaagugugacacauugcugugcgauaucggugaguccucucccagcccuacuguggaagagucccguaccauuagaguucucaaaaugguagagccaugguuaaagaacaaucaguucuguaucaaagugcugaaccccuacaugccuacagucauagaacaccuugagaggcugcaacgcaagcacggcgggaugcuagugcggaauccacucucacgaaacucuacccaugaaauguauuggauuaguaauggaacuggcaacaucguugccucggugaauauggucagcagacuguugcugaacagguuuacgaugacacaccgccggcccaccaucgagaaagacguggaucucggugcagggacuagacauguaaacgccgaaccggagaccccuaauauggacgugauuggagagcguauaaagaggaucaaggaagagcacaacuccacauggcacuacgacgaugaaaauccauauaaaacgugggcuuaccauggcucuuaugagguuaaggcgaccggcucagccagcuccaugauuaacggggucgugaaacuucugacuaagcccugggacguggucccuaugguuacacagauggcaaugaccgauacuacaccauucggacagcaacggguguuuaaagaaaagguagacacccgcacaccccgaaguaugccggguacuagaagggugaugggcaucaccgcugagugguuauggcggacgcuggggcgcaauaagaaaccuagauugugcaccagggaggaauucacaaagaaaguccgaacuaacgccgcaaugggagccguguuuaccgaggaaaaucagugggauucugcuaaggccgcgguugaggacgaagauuucuggauucucguggaccgggagcgugagcugcacaaacuaggcaagugugguagcugcgucuacaacaugauggggaaaagagaaaagaagcuuggagaguuuggcaaagcaaagggcucacgcgccaucugguacauguggcugggggcuagguaucucgaauucgaggcccugggauuuuugaaugaggaucauugguucucccgggaaaacaguuacagcgguguggagggcgaagggcugcacaaacucggauauauacuuagagacaucucuaagauucccggcggugcaauguacgcugaugacacagccgggugggacacucgcaucaccgaggaugaccugcauaaugaagagaaaauuacgcagcagauggauccagagcacaggcaauuagcuaacgccaucuuuaagcugacauaucagaauaagguaguuaaagugcagcgaccuacccccacuggaacagucauggacauaauuucccggaaggaucagagaggcucaggccaaguggggaccuacggauugaacacuuucaccaauauggaagcacagcucaucaggcagauggagggugaaggcgugcugagcaaagcggaccuagagaacccacaccuucccgaaaagaaaaucacacaguggcuggagacgaagggggucgagcgccucaagcguauggccauuucgggagaugacugcguugugaaaccuauagaugaccgguuugcuaacgcccuguuggcauuaaaugauaugggcaagguaagaaaagacaucccacaauggcagccgucuaaggguuggcaugauuggcagcaggugcccuucuguagucaccauuuccacgaacugauuaugaaagacgggaggaagcucgucgugccuugccgcccacaagacgagcuuaucggacgagcucggauuucccagggcgccggcuggagccugagagaaaccgcaugucuagggaaggccuaugcgcagauguggucacugauguacuuucacaggcgcgaucucagauuggcuuccaacgccaucugcucugcaguucccgugcauugggucccuacuagccggacaaccuggaguauacacgcccaucaccaauggaugacuacagaggacaugcugaccguguggaauaggguauggaucgaagauaacccauggauggaggacaaaacgcccguuacaaccugggagaaugugccuuaccuuggaaagcgugaagaucaguggugugguucccugauuggccucacuagccgagcuaccugggcccagaacaucccgacagcaauucagcaaguccgcucuuuaaucgggaaugaggaauuccuggacuauaugccaucaaugaaaagauuucggaaggaggaggaaagugagggagcuauuugguga

SEQ ID NO: 15415 - RNA, 9873 nt, Artificial Sequence
  derived and/or modified CDS sequence (opt3) from DENV-3__EU726774__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacaccauuggcguccucgagcaggggaaaagaacucugacaccacagccuauggaguuaaaguacucauggaaaaccuggggaaaggccaagaucgugacagcggaaacucaaaacaguuccuucauaauugauggccccaauaccccagagugccccagcgccucuagggcuuggaacguuugggaaguggaggacuaugguuuuggggucuucacgacaaauaucuggcugaaacuucgggaaguguacacccaguugugugaccaccgccucaugucagcagccguuaaggaugagagagcugugcacgccgacaugggauacuggauugagagucagaaaaacggcagcuggaagcuggaaaaagcaucccuaaucgagguaaagacuugcaccuggccuaagucucauacacuguggucgaaugguguccucgaaagcgauaugauaaucccaaaaucccuggcgggcccgauuucacagcacaacuauaggcccggguaccauacucaaaccgccggaccuuggcaccuuggcaaguuggagcuggacuuuaauuauugcgaggggacaacgguggugaucaccgaaaacuguggaacucguggcccaaguuuacggacaaccacugucucugguaaacucauucacgaguggugcugucgaagcugcacacugcccccucuuagauacaugggggaagauggauguugguauggcauggagaucaggccaauauccgaaaaggaggagaauaugguuaaaucacuggugagcgcugguucuggcaagguagacaacuucaccauggggguguugugccucgccauucuguuugaagaggucaugcgcggaaaguucggcaaaaagcauaugaucgcagggguguucuuuacguucguucuacugcucuccggacagaucacuuggcgggauauggcucacacccugauuauggugggcaguaaugccagcgacagaauggguaugggggucacauaccuugcauugaucgccaccuuuaaaauucagcccuuccuggcuuuaggauuuuuccucaggaagcugacuucucgcgaaaaccuucugcuaggcgugggccucgcgauggccacaacccugcaauugccggaggauauagaacagauggcaaaugggaucgcucugggauuaauggcccucaaacugacaacucaguuugagaccuaucagcuuuggacggcccugauuuccuugacauguucaaacaccaucuucacucucaccguugcuuggcgaacagcaacucugauucuagccggugugagucugcuuccugucugccaaagcucguccaugcggaagaccgacuggcucccaaugacgguagcggcuaugggcgugcccccucugcccuuguuuaucuucucucugaaggauacauuaaaacguagaagcuggccacucaaugaggggguuauggccgugggacuggucucaauacuugcaaguucccuguugaggaacgacgugccuauggccggcccccucguagcuggugggcugcuaaucgcauguuacgugauuaccggaacuucugccgaucugacagucgaaaaggcggcugacguuaccugggaggaagaggccgaacagacuggcgugagccauaaccuuaugaucacaguggacgaugacggcaccaugcgcauuaaagaugacgagacggagaauauccucacuguccuguugaagaccgcauuacugauaguguccgggauuuuuccauacucaaucccggccacacuccugguuuggcacaccuggcagaaacagacacaacggagcggaguacuuugggaugugccuagucccccagaaacucagaaggcugagcuggaagagggugucuauagaaucaaacagcagggcauuuucgggaagacccaagugggaguuggcgugcagaaggagggugucuuucauacgauguggcacgugacaaggggggccguauugacuuacaacggaaaacgacuagaacccaauugggcaucugucaagaaagaccugauauccuauggcggcggguggcgccucagcgcucaguggcaaaagggagaggaagugcagguuaucgccguggagccugguaaaaacccaaagaauuuccagaccaugcccggcacauuccagaccacuaccggggaaauuggagcgaucgcccuggauuuuaagccuggcacaucggguucaccgauuaucaaccgggaggggaaagucgugggacuuuacggcaauggcguugugacgaagaacgggggauaugucucugguauagcacaaacuaaugcugagccagacggccccaccccugaauuagaggaagagauguucaaaaagagaaaccugacaaucauggaucuccacccagggaguggaaaaaccaggaaguacuugcccgccauugugcgugaagcuaucaagcgccggcugagaacucucauucuggcaccuacaaggguaguggccgccgagauggaggaagcucuuaaaggccugccgauccgauaucagaccacggcgacuaaguccgagcauacaggucgggaaauaguugacuugaugugccacgcaaccuuuaccaugcgccuacugagccccgucagagugccaaauuacaaccucauuaucauggaugaggcccauuucacugacccugcuucuaucgccgcaaggggguacauuagcacacgggugggaaugggcgaagccgcugcgaucuuuaugaccgccacacccccaggcacugcagaugcuuucccucaguccaaugcccccauacaggacgaggagcgagacauuccagaaagaucauggaacagugggaaugaguggaucacggauuuugcaggaaaaaccgucugguucguaccgagcauuaaggccgguaacgacaucgcuaacuguuuacgcaaaaauggcaagaaggugauacaacugucuaggaaaacauuugauacugaauaucagaagaccaaacuuaacgacugggauuucguugugacaaccgacauuuccgagaugggggccaauuuuaaggcggaucgugucaucgacccucggagaugccugaaacccgugauccucacugauggaccagagaggguuauuuuggcaggccccaugccugugacggccgcuucagccgcucagcgccgagguagagucgggcggaacccacagaaggaaaaugaccaauacaucuucaccggccagccccugaacaaugaugaggaccacgcacauuggacagaagccaagaugcuccuggacaacauuaauacuccugagggaauaaucccggcucuuuucgaaccagagagggagaaaagugccgcaauugauggcgaauaucgccuaaagggggagagccguaaaaccuuuguggaacugaugagacggggagacuugcccguaugguuagcgcacaagguggccuccgaggguaucaaauacacagauaggaaguggugcuucgacggccagcgcaacaaucagauccuggaagagaacauggauguugagauuuggaccaaagaaggggagaagaagaaacuccgaccuagauggcuggacgcucggacuuauucugauccccuugcccugaaggaauuuaaagacuucgcagcuggaaggaagucgauagcccucgauuuggucacagagaucggccgcgugccaagccaccuggcacauagaacgaggaaugcccuagacaaccuggugaugcuccacaccucagaacauggugggaaagcuuaccggcacgcggucgaggagcuuccugaaacuauggagacacuguuauugcugggccucaugauucugcuuaccggaggcgccaugcuguuucucaucuccgggaagggaauugguaagaccaguaucggcuugauauguguuaucgcaucuagcgggaugcuguggauggcugaaauucccuuacaauggaucgccuccgccauugugcuagaguucuuuaugaugguacugcucaucccagagccugaaaaacagcguacaccgcaggauaaucaacuugcauauguggucauaggaauucugacuuuggcugccaucauugcggcuaacgagaugggccugcucgaaacgaccaagcgcgaccuggguaugucaaaagagcccggggugguuucuccaacaagcuaccuugauguggaccuccacccugccagugcauggacucuguacgccgucgcuaccacaguaaucacccccauguugcgacauacuauagaaaauuccacggcaaacgugagccuggccgcgaucgcuaaccaggccguuguguuaaugggccuagacaagggauggccaauuucuaaaauggaucugggcgucccucuccuugcacuggggugcuauucacaggugaaucccuugacacugaccgccgcuguccuccugcuuaucacucacuacgccauuaucggaccgggcuuacaggcaaaggcuaccagagaggcccaaaagaggacagcggccgguauaaugaaaaacccaacuguggacgggauuaugaccaucgaucuggacccuguuaucuaugauuccaaguucgagaaacagcucggacaggugauguugcugguacuaugugcagugcagcugcuccuuaugcggacaaguugggcucugugcgaagccuugacgcuggcaaccggccccauuacuacacucugggaggguagcccaggcaaguuuuggaauaccacuaucgcugucucgauggccaacauauuccgcgggucuuaccuggccggagcgggcuuagcuuuuuccauuaugaaaagcguugggacaggaaagagaggcaccgguucacaaggggaaacgcuuggagagaaguggaaaaagaaacugaaucagcucaguaggaaggaauucgaccuauauaaaaagucuggcaucaccgagguggaucggacagaggcaaaagaaggucugaagcgaggcgagauuacucaucacgccgucuccagagggagcgcuaaguugcagugguuuguggaacgcaacaugguaauccccgagggaagggugauagaccugggcugugggcggggaggcuggucauacuauugcgccggucucaaaaagguuaccgaagugcguggguacacaaaaggaggcccuggccaugaggagccgguccccaugaguacuuacggguggaauaucgugaagcuuaugagcggaaaagaugucuucuaucugccaccugaaaagugugacaccuugcugugcgauauuggugaguccucucccagcccuacaguggaagaguccagaaccaucaggguucucaagaugguagagccaugguuaaaaaacaaucaguucuguauuaaggugcugaaccccuacaugccuacugucaucgaacaccuugagcgccugcaacggaaacacggcgggaugcuagugcgaaauccacucucaagaaacucuacgcaugaaauguauuggauuaguaauggaacaggcaacaucguugcaucggugaauauggucagcaggcuguugcugaaccgcuuuaccaugacucaccggagacccaccauagagaaggacguggaucucggugccgggacacgucauguaaacgcugaaccggagacgccuaauauggacgugauuggagagaggaucaaacggaucaaggaagagcacaacuccaccuggcacuacgacgaugaaaauccauauaagacuugggcguaccauggcucuuaugagguuaaagccacaggcucagcaagcuccaugauuaacggggucgugaagcuucugaccaaacccugggacguggucccuaugguuacucagauggcuaugacagauaccacaccauucggacagcaacgcguguuuaaggaaaaaguagacacucgaacccccagaaguaugccggguacgaggcgggugaugggcauaaccgccgagugguuauggcgcacacuggggagaaauaagaagccuagguugugcacucgagaggaauucaccaaaaagguccggacaaacgcagccaugggagcuguguuuacugaggaaaaucagugggauucugccaaagcggcaguugaggacgaagauuucuggaagcucguggaccgugagagagagcugcacaaacuaggcaagugugguagcugcgucuacaacaugauggggaaacgcgaaaagaagcuuggagaguuuggcaaagccaagggcucaagggcuaucugguacauguggcugggggcccgguaucucgaauucgaggcacugggauuuuugaaugaggaucauugguucuccagagaaaacaguuacagcgguguggagggcgaagggcugcacaaacucggauauauucuucgcgacaucucuaagauucccggcggugcuauguacgccgaugacaccgcugggugggacacgaggaucacagaggaugaccugcauaaugaagagaaaauaacccagcagauggauccagagcaccgacaauuagccaacgcaaucuuuaagcugacuuaucagaauaagguaguuaaagugcagcggccuacacccaccggaacugucauggacauuaucuccagaaaggaucagaggggcucaggccaaguggggaccuacggauugaacacauucacgaauauggaagcgcagcucauucgccagauggagggugaaggcgugcugagcaaagccgaccuagagaacccacaccuucccgaaaagaaaaucacccaguggcuggagacuaagggggucgagcgucucaagcggauggcuauaucgggagaugacugcguugugaaaccuauugaugacagauuugccaacgcacuguuggcuuuaaaugauaugggcaagguaaggaaagacaucccacaauggcagccgucuaaggguuggcaugauuggcagcaggugcccuucuguagucaccauuuccacgaacugaucaugaaagacgggcgcaagcucgucgugccuugccgaccacaagacgagcuuauuggacgggccagaauaucccagggcgcaggcuggagccugagggaaacagccugucuagggaaggcguaugcucagauguggucacugauguacuuucaccgcagagaucuccgguuggccuccaacgcaaucugcucugccguucccgugcauugggucccuaccagcaggacuacauggaguauucacgcucaucaccaauggaugaccacggaggacaugcugacaguguggaaucguguauggaucgaagauaacccauggauggaggacaaaacccccguuacuaccugggagaaugugccuuaccuuggaaagcgagaagaucaguggugugguucccugauuggccucacaagccgcgccacuugggcacagaacaucccgaccgcuauacagcaagucagaucuuuaaucgggaaugaggaauuccuggacuauaugccaucaaugaaacgguuuaggaaggaggaggaaagugagggagccauuugguga

SEQ ID NO: 15416 - RNA, 9873 nt, Artificial Sequence
  derived and/or modified CDS sequence (opt3) from DENV-3__EU687219__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauugcugaaguugagccggaagacaucgauugcugguguaaccugacuaguaccugggugacauaugggaccugcaaucaggccggagagcaccgccgagacaagcguagcguagcacuugccccccaugugggcaugggucuggauacuagaacacaaaccuggauguccgcugagggggcauggaggcaggucgaaaaaguggagacgugggccuugcggcacccuggauucacuauucucgcucuguuucuggcccauuacaucggcaccucucucacacagaagguugugauauucaucuuacugaugcuugucacuccaucgaugaccaugcgcugugugggcguagggaacagagacuuuguugaaggauugucaggugcgacauggguggaugucgugcuggagcacggcgggugcgugaccacgauggcaaagaauaaacccacucuagacauugagcuccagaagacagaagccacccaacuggcuacucuuaggaaacuguguaucgagggaaagauuacaaacaucaccacggauagccggugcccuacccagggcgaagccgucuugccagaggaacaggaccagaauuauguuuguaaacacacauacguggaucgcgguugggggaacggaugcggccucuucggcaaggggagucugguaacuugcgcaaaguuucaauguuuagagcccauagagggaaaagugguccaguaugaaaaucugaaguacaccgugauuaucacaguucauacuggugaccagcaccaggugggcaacgagacccaaggggucacagcugaaauuaccccucaggccuccacuacggaggcgauccucccagaauauggaacacuuggccuggagugcucuccgcgaaccgguuuggacuucaaugagaugauccuacugacuaugaaaaacaaggccuggauggugcauagacagugguuuuucgaucucccccugccuuggaccagcggggcaacaaccgaaacuccaacauggaauaggaaagagcuucugguaacguuuaagaacgcucacgccaaaaagcaagaaguuguggucuugggcucccaggagggagcuaugcacaccgcccucacuggcgcaacagaaauucagaauucagggggaaccaguauauucgccggucaucugaagugucgguuaaaaauggacaagcuggagcuaaaaggcaugagcuacgcuaugugcacaaacacuuuugugcucaagaaagaggucucugaaacccagcacgggacgauccugauuaagguggaguacaagggagaagauguucccuguaaaaucccuuucuccaccgaggacggccaagguaaggcgcauaacgggcgucuuauaacagcaaauccagugguaacuaaaaaggaggaacccgucaacauugaggccgaaccgccuuucggcgagucaaauaucgugaucggaauuggcgauaacgcuuugaaaaucaauugguauaagaaggggagcaguauuggaaaaauguuugaagccaccgcacgcggugccagaaggauggcuauacugggcgacacagccugggauuucgggucuguuggaggcgugcucaacucccuggguaagaugguccaccagaucuuugggagcgcauacacugcgcuuuucucgggcgugucuuggguaaugaaaauuggaaucggcgugcuguugaccuggaucgggcucaauuccaagaacacgucaaugaguuuuagcugcauugcuauaggaaucauuacacuguauuuaggcgccguuguccaggcagacauggguugugugaucaauuggaaagggaaggagcugaagugcggauccggcauuuucgugaccaacgagguccauacuuggacagaacaguacaaauuucaagccgauucucccaagcggcuagcuaccgccaucgcaggugcuugggagaauggcguuugugggauacgaagcacuacccgcauggaaaaccuccuguggaaacagaucgccaaugagcuuaacuauauuuugugggaaaauaacaucaagcugacaguggugguaggagacauuaucggcguccucgagcaggggaaaagaacgcugaccccacagccuauggaguuaaaguacucauggaaaacuuggggaaaggcgaagauagugacagccgaaacccaaaacaguuccuucauuaucgauggccccaauacaccagagugccccagcguuucuagggcuuggaacgugugggaagucgaggacuaugguuuugggguguucacuaccaauauuuggcugaaacuucgggaaguuuacacgcaguugugugaccaccgccucaugucagcagccgugaaggaugagagagcuguacacgccgacaugggauacuggaucgagagucagaaaaacggcagcuggaagcuggaaaaagcaucccuaauagaggucaagacaugcaccuggccuaagucucauacucuguggucgaauggugugcucgaaagcgauaugaucauuccaaaaucccuggcgggcccgaucucacagcacaacuauaggcccggguaccauacccaaacagccggaccuuggcaccuuggcaaguuggagcuggacuuuaauuauugcgaggggacuaccguggucauuacagaaaacuguggaacgcguggcccaaguuuacggaccacuacaguuucugguaaacucauccacgaguggugcugucgaagcugcacccugcccccucuuagauacaugggggaagauggauguugguauggcauggagauaaggccaauuuccgaaaaggaggagaauauggugaaaucacugguaagcgcugguucuggcaagguggacaacuucacuaugggggucuugugccucgccauccuguuugaagaggugaugcgcggaaaguucggcaaaaagcauaugaucgcagggguuuucuuuacauucgugcuacugcucuccggacagauuaccuggcgggauauggcucacacgcugaucaugauuggcaguaaugccagcgacagaauggguaugggggucacuuaccuugcauugauagccaccuuuaaaauccagcccuuccuggcuuuaggauuuuuccucaggaagcugacaucucgcgaaaaccuucugcuaggcgugggccucgcgauggccaccacucugcaauugccggaggauauugaacagauggcaaaugggaucgcucugggauuaauggcccucaaacugauuacacaguuugagaccuaucagcuuuggacagcccugaucuccuugacuuguucaaacaccauauucacgcucacaguugcuuggcgaaccgcaacucugauccuagccggugugagucugcuuccugucugccaaagcucguccaugcggaagaccgacuggcucccaaugacaguagcggcuaugggcgugcccccucugcccuuguuuauuuucucucugaaggauacuuuaaaacguagaagcuggccacucaaugaggggguuauggccgugggacuggucucaauccuugcaaguucccuguugaggaacgacgugccuauggccggcccccucguagcuggugggcugcuaauugcauguuacgugaucaccggaacgucugccgaucugacagucgaaaaggcggcugacguuaccugggaggaagaggccgaacagacuggcgugagccauaaccuuaugauaacaguggacgaugacggcaccaugcgcauuaaagaugacgagacugagaauauccucacaguccuguugaagaccgcauuacugaucguguccgggauuuuuccauacucaauaccggccacgcuccugguuuggcacacuuggcagaaacagacccaacggagcggaguacuuugggaugugccuagucccccagaaacacagaaggcugagcuggaagagggugucuauagaaucaaacagcagggcauuuucgggaagacccaagugggaguuggcgugcagaaggagggugucuuucauacaauguggcacgugacuaggggggccguauugaccuacaacggaaaacgacuagaacccaauugggcaucugucaagaaagaccugaucuccuauggcggcggguggcgccucagcgcucaguggcaaaagggagaggaagugcagguuauugccguggagccugguaaaaacccaaagaauuuccagacgaugcccggcacauuccagacuaccacaggggaaaucggagcgauagcccuggauuuuaagccuggcaccucggguucaccgaucauuaaccgggaggggaaagucgugggacuuuacggcaauggcguuaucacuaagaacgggggauaugugucugguauugcacaaaccaaugcugagccagacggccccacaccugaauuagaggaagagauguucaaaaagagaaaccugacgaucauggaucuccacccagggaguggaaaaacuaggaaguacuugcccgccauaguccgugaagcuauuaagcgccggcugagaacccucauccuggcaccuacaagggugguagccgccgagauggaggaagcucuuaaaggccugccgauccgauaucagaccacugcgacaaaguccgagcauaccggucgggaaauuguggacuugaugugccacgcaacguuuacuaugcgccuacugagccccguuagagucccaaauuacaaccucaucauaauggaugaggcccauuucacagacccugcuucuauugccgcaaggggguacaucagcacccgggugggaaugggcgaagccgcugcgauuuuuaugaccgccacucccccaggcacagcagaugcuuucccucaguccaaugcccccauccaggacgaggagcgagacauaccagaaagaucauggaacagugggaaugaguggauuaccgauuuugcaggaaaaacagugugguucgucccgagcaucaaggccgguaacgacaucgcuaacuguuuacgcaaaaauggcaagaagguaauucaacugucuaggaaaacuuuugauacggaauaucagaagaccaaacuuaacgacugggauuucgugguuacaacugacaucuccgagaugggggccaauuuuaaggcggaucgugugauugacccucggagaugccugaaacccgucauacucaccgauggaccagagagggugaucuuggcaggccccaugccuguuacagccgcuucagccgcucagcgccgagguagaguggggcggaacccacagaaggaaaaugaccaauacauuuucaccggccagccccugaacaaugaugaggaccacgcacauuggacugaagccaagaugcuccuggacaacaucaauacgccugagggaaucauuccggcucuuuucgaaccagagagggagaaaagugccgcaauagauggcgaauaucgccuaaagggggagagccguaaaaccuuugucgaacugaugagacggggagacuugcccgugugguuagcgcacaagguagccuccgaggguaucaaauacacagauaggaaguggugcuucgacggccagcgcaacaaucagauucuggaagagaacauggauguggagaucuggacuaaagaaggggagaagaagaaacuccgaccuagauggcuggacgcucggaccuauucugauccccuugcccugaaggaauuuaaagacuucgcagcuggaaggaagucgauugcccucgauuugguuacagagaucggccgcgucccaagccaccuggcacauagaaccaggaaugcccuagacaaccuggugaugcuccacacuucagaacauggugggaaagcuuaccggcacgcgguggaggagcuuccugaaacaauggagacgcuguuauugcugggccucaugauacugcuuaccggaggcgccaugcuguuucucaucuccgggaagggaauugguaagacuaguaucggcuugauuugugucaucgcaucuagcgggaugcuguggauggcugaaauacccuuacaauggauugccuccgccaucguucuagaguucuuuaugauggugcugcucauuccagagccugaaaaacagcguacaccgcaggauaaucaacuugcauauguagugaucggaauacugaccuuggcugccaucauugcggcuaacgagaugggccugcucgaaaccacaaagcgcgaccuggguaugucaaaagagcccggggucgugucuccaacuagcuaccuugauguugaccuccacccugccagugcauggacgcuguacgccguggcuaccacagucaucacucccauguugcgacauaccauugaaaauuccacagcaaacguaagccuggccgcgaucgcuaaccaggccgugguuuuaaugggccuagacaagggauggccaauaucuaaaauggaucugggcgugccucuccuugcacuggggugcuauucacaggucaaucccuugacccugacugccgcugugcuccugcuuauuacgcacuacgccaucaucggaccgggcuuacaggcaaaggcuacaagagaggcccaaaagaggaccgcggccgguauuaugaaaaacccaacugucgacgggaucaugaccauagaucuggacccugugauuuaugauuccaaguucgagaaacagcucggacagguuauguugcuggugcuaugugcaguacagcugcuccuuaugcggacaaguugggcucugugcgaagccuugacucuggcaaccggccccaucacaacgcucugggaggguagcccaggcaaguuuuggaauaccacuauugcugugucgauggccaacaucuuccgcgggucuuaccuggccggagcgggcuuagcuuuuuccauaaugaaaagcgucgggacaggaaagagaggcaccgguucacaaggggaaacucuuggagagaaguggaaaaagaaacugaaucagcucaguaggaaggaauucgaccuauauaaaaagucuggcaucacagagguugaucggaccgaggcaaaagaaggucugaagcgaggcgagauuacgcaucacgccguguccagagggagcgcuaaguugcagugguuugucgaacgcaacauggugauccccgagggaaggguaauugaccugggcugugggcggggaggcuggucauacuauugcgccggucucaaaaaggugaccgaaguucguggguacacaaaaggaggcccuggccaugaggagccggugcccaugaguacuuacggguggaauaucgucaagcuuaugagcggaaaagauguguucuaucugccaccugaaaagugugacaccuugcugugcgauauuggugaguccucucccagcccuacagucgaagaguccagaacuaucagggugcucaagaugguugagccaugguuaaaaaacaaucaguucuguauaaagguacugaaccccuacaugccuaccgugauugaacaccuugagcgccugcaacggaaacacggcgggaugcuaguccgaaauccacucucaagaaacucuacacaugaaauguauuggaucaguaauggaaccggcaacaucguggcaucgguuaauauggugagcaggcuguugcugaaccgcuuuacuaugacgcaccggagacccacaauugagaaggacgucgaucucggugccgggacccgucaugugaacgcugaaccggagacuccuaauauggacguaauaggagagaggaucaaacggauuaaggaagagcacaacuccaccuggcacuacgacgaugaaaauccauauaagacaugggcguaccauggcucuuaugaggugaaagccacgggcucagcaagcuccaugaucaacgggguugucaagcuucugaccaaacccugggacguggugccuauggucacucagauggcuaugacagauaccacuccauucggacagcaacgcguuuuuaaggaaaaaguggacacacgaacccccagaaguaugccggguacaaggcggguaaugggcauuacugccgagugguuauggcgcacccuggggagaaauaagaagccuagguugugcacgcgagaggaauucaccaaaaaggugcggacaaacgcagccaugggagcugucuuuacugaggaaaaucagugggauucugccaaagcggcaguggaggacgaagauuucuggaagcucguugaccgugagagagagcugcacaaacuaggcaagugugguagcugcguguacaacaugauggggaaacgcgaaaagaagcuuggagaguuuggcaaagccaagggcucaagggcuaucugguacauguggcugggggcccgguaucucgaauucgaggcacugggauuuuugaaugaggaucauugguucuccagagaaaacaguuacagcggugucgagggcgaagggcugcacaaacucggauauauacuucgcgacaucucuaagauucccggcggugcuauguacgccgaugacaccgcugggugggacacaaggaucacugaggaugaccugcauaaugaagagaaaauuacccagcagauggauccagagcaccgacaauuagccaacgcaaucuuuaagcugacguaucagaauaaggugguaaaaguucagcggccuacacccaccggaacugugauggacauaauuuccagaaaggaucagaggggcucaggccaagucgggacauacggauugaacaccuucacuaauauggaagcgcagcucauccgccagauggagggugaaggcgugcugagcaaagccgaccuagagaacccacaccuucccgaaaagaaaaucacccaguggcuggagacaaaggggguggagcgucucaagcggauggcuauuucgggagaugacugcgucguuaaaccuauagaugacagauuugccaacgcacuguuggcuuuaaaugauaugggcaaggugaggaaagacaucccacaauggcagccgucuaaggguuggcaugauuggcagcagguacccuucuguagucaccauuuccacgaacugauuaugaaagacgggcgcaagcucguggucccuugccgaccacaagacgagcuuaucggacgggccagaauuucccagggcgcaggcuggagccugagggaaacggccugucuagggaaggcguaugcucagauguggucacugauguacuuucaccgcagagaucuccgguuggccuccaacgcaaucugcucugccgugcccguucauugggugccuaccagcaggacuacauggaguauacacgcucaucaccaauggaugaccacugaggacaugcugacagucuggaaucguguguggaucgaagauaacccauggauggaggacaaaacccccguaacgacaugggagaauguuccuuaccuuggaaagcgagaagaucaguggugugguucccugauuggccucaccagccgcgccacuugggcacagaacaucccgaccgcuauucagcaagugagaucuuuaaucgggaaugaggaauuccuggacuauaugccaucaaugaaacgguuuaggaaggaggaggaaagugagggagccauuugguga

SEQ ID NO: 15417 - RNA, 9873 nt, Artificial Sequence
  derived and/or modified CDS sequence (opt3) from DENV-3__EU726768__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauuguuauaggaaucauuacccuguauuuaggcgcggucgugcaggcugacauggguugugugaucaauuggaaagggaaggagcugaagugcggauccggcauuuucgucacuaacgagguucauacauggaccgaacaguacaaauuucaagccgauucucccaagcggcuagcaacugccaucgcuggugccugggagaauggcgugugugggauacgaagcaccacacgcauggaaaaccuccuguggaaacagaucgcaaaugagcuuaacuauauuuugugggaaaauaacaucaagcugacggugguagucggagacauuaucggcgugcucgagcaggggaaaagaacccugacuccacagccuauggaguuaaaguacucauggaaaacauggggaaaggcuaagauaguuaccgccgaaacacaaaacaguuccuucauuaucgauggccccaauacuccagagugccccagcgcgucuagggccuggaacgugugggaagucgaggacuaugguuuugggguguucaccacgaauauuuggcugaaacuucgggaaguuuacacacaguugugugaccaccgccucaugucagcugcagugaaggaugagagagccguacacgcugacaugggauacuggaucgagagucagaaaaacggcagcuggaagcuggaaaaagccucccuaauagaggucaagaccugcacuuggccuaagucucauacccuguggucgaauggugugcucgaaagcgauaugaucauuccaaaaucccuggcaggcccgaucucacagcacaacuauaggcccggguaccauacacaaacugcgggaccuuggcaccuuggcaaguuggagcuggacuuuaauuauugcgaggggaccacaguggucauuacggaaaacuguggaacccguggcccaaguuuacggacuacaaccguuucugguaaacucauccacgaguggugcugucgaagcugcacucugcccccucuuagauacaugggggaagauggauguugguauggcauggagauaaggccaauuuccgaaaaggaggagaauauggugaaaucacugguaagcgccgguucuggcaagguggacaacuucacaaugggggucuugugccucgcuauccuguuugaagaggugaugcgcggaaaguucggcaaaaagcauaugaucgccgggguuuucuuuaccuucgugcuacugcucuccggacagauuacguggcgggauauggcacacacucugaucaugauuggcaguaaugcuagcgacagaauggguaugggggucaccuaccuugccuugauagcaacauuuaaaauccagcccuuccuggccuuaggauuuuuccucaggaagcugaccucucgcgaaaaccuucugcuaggcgugggccucgcuauggcgacuacacugcaauugccggaggauauugaacagauggccaaugggaucgcacugggauuaauggcucucaaacugauuacccaguuugagacauaucagcuuuggacugcccugaucuccuugaccuguucaaacacgauauucacacucaccguugccuggcgaacugcuacccugauccuagcaggugugagucugcuuccugucugccaaagcucguccaugcggaagacagacuggcucccaaugacuguagccgcgaugggcgugcccccucugcccuuguuuauuuucucucugaaggauaccuuaaaacguagaagcuggccacucaaugaggggguuauggcugugggacuggucucaauccuugccaguucccuguugaggaacgacgugccuauggcaggcccccucguagccggugggcugcuaauugcuuguuacgugaucacgggaacaucugcagaucugaccgucgaaaaggccgcggacguuacuugggaggaagaggcugaacagacaggcgugagccauaaccuuaugauaaccguggacgaugacggcacuaugcgcauuaaagaugacgagacagagaauauccucaccguccuguugaagacggccuuacugaucguguccgggauuuuuccauacucaauaccggcaacucuccugguuuggcacaccuggcagaaacagacacaacggagcggaguacuuugggaugugccuagucccccagaaacccagaaggccgagcuggaagagggugucuauagaaucaaacagcagggcauuuucgggaagacacaagugggaguuggcgugcagaaggagggugucuuucauacuauguggcacgugaccaggggggcuguauugacguacaacggaaaacgacuagaacccaauugggccucugucaagaaagaccugaucuccuauggcggcggguggcgccucagcgcacaguggcaaaagggagaggaagugcagguuauugcuguggagccugguaaaaacccaaagaauuuccagacaaugcccggcacuuuccagaccacaaccggggaaaucggagccauagcgcuggauuuuaagccuggcacuucggguucaccgaucauuaaccgggaggggaaagucgugggacuuuacggcaauggcguugugaccaagaacgggggauaugucucugguaucgcccaaacaaaugcagagccagacggccccacgccugaauuagaggaagagauguucaaaaagagaaaccugacuauuauggaucuccacccagggaguggaaaaaccaggaaguacuugcccgcuaucgugcgugaagccauaaagcgccggcugagaacacucauucuggcuccuaccaggguaguggcagccgagauggaggaagcccuuaaaggccugccgauccgauaucagacuacagcuaccaaguccgagcauacgggucgggaaaucguugacuugaugugccacgcgacuuuuacaaugcgccuacugagccccgucagagugccaaauuacaaccucauuaucauggaugaggcacauuucaccgacccugccucuauagcugccaggggguacauuagcacccgggugggaaugggcgaagcagccgcuaucuuuaugacugcgacacccccaggcaccgccgaugcauucccucaguccaaugcucccauucaggacgaggagcgagacaucccagaaagaucauggaacagugggaaugaguggauaacagauuuugccggaaaaacugucugguucguaccgagcauuaaggcagguaacgacaucgccaacuguuuacgcaaaaauggcaagaaggugauccaacugucuaggaaaacguuugauaccgaauaucagaagacaaaacuuaacgacugggauuucguugugacuaccgacauuuccgagaugggggcuaauuuuaaggccgaucgugucaucgacccucggagaugccugaaacccgugauucucacagauggaccagagaggguuauauuggcgggccccaugccugugaccgcagccucagcugcccagcgccgagguagagucgggcggaacccacagaaggaaaaugaccaauacaucuucacuggccagccccugaacaaugaugaggaccacgcucauuggacggaagcaaagaugcuccuggacaacauuaauaccccugagggaaucaucccggcccuuuucgaaccagagagggagaaaagugcugccauugauggcgaauaucgccuaaagggggagagccguaaaacauuuguggaacugaugagacggggagacuugcccguaugguuagcacacaagguggcguccgaggguauaaaauacacugauaggaaguggugcuucgacggccagcgcaacaaucagauccuggaagagaacauggauguugagauuuggaccaaagaaggggagaagaagaaacuccgaccuagauggcuggacgcccggacauauucugauccccuugcucugaaggaauuuaaagacuucgccgcaggaaggaagucgaucgcucucgauuuggucaccgagauuggccgcgugccaagccaccuggcccauagaacuaggaaugcacuagacaaccuggugaugcuccacacaucagaacauggugggaaagccuaccggcacgcugucgaggagcuuccugaaacgauggagacccuguuauugcugggccucaugauccugcuuacuggaggcgcgaugcuguuucucauauccgggaagggaaucgguaagacaaguauuggcuugaucuguguuauugccucuagcgggaugcuguggauggcagaaauccccuuacaauggauagcuuccgccauugugcuagaguucuuuaugaugguacugcucaucccagagccugaaaaacagcguaccccgcaggauaaucaacuugccuauguggucauuggaauccugaccuuggcagcuauaaucgccgcgaacgagaugggccugcucgaaacaacuaagcgcgaccuggguaugucaaaagagcccggggugguuucuccaacgagcuaccuugauguggaccuccacccugcuagugccuggacccuguacgcagucgccacaacuguaauuacccccauguugcgacauacaaucgaaaauuccaccgcuaacgugagccuggcagccauugcgaaccaggcuguuguguuaaugggccuagacaagggauggccaaucucuaaaauggaucugggcgucccucuccuugcccuggggugcuauucacaggugaaucccuugacucugacggcagccguccuccugcuuauaacacacuacgcuauuaucggaccgggcuuacaggccaaggcaaccagagaggcucaaaagaggacugccgcggguaucaugaaaaacccaaccguggacgggauuaugacaaucgaucuggacccuguuauauaugauuccaaguucgagaaacagcucggacaggugauguugcugguacuaugugccgugcagcugcuccuuaugcggacuaguugggcacugugcgaagcuuugacccuggccacaggccccauuacgacccucugggaggguagcccaggcaaguuuuggaauacuacaaucgcagucucgauggcuaacauuuuccgcgggucuuaccuggccggagccggcuuagcguuuuccaucaugaaaagcguugggaccggaaagagaggcacugguucacaaggggaaacacuuggagagaaguggaaaaagaaacugaaucagcucaguaggaaggaauucgaccuauauaaaaagucuggcauaaccgagguggaucggacggaggcuaaagaaggucugaagcgaggcgagaucacccaucacgcagucuccagagggagcgccaaguugcagugguuuguggaacgcaacaugguaauucccgagggaagggugaucgaccugggcugugggcggggaggcuggucauacuauugcgcuggucucaaaaagguuacagaagugcguggguacacuaaaggaggcccuggccaugaggagccgguccccaugaguaccuacggguggaauauugugaagcuuaugagcggaaaagaugucuucuaucugccaccugaaaagugugacacauugcugugcgauaucggugaguccucucccagcccuacuguggaagaguccagaaccauuaggguucucaagaugguagagccaugguuaaaaaacaaucaguucuguaucaaggugcugaaccccuacaugccuacagucauagaacaccuugagcgccugcaacggaaacacggcgggaugcuagugcgaaauccacucucaagaaacucuacccaugaaauguauuggauuaguaauggaacuggcaacaucguugccucggugaauauggucagcaggcuguugcugaaccgcuuuacgaugacacaccggagacccaccaucgagaaggacguggaucucggugcagggacucgucauguaaacgccgaaccggagaccccuaauauggacgugauuggagagaggauaaaacggaucaaggaagagcacaacuccacauggcacuacgacgaugaaaauccauauaagacgugggcuuaccauggcucuuaugagguuaaagcgaccggcucagccagcuccaugauuaacggggucgugaagcuucugacuaaacccugggacguggucccuaugguuacacagauggcaaugaccgauacuacaccauucggacagcaacgcguguuuaaggaaaaaguagacacccgaacacccagaaguaugccggguacuaggcgggugaugggcaucaccgcugagugguuauggcgcacgcuggggagaaauaagaagccuagguugugcacccgagaggaauucacaaaaaagguccggacuaacgccgcaaugggagccguguuuaccgaggaaaaucagugggauucugcuaaagccgcgguugaggacgaagauuucuggauucucguggaccgugagagagagcugcacaagcuaggcaaaugugguagcugcgucuacaacaugauggggaagcgcgaaaaaaagcuuggagaguuuggcaaggcaaaaggcucaagggccaucugguacauguggcugggggcucgguaucucgaauucgaggcccugggauuuuugaaugaggaucauugguucuccagagaaaacaguuacagcgguguggagggcgaagggcugcacaagcucggauauauacuucgcgacaucucuaaaauucccggcggugcaauguacgcugaugacacagccgggugggacacuaggaucaccgaggaugaccugcauaaugaagagaagauuacgcagcagauggauccagagcaccgacaauuagcuaacgccaucuuuaaacugacauaucagaauaagguaguuaaggugcagcggccuacccccacuggaacagucauggacauaauuuccagaaaagaucagaggggcucaggccaaguggggaccuacggauugaacacuuucaccaauauggaagcacagcucauccgccagauggagggugaaggcgugcugagcaaggcggaccuagagaacccacaccuucccgaaaaaaagaucacacaguggcuggagacgaaaggggucgagcgucucaagcggauggccauuucgggagaugacugcguugugaagccuauagaugacagauuugcuaacgcccuguuggcauuaaaugauaugggcaaaguaaggaaggacaucccacaauggcagccgucuaaagguuggcaugauuggcagcaggugcccuucuguagucaccauuuccacgaacugauuaugaaggacgggcgcaaacucgucgugccuugccgaccacaagacgagcuuaucggacgggcuagaauuucccagggcgccggcuggagccugagggaaaccgcaugucuagggaaggccuaugcgcagauguggucacugauguacuuucaccgcagagaucuccgguuggcuuccaacgccaucugcucugcaguucccgugcauugggucccuacuagcaggacaaccuggaguauacacgcccaucaccaauggaugacuacagaggacaugcugaccguguggaaucguguauggaucgaagauaacccauggauggaggacaagacgcccguuacaaccugggagaaugugccuuaccuuggaaaacgagaagaucaguggugugguucccugauuggccucacuagccgcgcuaccugggcccagaacaucccgacagcaauucagcaagucagaucuuuaaucgggaaugaggaauuccuggacuauaugccaucaaugaagcgguuuaggaaagaggaggaaagugagggagcuauuugguga

SEQ ID NO: 15418 - RNA, 9873 nt, Artificial Sequence
  derived and/or modified CDS sequence (opt3) from DENV-3__EU687226__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaguuuccgaaaaggaggagaauauggugaaaucacugguaagcgcugguucuggcaagguggacaacuucacaaugggggucuugugccucgccauucuguuugaagaggugaugcgcggaaaguucggcaaaaagcauaugaucgcagggguuuucuuuaccuucgugcuacugcucuccggacagaucacguggcgggauauggcucacacucugauuaugaucggcaguaaugccagcgacagaauggguaugggggucaccuaccuugcauugauugccacauuuaaaauacagcccuuccuggcuuuaggauuuuuccucaggaagcugaccucucgcgaaaaccuucugcuaggcgugggccucgcgauggccacuacacugcaauugccggaggauaucgaacagauggcaaaugggauugcucugggauuaauggcccucaaacugaucacccaguuugagacauaucagcuuuggacugcccugauuuccuugaccuguucaaacacgaucuucacacucaccguugcuuggcgaacugcaacccugauacuagccggugugagucugcuuccugucugccaaagcucguccaugcggaagacagacuggcucccaaugacuguagcggcuaugggcgugcccccucugcccuuguuuaucuucucucugaaggauaccuuaaaacguagaagcuggccacucaaugaggggguuauggccgugggacuggucucaauucuugcaaguucccuguugaggaacgacgugccuauggccggcccccucguagcuggugggcugcuaaucgcauguuacgugauuacgggaacaucugccgaucugaccgucgaaaaggcggcugacguuacuugggaggaagaggccgaacagacaggcgugagccauaaccuuaugaucaccguggacgaugacggcacuaugcgcauaaaagaugacgagacagagaauauucucaccguccuguugaagacggcauuacugaucguguccgggaucuuuccauacucaauuccggccacucuccugguuuggcacaccuggcauaaacagacacagcggagcggaguaccuugggaugugcccaguccacccgaaacccaaaaggcugagcuugaagagggugucuauagaauaaaacagcagggcaucuucgggaagacacaggugggaguuggcgugcaaaaggagggugucuuucacucuauguggcacgugacuaggggggccguacugaccuacaacggaaaacgauuggaaccuaauugggcauccgucaagaaagaccuaauuagcuauggcggcggguggcgccugucggcucaguggcagaagggagaggaagugcaaguuaucgccguggagccagguaaaaaccccaagaauuuccagacgaugccuggcacauuccagacuaccacaggggaaauuggagcgaucgcccucgauuuuaagccgggcaccucagguucuccaauaaucaaccgggaggggaaagucgugggacuguacggcaauggcguugugacuaagaacgggggauaugucagugguauugcacagaccaaugcugagcccgacggcccuacaccagaacuugaggaagagauguucaaaaagagaaacuuaacgaucauggaucugcaucccggguccggaaaaacuaggaaguaccucccugccauugugcgugaagcuaucaagcgccgguugagaacccugauacucgcaccgacaaggguaguggccgccgagauggaggaagcucugaaaggccuucccauucgauaucaaaccacugcgacaaagagcgagcacaccggucgggaaaucguugaccugaugugccaugcaacguuuacuaugcgcuugcuaucuccagucagagugccuaauuacaaccugaucauuauggaugaggcccacuucacagaccccgcuagcaucgccgcaaggggguacauauccacccgggugggaaugggcgaagccgcugcgauuuuuaugaccgccacuccaccuggcacagcagaugcuuucccccagucaaaugccccaauccaggacgaggagcgagacauuccggaaagaaguuggaacagcgggaaugaguggaucaccgauuuugcaggaaaaacagucugguucguaccuucuauaaaggccgguaacgacauugcuaacugucuccgcaaaaauggcaagaaggugauccaguuauccaggaaaacuuuugauacggaauaucaaaagaccaaacugaacgacugggauuucguugugacaacugacaucucagagaugggggccaauuuuaaggcggaucgugucauugacccccggagaugccuuaaaccagugauccugaccgauggacccgagaggguuauucucgcaggcccuaugccagugacagccgcuagugccgcucagcgccgagguagagucgggcggaacccccagaaggaaaaugaccaguacauauucaccggccaaccuuugaacaaugaugaggaccaugcacacuggacugaagccaagaugcugcucgacaacaucaauacgccggagggaauuaucccagcucuguucgaacccgagagggagaaaagcgccgcaaucgauggcgaauaucgccuuaagggggagucccguaaaaccuuuguggaacuaaugagacggggagaccugccuguaugguuggcgcacaagguggccucugaggguauuaaauacacagauaggaaguggugcuucgacggccagcgcaacaaucagauauuagaagagaacauggauguugagaucuggacuaaagaaggggagaagaagaaacugcgacccagauggcucgacgcucggaccuauucggauccacuggcccuuaaggaauuuaaagacuucgcagcuggaaggaagagcauugcccuggaucucgucacagagaucggccgcgugccuucacauuuggcacacagaaccaggaaugcccuggacaaccuagugaugcugcauacuuccgaacacggugggaaagcuuaccggcacgcggucgaggagcuccccgaaacaauggagacgcuucuguuauugggccugaugauucuccugaccggaggcgccaugcuuuuucugaucagugggaagggaauagguaagacuucuaucggccucauuuguguuaucgcaagcuccgggauguuguggauggcugaaauuccacugcaguggaucgccucagccauaguguuagaguucuuuaugaugguacuacugauuccugagccggaaaaacaacguacaccccaggauaaucagcucgcauauguggucaucggaauucuuacccuggcugccaucauagcggcuaacgagaugggcuugcuggaaaccacaaagcgcgaccucgguaugucuaaagagccaggggugguuagcccuacuaguuaccuggauguggaccuucaucccgccuccgcauggacgcucuacgccgucgcuaccacaguaaucacuccaaugcugcgacacaccauugaaaauagcacagcaaacgugucuuuggccgcgaucgcuaaccaagccguugugcugaugggcuuagacaagggauggccuauuucaaaaauggaucuaggcgucccccugcucgcacuugggugcuauucccaggugaauccgcugaccuugacugccgcuguccugcuccugaucacgcauuacgccauaauuggaccaggccuucaggcaaaggcuacaagagaggcccagaagaggaccgcggccgguaucaugaaaaacccuacuguggacgggaucaugaccauugauuuagaccccguuaucuaugauaguaaguucgagaaacaacugggacaggugaugcucuugguacugugugcagugcagcuacugcucaugcggacaagcugggcucuuugcgaagcccugacuuuggcaaccggcccaauaacaacgcugugggaggguucgcccggcaaguuuuggaauaccacuauugcugucucuauggccaacaucuuccgcggguccuaccucgccggagcgggccuggcuuuuagcauuaugaaaucaguugggacaggaaagagaggcaccgguagucagggggaaacuuuaggagagaaguggaaaaagaaacuuaaucaacugucuaggaaggaauucgaccucuauaaaaaguccggcaucacagagguggaucggaccgaggcaaaagaaggucuaaagcgaggcgagauaacgcaccaugccgucagcagagggucagcuaagcugcagugguuuguggaacgcaacaugguaaucccugagggaagggugauugacuugggcugugggcggggaggcuggaguuacuauugcgccggucugaaaaagguuaccgaagugcguggguacacaaaaggaggcccgggccacgaggagcccgucccaaugagcacuuacggguggaauaucgugaagcucauguccggaaaagaugucuucuaucuuccucccgaaaagugugacacccuguugugcgauauuggugagucuagcccuuccccaacaguggaagagucaagaacuaucaggguucugaagaugguagagcccuggcucaaaaacaaucaguucuguauuaagguguuaaacccuuacaugccaaccgucaucgaacaccuggagcgccuucagcggaaacauggcgggaugcuggugcgaaauccccuaucuagaaacaguacacacgaaauguauuggauaucgaauggaaccggcaacauuguugcaagcgugaauauggucuccaggcuccuguugaaccgcuuuacuaugacgcaucggagaccgacaaucgagaaggacguggaucugggugccgggacccgucacguaaacgcugaaccugagacuccaaauauggacgugaucggagagaggauuaaacggauaaaggaagagcacaacucuaccuggcauuacgacgaugaaaaucccuauaagacaugggcguaccacggcucauaugagguuaaagccacgggcagcgcauccaguaugaucaacggggucgugaagcuccuuaccaaaccuugggacguggucccaaugguuacucaaauggcuaugacagauaccacucccuucggacagcagcgcguguuuaaggaaaaaguagacacacgaaccccgagaucuaugccugguacaaggcgggugaugggcauuacugccgaguggcuguggcgcaccuuagggagaaauaagaagcccaggcugugcacgcgagaggaauucaccaaaaagguccggacaaacgcagccaugggagcuguguuuacugaggaaaaucaaugggauagcgccaaagcggcaguugaggacgaagauuucuggaaguugguggaccgugagagagagcuccauaaacugggcaagugugguucaugcgucuacaacaugauggggaaacgcgaaaagaagcuaggagaguuuggcaaagccaagggcuccagggcuaucugguacauguggcuuggggcccgguaucuggaauucgaggcacucggauuucugaaugaggaucacugguucaguagagaaaacagcuacucugguguggagggcgaaggguugcauaaacugggauauauucuccgcgacaucuccaagauaccaggcggugcuauguacgccgaugacaccgcugggugggacacaaggaucacugaggaugaccuucacaaugaagagaaaauuacccagcagauggauccugagcaccgacagcuggccaacgcaaucuuuaaguuaacguaucaaaauaagguaguuaaagugcagcggcccacaccaaccggaacugucauggacauuaucucaagaaaggaucagaggggcagcggccagguggggacauacggacugaacaccuucacuaauauggaagcgcaauugauacgccagauggagggugaaggcgugcucucgaaagccgaccuggagaacccccaucuaccugaaaagaaaauuacccaguggcuugagacaaagggggucgagcgucugaagcggauggcuaucucuggagaugacugcguugugaaaccaaucgaugacagauuugccaacgcacuccuggcuuugaaugauaugggcaagguaaggaaagacauuccgcaguggcaacccaguaaggguuggcacgauuggcagcaggugccuuucuguucccaucacuuccacgaauuaauaaugaaagacgggcgcaagcuggucgugccaugccgaccccaggacgagcucaucggacgggccagaauuagccaaggcgcaggcuggucacuuagggaaacggccugucuggggaaggcguaugcucagauguggucccuaauguacuuucaucgcagagaucugcggcucgccucuaacgcaaucugcagcgccguuccugugcacugggucccaaccaguaggacuacaugguccauucaugcucaccaucaguggaugaccacugaggacauguugacaguguggaaucguguauggaucgaagauaaccccuggauggaggacaaaaccccuguuacgacaugggagaaugugccguaccugggaaagcgagaagaucaauggugugguagccuuauaggccugaccucucgcgccacuugggcacagaacaucccaaccgcuauucagcaggucagaucacucaucgggaaugaggaauucuuagacuauaugcccaguaugaaacgguuuaggaaggaggaggaauccgagggagccauuugguga

SEQ ID NO: 15419 - RNA, 9876 nt, Artificial Sequence
  derived and/or modified CDS sequence (opt3) from DENV-3__EU687233__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauugcugaaguugagccggaagacaucgauugcugguguaaccugacuaguaccugggugacauaugggaccugcaaucaggccggagagcaccgccgagacaagcguagcguagcacuugccccccaugugggcaugggucuggauacuagaacacaaaccuggauguccgcugagggggcauggaggcaggucgaaaaaguggagacgugggccuugcggcacccuggauucacuauucucgcucuguuucuggcccauuacaucggcaccucucucacacagaagguugugauauucaucuuacugaugcuugucacuccaucgaugaccaugcgcugugugggcguagggaacagagacuuuguugaaggauugucaggugcgacauggguggaugucgugcuggagcacggcgggugcgugaccacgauggcaaagaauaaacccacucuagacauugagcuccagaagacagaagccacccaacuggcuacucuuaggaaacuguguaucgagggaaagauuacaaacaucaccacggauagccggugcccuacccagggcgaagccgucuugccagaggaacaggaccagaauuauguuuguaaacacacauacguggaucgcgguugggggaacggaugcggccucuucggcaaggggagucugguaacuugcgcaaaguuucaauguuuagagcccauagagggaaaagugguccaguaugaaaaucugaaguacaccgugauuaucacaguucauacuggugaccagcaccaggugggcaacgagacccaaggggucacagcugaaauuaccccucaggccuccacuacggaggcgauccucccagaauauggaacacuuggccuggagugcucuccgcgaaccgguuuggacuucaaugagaugauccuacugacuaugaaaaacaaggccuggauggugcauagacagugguuuuucgaucucccccugccuuggaccagcggggcaacaaccgaaacuccaacauggaauaggaaagagcuucugguaacguuuaagaacgcucacgccaaaaagcaagaaguuguggucuugggcucccaggagggagcuaugcacaccgcccucacuggcgcaacagaaauucagaauucagggggaaccaguauauucgccggucaucugaagugucgguuaaaaauggacaagcuggagcuaaaaggcaugagcuacgcuaugugcacaaacacuuuugugcucaagaaagaggucucugaaacccagcacgggacgauccugauuaagguggaguacaagggagaagauguucccuguaaaaucccuuucuccaccgaggacggccaagguaaggcgcauaacgggcgucuuauaacagcaaauccagugguaacuaaaaaggaggaacccgucaacauugaggccgaaccgccuuucggcgagucaaauaucgugaucggaauuggcgauaacgcuuugaaaaucaauugguauaagaaggggagcaguauuggaaaaauguuugaagccaccgcacgcggugccagaaggauggcuauacugggcgacacagccugggauuucgggucuguuggaggcgugcucaacucccuggguaagaugguccaccagaucuuugggagcgcauacacugcgcuuuucucgggcgugucuuggguaaugaaaauuggaaucggcgugcuguugaccuggaucgggcucaauuccaagaacacgucaaugaguuuuagcugcauugcuauaggaaucauuacacuguauuuaggcgccguuguccaggcagacaccgguugugugaucaauuggaaagggaaggagcugaagugcggauccggcauuuucgugacuaacgagguccauacauggaccgaacaguacaaauuucaagccgauucucccaagcggcuagcuacugccaucgcaggugcuugggagaauggcguuugugggauacgaagcaccacacgcauggaaaaccuccuguggaaacagaucgccaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggcgaagauagugaccgccgaaacacaaaacaguuccuucauuaucgauggccccaauacuccagagugccccagcgcuucuagggcauggaacguuugggaaguggaggacuaugguuuuggggucuucaccacgaauauuuggcugaaacuucgggaaguguacacacaguugugugaccaccgccucaugucagccgcuguuaaggaugagagagccgugcacgcagacaugggauacuggaucgagagucagaaaaacggcagcuggaagcuggaaaaagcgucccuaauagagguaaagaccugcacuuggccuaagucucauacccuguggucgaaugguguccucgaaagcgauaugaucauuccaaaaucccuggccggcccgaucucacagcacaacuauaggcccggguaccauacacaaacugcuggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgccgguucuggcaagguagacaacuucacaauggggguguugugccucgcaauccuguuugaagaggucaugcgcggaaaguucggcaaaaagcauaugaucgcugggguguucuuuaccuucguucuacugcucuccggacagauuacguggcgggauauggcccacacucugaucaugauuggcaguaaugcaagcgacagaauggguaugggggugaccuaccuugccuugauagcuacauuuaaaauccagcccuuccuggcguuaggauuuuuccucaggaagcugaccucucgcgaaaaccuucugcuaggcgucggccucgccauggcaacuacacugcaauugccggaggauauugaacagauggcuaaugggaucgcccugggauuaauggcccucaaacugauuacccaguuugagacauaucagcuuuggacugcucugaucuccuugaccuguucaaacacgauauucacacucaccguggcauggcgaacugccacccugauccuagcggguguuagucugcuuccugugugccaaagcucguccaugcggaagucugacuggcucccaaugacagucgcugccaugggcguacccccucugcccuuguuuauuuucagccugaaggauacuuuaaaacguagaucauggccacucaaugagggggugauggcaguuggacuggugaguauccuugccuccucucuguugaggaacgacgucccuauggcuggcccccucguggcaggugggcugcuaauugccuguuacguaaucaccggaacgagcgcggaucugacaguggaaaaggcugccgacgucaccugggaggaagaggcagaacagacuggcguuucccauaaccuuaugauaacaguggacgaugacggcaccaugcgcauuaaagaugacgagacugagaauauccucacagugcuguugaagaccgccuuacugaucgucucagggauuuuuccauacagcauaccggcuacgcuccugguguggcacacuuggcagaaacagacccggagaaguggaguucuuugggauguaccuucucccccagaaacacaaaaggccgagcuggaagaggguguguauaggaucaaacagcagggcauuuucgggaagacccaggucggagugggcguucaaaaggaggguguguuucauacaauguggcacgucacucgaggggcaguguugaccuacaacggaaaacgccuagaacccaauugggcuuccguaaagaaagaccugaucagcuauggcggcggguggcggcucucggcccaguggcagaagggagaggaaguccaagugauugcgguugagccugguaaaaacccaaagaauuuccagacgaugcccggcacauuccagacuaccacaggggaaaucggagccauagcacuggauuuuaagccuggcaccucagguucuccgaucauuaacagagaggggaaaguggucggacuuuacggcaauggcgugguuacuaagaacgggggauaugugagugguaucgcucagaccaaugccgagccagacggccccacaccugaauuagaggaagagauguucaaaaagaggaaccugacgauuauggaucuccacccaggguccggaaaaacucguaaguacuugcccgcuaucguccgcgaagcaauaaagcggagacugaggacccucauucuggccccuacacgagugguagccgcugagauggaggaagcgcuuaaaggccugccgauccgguaucaaaccacugcaacaaagagcgagcauaccggucgcgaaaucguggacuugaugugccacgccacguuuacuaugagacuacugucucccguuagggucccaaauuacaaccucauuaucauggaugaggcucauuucacagacccugccagcauagcagcccggggguacauuuccacccgagugggaaugggcgaagcugcggccaucuuuaugaccgcaacucccccaggcacagcugaugccuucccucagucaaaugcacccauucaggacgaggagagagacaucccagaacgcaguuggaacagcgggaaugaguggauaaccgauuuugccggaaaaacagugugguucgucccgucuauuaaggcugguaacgacaucgccaacuguuuaaggaaaaauggcaagaagguaauccagcugucccguaaaacuuuugauacggaauaucaaaagaccaaacuuaacgacugggauuucgugguuacaacugacauuucagagaugggggcgaauuuuaaggcagaucgggugaucgacccuagaaggugccugaaacccgucauucucaccgauggaccagagcgcgugauauuggccggccccaugccuguuacagcugccagugcugcacagcgaagaggucggguggggaggaacccacagaaggaaaaugaccaguacaucuucaccggccaaccccugaacaaugaugaggaccacgcccauuggacugaagcuaagaugcuccuggacaacauuaauacgccugagggaaucaucccggcccuuuucgaaccagagcgcgagaaaagcgcagcgauugauggcgaauaucgucuaaagggggaguccagaaaaaccuuugucgaacugaugcggaggggagacuugcccgugugguuagcccacaagguagcuucugaggguauaaaauacacagaucgcaaguggugcuucgacggccagcgaaacaaucagauccuggaagagaacauggauguggagauuuggacuaaagaaggggagaagaagaaacucagaccucgguggcuggacgccaggaccuauucggauccccuugcacugaaggaauuuaaagacuucgcugccggacgcaagagcaucgcacucgauuugguuacagagauuggcagagucccaucacaccuggcccauaggacccggaaugcucuagacaaccuggugaugcuccacacuuccgaacauggugggaaagcguaccgucacgccguggaggagcuuccugaaacaauggagacgcuguuauugcugggccucaugauccugcuuaccggaggcgcaaugcuguuucucauaagugggaagggaaucgguaagacuucuauuggcuugaucugugucauugcuagcuccgggaugcuguggauggccgaaauccccuuacaguggauagccucagcaauuguucuagaguucuuuaugauggugcugcucaucccagagccugaaaaacaacgcacaccgcaggauaaucagcuugcuuauguagugauuggaauccugaccuuggccgcgauaaucgcugccaacgagaugggccugcucgaaaccacaaagcgagaccuggguaugucuaaagagcccggggucgugagcccaacuaguuaccuugauguugaccuccacccugcauccgccuggacgcuguacgcuguggcaaccacagucauuacucccauguugagacauaccaucgaaaauagcacagccaacguaucucuggcggcuauugccaaccaagcagugguuuuaaugggccuagacaagggauggccaaucucaaaaauggaucugggcgugccucuccuugcccuggggugcuauucccaggucaaucccuugacccugacugcugccgugcuccugcuuauaacgcacuacgcaauuaucggaccgggcuuacaggcuaaggccacaagggaggcgcagaagcggaccgccgcagguaucaugaaaaacccaacugucgacgggauuaugaccaucgaucuggacccugugauauaugauaguaaguucgagaaacaacucggacagguuauguugcuggugcuaugugcuguacagcugcuccuuaugcgcacaagcugggcccugugcgaagcauugacucuggcuaccggccccauuacaacgcucugggaggguucgccaggcaaguuuuggaauaccacuaucgccgugucuauggccaacauuuucagaggguccuaccuggcgggagcuggcuuagcauuuagcaucaugaaaucagucgggacaggaaagaggggcaccgguagucagggggaaacucuuggagagaaguggaaaaagaaacugaaucaacucucucggaaggaauucgaccuauauaaaaaguccggcauaacagagguugaucgaaccgaggccaaagaaggucugaagagaggcgagaucacgcaucacgcugugagccgcgggucagccaaguugcagugguuugucgaaaggaacauggugauucccgagggacggguaaucgaccugggcugugggcguggaggcuggaguuacuauugcgcaggucucaaaaaggugaccgaaguuagaggguacacaaaaggaggcccuggccaugaggagccggugcccaugagcacuuacggguggaauauugucaagcuuauguccggaaaagauguguucuaucugccaccugaaaagugugacaccuugcugugcgauaucggugagucuagccccuccccuacagucgaagagucaaggacuauucgcgugcucaagaugguugagccaugguuaaaaaacaaucaguucuguaucaagguacugaaccccuacaugccuaccgugauagaacaccuugagcggcugcagcgaaaacacggcgggaugcuagucagaaauccacucucuaggaacaguacacaugaaauguauuggauuucgaauggaaccggcaacaucguggccagcguuaauauggugucccgccuguugcugaaccgguuuacuaugacgcacagacgucccacaaucgagaaggacgucgaucucggugcugggaccaggcaugugaacgcggaaccggagacuccuaauauggacguaauuggagagcggauaaaacgcaucaaggaagagcacaacucuaccuggcacuacgacgaugaaaauccauauaagacaugggccuaccauggcucauaugaggugaaagcaacgggcagcgcuuccaguaugauuaacgggguugucaagcuucugaccaaacccugggacguggugccuauggucacucaaauggccaugacagauaccacuccauucggacagcagcgaguuuuuaaggaaaaaguggacacaagaacccccaggucuaugccggguacacggcgcguaaugggcaucacugcagagugguuauggagaacccuggggaggaauaagaagccucgauugugcacgcgggaggaauucaccaaaaaggugcguacaaacgccgcuaugggagccgucuuuacugaggaaaaucaaugggauagcgcgaaagcagccguggaggacgaagauuucuggaagcucguugacagagagcgcgagcugcacaaacuaggcaagugugguucaugcguguacaacaugauggggaaaagggaaaagaagcuuggagaguuuggcaaagcuaagggcucccgggccauuugguacauguggcugggggcaagauaucucgaauucgaggcucugggauuuuugaaugaggaucauugguucagucgcgaaaacagcuacucuggugucgagggcgaagggcugcacaaacucggauauauccuuagggacauauccaagauccccggcggugccauguacgcugaugacaccgccgggugggacacacgaauuacugaggaugaccugcauaaugaagagaaaaucacccagcagauggauccagagcaccggcaguuagcaaacgcgauuuuuaagcugacguaucaaaauaaggugguaaaaguucagagaccuacacccaccggaacugugauggacaucauaucaaggaaggaucagcgcggcagcggccaggucgggacauacggauugaacaccugccacucgaauauggaagcccaacucauucgucagauggagggugaaggcgugcugucuaaagcugaccuagagaacccacaucuuagugaaaagaaaaucacucaguggcuggagaccaaggggguggagcggcucaagagaauggccaucuccggagaugacugugucguuaaacccauugaugacagguucgcaaacgcucuguuggccuuaaaugauaugggcaaggugcgcaaagacauaccucaguggcaaccaagcaaggguuggcacgauuggcagcagguaccguuuugcucacaucacuuccacgaacugaucaugaaagacgggcgaaagcucgugguccccugucggccucaggacgagcuuauuggaagagcaaggaucucccaaggcgccggcuggucucugcgcgaaacagcgugccuagggaaggcuuaugcccagauguggagccugauguacuuccauagacgggaucucagguuggcaaguaacgccauuuguuccgcugugccaguucacugggugcccacgagccguaccacuuggucuauccaugcccaccaucaguggaugacaaccgaggacaugcugacugucuggaaucgaguguggauagaagauaacccuuggauggaggacaaaacaccaguaaccacgugggagaauguucccuaccuuggaaagcgcgaagaucaauggugcgguucacugaucggccucacaaguagagcaaccugggcucagaacauuccuacugccauccagcaggugcgguccuuaauugggaaugaggaauuucuggacuauaugccgagcaugaaaagguuccgcaaggaggaggaaucugagggagcgaucugguga

SEQ ID NO: 15420 - RNA, 9873 nt, Artificial Sequence
  derived and/or modified CDS sequence (opt3) from DENV-3__EU687234__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaagugccuuucuccacagaggacggccaagguaaggcucauucagggcgucuuaucacugcgaacccaguagucaccaaaaaggaggaacccgugaauauagaggcagaaccgccuuucggcgagagcaacauuguuaucggaaucggcgauaaugccuugaaaauuaacugguauaagaaggggaguucuaucggaaaaauguuugaagcuacagcccgcggugcaagaaggauggccauucugggcgacacugcuugggauuucggguccgugggaggcguccucaauagccuggguaagauggugcaccagauauuugggucggccuacaccgcacuuuucucuggcguauccugggugaugaaaaucggaauuggcguucuguugacguggaucgggcucaacucaaagaauacaaguaugagcuuuuccugcaucgucauuggaauaaucacccuguauuuaggcgcgguggugcaggcugacauggguugugucauuaacuggaaagggaaggagcugaagugcggaucuggcaucuucguuacuaaugaggugcauacauggaccgaacaguacaaauuucaagccgauagccccaagcggcuagcaacugccauugcuggugccugggagaacggcgugugugggauccgaucaaccacacgcauggaaaaucuccuguggaaacagauagcaaacgagcuuaauuauaucuugugggaaaacaauauuaagcugacgguagucgugggagacaucauuggcguucucgagcaggggaaaagaacccugacuccacagccuauggaguuaaaguacaguuggaaaacauggggaaaggcuaagaucgugaccgccgaaacacaaaacuccagcuucauaauugauggccccaacacuccagagugccccucugcgucaagggccuggaaugucugggaaguggaggacuaugguuuugggguuuucaccacgaacaucuggcugaaacuucgggaaguguacacacaguugugugaccaccgccucaugagugcugcaguaaaggaugagagagccguccacgcugacaugggauacuggauugagagccagaaaaauggcuccuggaagcuggaaaaagccucucuaaucgaggugaagaccugcacuuggccuaagucgcauacccuguggagcaacggugugcucgaauccgauaugauaaucccaaaaucacuggcaggcccgauuagucagcacaauuauaggcccggguaccauacacaaacugcgggaccuuggcaccuuggcaaguuggagcuggacuuuaacuauugcgaggggaccacagucguuaucacggaaaauuguggaacccguggcccaucuuuacggacuacaaccgugagcgguaaacucauucacgaguggugcugucgauccugcacucugcccccucuuagauacaugggggaagauggauguugguauggcauggagaucaggccaauaucagaaaaggaggagaacaugguaaaaagccuggugucugccgguuccggcaaggucgacaauuucacaauggggguguugugccucgcuauucuguuugaagagguuaugcgcggaaaguucggcaaaaagcauaugaucgccgggguguucuuuaccuucguccuacugcucaguggacagaucacguggcgggauauggcacacacucugauuaugaucggcagcaacgcuucugacagaauggguaugggggugaccuaccuugccuugauugcaacauuuaaaauacagcccuuccuggccuuaggauuuuuccucaggaagcugaccucccgcgaaaaucuucugcuaggcguuggccucgcuauggcgacuacacugcaauugccggaggauaucgaacagauggccaacgggauugcacugggauuaauggcucucaaacugaucacccaguuugagacauaucagcuuuggacugcccugauuucauugaccuguaguaauacgaucuucacacucaccguggccuggcgaacugcuacccugauacuagcaggugucagccugcuuccuguaugccaaucguccucuaugcggaagacagacuggcucccaaugacuguggccgcgaugggcguucccccucugcccuuguuuaucuucagccugaaggauaccuuaaaacguagaucauggccacucaacgagggggugauggcugucggacuggugaguauucuugccuccucucuguugaggaaugacguaccuauggcaggcccccucguggccggugggcugcuaaucgcuuguuacgucauuacgggaacaagcgcagaucugaccguugaaaaggccgcggacgugacuugggaggaagaggcugaacagacaggcgugucccauaaccuuaugaucaccgucgacgaugacggcacuaugcgcauaaaagaugacgagacagagaacauucucaccgugcuguugaagacggccuuacugaucguuucagggaucuuuccauacagcauuccggcaacucuccugguauggcacaccuggcagaaacagacacaacggaguggagugcuuugggaugucccuucucccccagaaacccagaaggccgagcuggaagaggguguguauagaauaaaacagcagggcaucuucgggaagacacaaguuggagugggcguccagaaggaggguguguuucauacuauguggcacguaaccaggggggcugucuugacguacaauggaaaacgacuagaacccaacugggccuccgugaagaaagaccugauuagcuauggcggcggguggcgccucucggcacaguggcaaaagggagaggaaguucaggugaucgcugucgagccugguaaaaauccaaagaacuuccagacaaugcccggcacuuuccagaccacaaccggggaaauuggagccaucgcgcuggauuuuaagccuggcacuucagguucuccgauaaucaaucgggaggggaaagugguuggacuuuacggcaacggcguggucaccaagaaugggggauaugugagugguauugcccaaacaaacgcagagccagacggccccacgccugaauuagaggaagagauguucaaaaagagaaaucugacuaucauggaucuccacccaggguccggaaaaaccaggaaguacuugcccgcuauuguacgugaagccaucaagcgccggcugagaacacucauacuggcuccuaccagggugguugcagccgagauggaggaagcccuuaaaggccugccgauucgauaucagacuacagcuaccaagagcgagcauacgggucgggaaaucgucgacuugaugugccacgcgacuuuuacaaugcgccuacugucucccgugagagugccaaacuacaaucucaucauuauggaugaggcacauuucaccgacccugccagcaucgcugccaggggguacauauccacccgggucggaaugggcgaagcagccgcuauuuuuaugacugcgacacccccaggcaccgccgaugcauucccucagucaaacgcucccauccaggacgaggagcgagacauuccagaaagaaguuggaauagcgggaacgaguggaucacagauuuugccggaaaaacuguaugguucgugccgucuauaaaggcagguaaugacauugccaacuguuuacgcaaaaacggcaagaagguuauccaacuguccaggaaaacguuugauaccgaauaucagaagacaaaacuuaaugacugggauuucguggucacuaccgacaucucagagaugggggcuaacuuuaaggccgaucgugugauugacccucggagaugccugaaacccguuauccucacagauggaccagagagggugauuuuggcgggccccaugccugucaccgcagccagugcugcccagcgccgagguagaguggggcggaauccacagaaggaaaacgaccaauacauauucacuggccagccccugaauaacgaugaggaccacgcucauuggacggaagcaaagaugcuccuggacaauaucaacaccccugagggaauuaucccggcccuuuucgaaccagagagggagaaaagcgcugccaucgauggcgaauaucgccuaaagggggagucccguaaaacauuuguagaacugaugagacggggagacuugcccgugugguuagcacacaagguugcgucugaggguauuaaauacacugauaggaaguggugcuucgacggccagcgcaauaaccagauacuggaagagaauauggaugucgagaucuggaccaaagaaggggagaagaagaaacuccgaccuagauggcuggacgcccggacauauucggauccccuugcucugaaggaauuuaaagacuucgccgcaggaaggaagagcauugcucucgauuuggugaccgagaucggccgcgugccaucacaccuggcccauagaacuaggaacgcacuagacaaucuggucaugcuccacacauccgaacauggugggcgggccuaccgucacgcuguugaggagcuuccugaaacgauggagacccuguuauugcugggccucaugauucugcuuacuggaggcgcgaugcuguuucucaucagugggaaaggaauagguaagacaucuaucggcuugauuugugugaucgccagcuccgggaugcuguggauggcagaaauucccuuacaauggaucgcuucagccauaguacuagaguucuuuaugauggugcugcucauuccagagccugaaaagcagcgcaccccgcaggauaaccaacuugccuaugucgugaucggaauucugaccuuggcagcuaucauagccgcgaaugagaugggccugcucgaaacaacuaaacgagaccuggguaugucuaaggagcccgggguugugagcccaacgaguuaccuugaugucgaccuccacccugcuuccgccuggacccuguacgcaguagccacaacugugaucacccccauguugagacauacaauugaaaacagcaccgcuaauguuucucuggcagccaucgcgaaccaggcuguggucuuaaugggccuagacaaaggauggccaauuucaaagauggaucugggcgugccucuccuugcccuggggugcuauucccaggucaaccccuugacucugacggcagccgugcuccugcuuaucacacacuacgcuauaauuggaccgggcuuacaggccaaagcaaccagggaggcucaaaagcggacugccgcggguaucaugaagaauccaaccguugacgggaucaugacaauugaucuggacccugugaucuaugauaguaaauucgagaagcagcucggacagguaauguugcuggugcuaugugccguccagcugcuccuuaugcgcacuagcugggcacugugcgaagcuuugacccuggccacaggccccauaacgacccucugggaggguucgccaggcaaauuuuggaacacuacaauugcaguuucuauggcuaauaucuucagaggguccuaccuggccggagccggcuuagcguuuagcauuaugaagucaguggggaccggaaaaaggggcacugguagucaaggggaaacacuuggagagaaguggaagaaaaagcugaaccagcucucucggaaagaauucgaccuauauaagaaauccggcaucaccgaggucgaucgaacggaggcuaaggaaggucugaaaagaggcgagauaacccaucacgcagugagccgcgggucagccaaguugcagugguuuguagaaaggaauauggugauccccgagggacggguuauugaccugggcugugggcguggaggcuggaguuacuauugcgcuggucucaagaaagugacagaagucagaggguacacuaagggaggcccuggccaugaggagccggugcccaugagcaccuacggguggaacaucgucaaacuuauguccggaaaggauguguucuaucugccaccugaaaaaugugacacauugcugugcgauauuggugagucuagccccuccccuacuguugaagagucaaggaccauccgcguacucaagaugguggagccaugguuaaagaauaaccaguucuguauuaaaguccugaaucccuacaugccuacagugaucgaacaccuugagcggcugcaacgaaagcacggcgggaugcuaguuagaaacccacucucuaggaauaguacccaugaaauguauuggauaucgaacggaacuggcaauauuguggccagcgucaacauggugucccgccuguugcugaaucgguuuacgaugacacacagacgucccaccaucgagaaagacguagaucucggugcagggacuaggcaugugaacgccgaaccggagaccccuaacauggacguuaucggagagcggauuaagcgcauaaaagaagagcacaauucuacauggcacuacgacgaugaaaacccauauaagacgugggcuuaccauggcucauaugaggucaaggcgaccggcagcgccuccaguaugaucaaugggguggugaaacuucugacuaagcccugggacgucguuccuauggugacacagauggcaaugaccgauacuacaccauucggacagcaacgaguauuuaaagaaaagguggacaccagaacacccaggucuaugccggguacucggcgcgucaugggcauuaccgcugagugguuauggagaacgcuggggaggaacaaaaagccucgauugugcacccgggaggaauucacaaagaaagugcguacuaaugccgcaaugggagccguuuuuaccgaggaaaaccagugggauagcgcuaaggccgcgguggaggacgaagauuucuggauccucgucgacagagagcgcgagcugcacaaacuaggcaagugugguucaugcguguacaauaugauggggaaaagggaaaagaaacuuggagaguuuggcaaggcaaagggcucccgggccauuugguacauguggcugggggcuagauaucucgaauucgaggcccugggauuuuugaacgaggaucauugguucagucgcgaaaauagcuacucugguguagagggcgaagggcugcacaaacucggauauauccuuagggacauauccaagauccccggcggugcaauguacgcugaugacacagccgggugggacacucgaauuaccgaggaugaccugcauaacgaagagaaaaucacgcagcagauggauccagagcaccggcaauuagcuucagccauuuuuaagcugacauaucagaauaaaguugugaagguccagagaccuacccccacuggaacagugauggacaucauaagcaggaaggaucagcgcggcucgggccaaguggggaccuacggauugaacacuuucaccaauauggaagcacagcucauucgucagauggagggugaaggcguccugucuaaagcggaccuagagaacccacaccuucccgaaaagaaaaucacacaguggcuggagacgaaggggguugagcggcucaaaagaauggccaucaguggagaugacugcgugguaaagccuauugaugacagguuugcuaaugcccuguuggcauuaaacgauaugggcaaggugcgcaaagacauaccacaauggcagccguccaaggguuggcaugauuggcagcagguccccuucuguagccaccauuuccacgaacugaucaugaaagacgggcgaaagcucgugguuccuugccggccacaagacgagcuuauuggaagagcuaggaucucacagggcgccggcuggucccugcgcgaaaccgcaugucuagggaaagccuaugcgcagauguggucucugauguacuuucacagacgggaucucagguuggcuagcaacgccauuugcagugcagugcccguccauugggugccuacuucccguacaaccuggagcauccacgcccaucaccaauggaugacuacagaggacaugcugaccguauggaaucgaguuuggauagaagauaacccauggauggaggacaagacgcccgugacaaccugggagaaugucccuuaccuuggaaagcgcgaagaucaguggugugguucucugaucggccucacuucaagagcuaccugggcccagaacauuccgacagcaauccagcaagugcggaguuuaauugggaaugaggaauuccuggacuauaugccauccaugaaaagguuucgcaaggaggaggaaagcgagggagcuaucugguga

SEQ ID NO: 15421 - RNA, 9873 nt, Artificial Sequence
  derived and/or modified CDS sequence (opt3) from DENV-3__EU687196__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacaccauuggcguccucgagcaggggaaaagaacucugacaccacagccuauggaguuaaaguacucauggaaaaccuggggaaaggccaagaucgugacagcggaaacucaaaacaguuccuucauaauugauggccccaauaccccagagugccccagcgccucuagggcuuggaacguuugggaaguggaggacuaugguuuuggggucuucacgacaaauaucuggcugaaacuucgggaaguguacacccaguugugugaccaccgccucaugucagcagccguuaaggaugagagagcugugcacgccgacaugggauacuggauugagagucagaaaaacggcagcuggaagcuggaaaaagcaucccuaaucgagguaaagacuugcaccuggccuaagucucauacacuguggucgaaugguguccucgaaagcgauaugauaaucccaaaaucccuggcgggcccgauuucacagcacaacuauaggcccggguaccauacucaaaccgccggaccuuggcaccuuggcaaguuggagcuggacuuuaauuauugcgaggggacaacgguggugaucaccgaaaacuguggaacucguggcccaaguuuacggacaaccacugucucugguaaacucauucacgaguggugcugucgaagcugcacacugcccccucuuagauacaugggggaagauggauguugguauggcauggagaucaggccaauauccgaaaaggaggagaauaugguuaaaucacuggugagcgcugguucuggcaagguagacaacuucaccauggggguguugugccucgccauucuguuugaagaggucaugcgcggaaaguucggcaaaaagcauaugaucgcaggggugaucuucacguuuguucuacugcucuccggacagauuacuuggcgggauguggcucacacccugaucaugauuggcaguaaugccagcgacagaauggguaugggggucacauaccuugcauugauagccaccuucaaaauccagcccuuucuggcuuuaggauucuuucucaggaagcugacuucucgcgaaaaccuucugcuaggcgugggccucgcgauggccacaacccugcaauugccggaggauauugaacagauggcaaaugggaucgcucugggauuaauggcccucaaacugacaacucaguucgagaccuaucagcuuuggacggcccugauuuccuugacauguucaaacaccaucuuuacucucaccguugcuuggcgaacagcaacucugauacuagccggugugagucugcuuccugucugccaaagcucguccaugcggaagaccgacuggcucccaaugacgguagcggcuaugggcgugcccccucugcccuuguucaucuuuucucugaaggauacauuaaaacguagaagcuggccacucaaugaggggguuauggccgugggacuggucucaauucuugcaaguucccuguugaggaacgacgugccuauggccggcccccucguagcuggugggcugcuaaucgcauguuacgugauuaccggaacuucugccgaucugacagucgaaaaggcggcugacguuaccugggaggaagaggccgaacagacuggcgugagccauaaccuuaugaucacaguggacgaugacggcaccaugcgcauaaaagaugacgagacggagaauauucucacuguccuguugaagaccgcauuacugaucguguccgggaucuucccauacucaauuccggccacacuccugguuuggcacaccuggcagaaacagacacaacggagcggaguacuuugggaugugccuagucccccagaaacucagaaggcugagcuggaagagggugucuauagaauaaaacagcagggcaucuuugggaagacccaagugggaguuggcgugcagaaggagggugucuuccauacgauguggcacgugacaaggggggccguauugacuuacaacggaaaacgacuagaacccaauugggcaucugucaagaaagaccugauuuccuauggcggcggguggcgccucagcgcucaguggcaaaagggagaggaagugcagguuaucgccguggagccugguaaaaacccaaagaauuuucagaccaugcccggcauuuuccagacaaccacuggggaaaucggagcgauagcccuggauuucaagccuggcaccucggguucaccgaucauuaaccgggaggggaaagucgugggacuuuacggcaauggcguugugacaaagaacgggggauaugucucugguaucgcacaaacgaaugcugagccagacggccccacuccugaauuagaggaagagauguuuaaaaagagaaaccugaccauuauggaucuccacccagggaguggaaaaacaaggaaguacuugcccgccaucgugcgugaagcuauaaagcgccggcugagaacccucauucuggcaccuacuaggguaguggccgccgagauggaggaagcucuuaaaggccugccgauccgauaucagacaaccgcgacgaaguccgagcauacuggucgggaaaucguugacuugaugugccacgcaacauucaccaugcgccuacugagccccgucagagugccaaauuacaaccucauuaucauggaugaggcccauuuuaccgacccugcuucuauagccgcaaggggguacauuagcacucgggugggaaugggcgaagccgcugcgaucuucaugacagccacccccccaggcacagcagaugcuuuuccucaguccaaugcccccauucaggacgaggagcgagacaucccagaaagaucauggaacagugggaaugaguggauaacugauuucgcaggaaaaacggucugguuuguaccgagcauuaaggccgguaacgacaucgcuaacuguuuacgcaaaaauggcaagaaggugauccaacugucuaggaaaaccuucgauacagaauaucagaagacuaaacuuaacgacugggauuuuguugugaccacagacauuuccgagaugggggccaauuucaaggcggaucgugucaucgacccucggagaugccugaaacccgugauucucaccgauggaccagagaggguuauauuggcaggccccaugccugugacugccgcuucagccgcucagcgccgagguagagucgggcggaacccacagaaggaaaaugaccaauacaucuuuacgggccagccccugaacaaugaugaggaccacgcacauuggaccgaagccaagaugcuccuggacaacauuaauacaccugagggaaucaucccggcucuuuucgaaccagagagggagaaaagugccgcaauugauggcgaauaucgccuaaagggggagagccguaaaacuuucguggaacugaugagacggggagacuugcccguaugguuagcgcacaagguggccuccgaggguauaaaauacaccgauaggaaguggugcuuugacggccagcgcaacaaucagauccuggaagagaacauggauguugagauuuggacaaaagaaggggagaagaagaaacuccgaccuagauggcuggacgcucggaccuauucugauccccuugcccugaaggaauucaaagacuuugcagcuggaaggaagucgaucgcccucgauuuggucacugagauuggccgcgugccaagccaccuggcacauagaacaaggaaugcccuagacaaccuggugaugcuccacaugucagaacauggugggaaagcuuaccggcacgcggucgaggagcuuccugaaacgauggagacccuguuauugcugggccucaugauccugcuuacuggaggcgccaugcuguuccucauauccgggaagggaaucgguaagacaaguauuggcuugaucuguguuauugcaucuagcgggaugcuguggauggcugaaauccccuuacaauggauagccuccgccauugugcuagaguuuuucaugaugguacugcucaucccagagccugaaaaacagcguaccccgcaggauaaucaacuugcauauguggucauuggaauccugaccuuggcugccauaaucgcggcuaacgagaugggccugcucgaaacaacuaagcgcgaccuggguaugucaaaagagcccggggugguuucuccaacgagcuaccuugauguggaccuccacccugccagugcauggacccuguacgccgucgcuacaacuguaauuacccccauguugcgacauacaaucgaaaauuccaccgcaaacgugagccuggccgcgauugcuaaccaggccguuguguuaaugggccuagacaagggauggccaaucucuaaaauggaucugggcgucccucuccuugcacuggggugcuauucacaggugaaucccuugacucugacggccgcuguccuccugcuuauaacacacuacgccauuaucggaccgggcuuacaggcaaaggcuaccagagaggcccaaaagaggacugcggccgguaucaugaaaaacccaaccguggacgggauuaugacaaucgaucuggacccuguuauauaugauuccaaguuugagaaacagcucggacaggugauguugcugguacuaugugcagugcagcugcuccuuaugcggacuaguugggcucugugcgaagccuugacccuggcaacaggccccauuacgacccucugggaggguagcccaggcaaguucuggaauacuacaaucgcugucucgauggccaacauuuuucgcgggucuuaccuggccggagcgggcuuagcuuucuccaucaugaaaagcguugggaccggaaagagaggcacugguucacaaggggaaacacuuggagagaaguggaaaaagaaacugaaucagcucaguaggaaggaauuugaccuauauaaaaagucuggcauaaccgagguggaucggacggaggcaaaagaaggucugaagcgaggcgagaucacccaucacgccgucuccagagggagcgcuaaguugcagugguucguggaacgcaacaugguaauucccgagggaagggugaucgaccugggcugugggcggggaggcuggucauacuauugcgccggucucaaaaagguuacagaagugcguggguacacuaaaggaggcccuggccaugaggagccgguccccaugaguaccuacggguggaauauugugaagcuuaugagcggaaaagaugucuuuuaucugccaccugaaaagugugacacauugcugugcgauaucggugaguccucucccagcccuacuguggaagaguccagaaccguuaggguacucaagaugguggagccaugguuaaaaaacaaucaguucuguauuaagguccugaaccccuacaugccuacagugaucgaacaccuugagcgccugcaacggaaacacggcgggaugcuaguucgaaauccacucucaagaaacucuacccaugaaauguauuggauaaguaauggaacuggcaacauuguggcaucggucaauauggugagcaggcuguugcugaaccgcuucacgaugacacaccggagacccaccaucgagaaggacguagaucucggugccgggacucgucaugugaacgcugaaccggagaccccuaauauggacguuaucggagagaggauuaaacggauaaaggaagagcacaucuccacauggcacuacgacgaugaaaacccauauaagacgugggcguaccauggcucuuaugaggucaaagccaccggcucagcaagcuccaugauuaaugggguggugaagcuucugacuaaacccugggacgucguuccuauggugacacagauggcuaugaccgauacuacaccauuuggacagcaacgcguauucaaggaaaaaguggacacccgaacacccagaaguaugccggguacuaggcgggucaugggcaucaccgccgagugguuauggcgcacgcuggggagaaacaagaagccuagguugugcacccgagaggaauuuacaaaaaaggugcggacuaaugcagccaugggagcuguuuucaccgaggaaaaccagugggauucugccaaagcggcaguggaggacgaagauuuuuggaagcucgucgaccgugagagagagcugcacaaacuaggcaagugugguagcugcguguacaauaugauggggaaacgcgaaaagaagcuuggagaguucggcaaagccaagggcucaagggcuauuugguacauguggcugggggcccgguaucucgaauuugaggcacugggauucuugaacgaggaucauugguuuuccagagaaaauaguuacagcgguguagagggcgaagggcugcacaaacucggauauauccuucgcgacauaucuaagauccccggcggugcuauguacgccgaugacacagcugggugggacacuaggauuaccgaggaugaccugcauaacgaagagaaaaucacgcagcagauggauccagagcaccgacaauuagccaaugcaauuuucaagcugacauaucagaacaagguugugaaaguccagcggccuacccccacuggaacagugauggacaucauauccagaaaggaucagaggggcucaggccaaguggggaccuacggauugaauacuuuuaccaacauggaagcgcagcucauucgccagauggagggugaaggcguccugagcaaagccgaccuagagaauccacaccuucccgaaaagaaaaucacacaguggcuggagacgaaggggguugagcgucucaagcggauggcuaucucgggagaugacugcgugguaaaaccuauugaugacagauucgccaacgcacuguuggcuuuaaacgauaugggcaaggugaggaaagacauaccacaauggcagccgucuaaggguuggcaugauuggcagcagguccccuuuuguagucaccauuuccacgaacugaucaugaaagacgggcgcaagcucgugguuccuugccgaccacaagacgagcuuauuggacgggccagaaucucccagggcgcaggcuggagcuucagggaaaccgccugucuggggaaggcguaugcucagauguggucacuaauguacuuucaccgcagagaucugcggcucgccuccaaugcaauuugcucugccgugcccguccauugggugccuacuagcaggacaaccuggaguauccacgcucaucaccaauggaugacuacagaggacauguugaccguauggaaccguguuuggauagaagauaauccauggauggaggacaaaacgcccgugacaaccugggagaacgucccuuaccugggaaagcgagaagaucaguggugugguucccuuaucggccugacuagccgcgccaccugggcacagaauauuccgacagcuauccagcaagugagaucucucauugggaacgaggaauucuuagacuauaugccaucaaugaaacgguuuaggaaggaggaggaaagugagggagccaucugguga

SEQ ID NO: 15422 - RNA, 9873 nt, Artificial Sequence
  derived and/or modified CDS sequence (opt3) from DENV-3__EU854298__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccaacgccagcagggcuuggaauguuugggaaguggaggacuaugguuuuggggucuucaccacgaacauuuggcugaaacuucgggaagugcacacacaguugugugaccaccgccucaugucugcagccguuaaggaugagagagcugugcaugccgacaugggauacuggaucgagucacagaaaaauggcaguuggaagcuggaaaaagcaagccuaauagagguaaagaccugcacuuggccuaagucccacacccuguggucuaacgguguccucgaaucggauaugaucauuccaaaaagccuggcgggcccgaucucccagcauaauuacaggcccggguaucacacacaaacugccggaccuuggcaccuuggcaaguuggagcuggacuuuaacuacugcgaggggaccacaguggugauuacggaaaauuguggaacccguggcccaucauuacggacuacaaccgucagugguaaacucauccaugaguggugcugucgaucuugcacucugcccccucuuagauauaugggggaagauggauguugguacggcauggagauaaggccaauuagcgaaaaggaggagaacaugguuaaaucccuggugucagcugguagcggcaagguagacaauuucacaauggggguguugugccucgccauccuguuugaagaggucaugcgcggaaaguucggcaaaaagcacaugaucgcagggguguucuuuaccuucguucuacugcucucuggacagauuacguggcgggauauggcucauacucugaucaugauuggcuccaacgccagugacagaauggguaugggggugaccuaucuugcauugauagccacauuuaaaauccagcccuuccuggcuuuaggauuuuuccucaggaagcugaccagccgcgaaaaucuucugcuaggcgucggccucgcgauggccacuacacugcaauugccggaggauauugaacagauggcaaacgggaucgcucugggauuaauggcccucaaacugauuacccaguuugagacauaccagcuuuggacugcccugaucucuuugaccuguuccaauacgauauucacacucaccguggcuuggcgaacugcaacccugauccuagccgguguuucacugcuuccugugugccaaaguagcucgaugcggaagacagacuggcucccaaugacugucgcggcuaugggcguacccccucugcccuuguuuauuuucucccugaaggauaccuuaaaacguagaucuuggccacucaacgagggggugauggccguuggacuggugagcauccuugcaucaagucuguugaggaacgacgucccuauggccggcccccucguggcuggugggcugcuaauugcauguuauguaaucacgggaacauccgccgaucugaccguggaaaaggcggcugacgucacuugggaggaagaggccgaacagacaggcguuucucacaaucuuaugauaaccguggacgaugacggcacuaugcgcauuaaagaugacgagacagagaacauccucaccgugcuguugaagacggcauuacugaucgucagcgggauuuuuccauacuccauaccggccacucuccugguguggcauaccuggcagaaacagacacaacggucaggaguucuuugggauguaccuagccccccagaaacccagaaggcugagcuggaagaggguguguacagaaucaaacagcagggcauuuucgggaagacacaagucggagugggcguucagaaggaggguguguuucacacuauguggcacgucaccaggggggccguguuggcauauaauggaaaacgacuagaacccaacugggcuaguguaaagaaagaccugaucucuuacggcggcggguggcgccucuccgcccaguggcaaaagggagaggaaguccaggugauugcgguugagccugguaaaaauccaaagaacuuccagacgauccccggcacauuccagacuaccacaggggaaauaggagccaucgcacuggauuuuaagccuggcaccagcgguucgccgauuaucaaucgggaggggaaaguggucggacuuuauggcaacggcgugguuacuaagaaugggggauacgugucagguauugcucaaaccaacgccgagccagacggccccacaccugaauuagaggaagagauguucaaaaagagaaaucugacgaucauggaucuccauccagggucuggaaaaacuaggaaguauuugcccgcuauaguccgugaagcaauuaagcgccggcugagaacccucauccuggccccuacaagggugguagccgcugagauggaggaagcgcuuaaaggccugccgauccgauaccagaccacugcaacaaagagugagcacaccggucgggaaauuguggacuugaugugccaugccacguuuacuaugcgccuacugucccccguuagagucccaaacuauaaucucaucauaauggaugaggcucacuucacagacccugccagcauugcagccaggggguacaucucuacccgggugggaaugggcgaagcugcggccauuuuuaugaccgcaacucccccaggcacagcugaugccuucccucagagcaacgcacccauccaggacgaggagcgagacauaccagaaagauccuggaauucagggaacgaguggauuaccgauuuugccggaaaaacagugugguucgucccgaguaucaaggcugguaacgacaucgccaauuguuuacgcaaaaacggcaagaagguaauucaacugagcaggaaaacuuuugauacggaauaccagaagaccaaacuuaaugacugggauuucgugguuacaacugacaucucugagaugggggcgaacuuuaaggcagaucgugugauugacccucggagaugccugaaacccgucauacucaccgauggaccagagagggugaucuuggccggccccaugccuguuacagcugccuccgcugcacagcgccgagguagaguggggcggaauccacagaaggaaaacgaccaauauauuuucaccggccagccccugaauaacgaugaggaccaugcccacuggacugaagcuaagaugcuccuggacaauaucaacacgccugagggaaucauuccggcccuuuucgaaccagagagggagaaaucagcagcgauagauggcgaauaccgccuaaagggggagagucguaaaaccuuugucgaacugaugagacggggagacuugcccgugugguuagcccacaagguagcuagcgaggguaucaaauauacagauaggaaguggugcuucgacggccagcgcaauaaccagauucuggaagagaauauggauguggagaucuggacuaaagaaggggagcgaaagaagcucagaccucgguggcuggacgccaggaccuacuccgauccccuugcacugaaagaauuuaaggacuucgcugccggacgcaaaucuauugcacucgauuugguuacagagaucggcagagucccaucgcaucuggcccacaggacccggaacgcucuagacaaucuggugaugcuccauacuagcgaacacggugggaaggcguaucgucacgccguggaggagcuuccugaaacaauggagacgcuguuauugcugggccucaugauacugcuuaccggaggcgcaaugcuguuucucaucucagggaaaggaauugguaagacuuccaucggcuugauuugugucaucgcuaguucugggaugcuguggauggccgaaauacccuuacaauggauugccagcgcaaucguucuagaguucuuuaugauggugcugcucauuccagagccugaaaagcagcgcacaccgcaggauaaccaacuugcuuacguagugaucggaauacugaccuuggccgcgaucauugcugccaaugagaugggccugcucgaaaccacaaaacgagaccuggguauguccaaggagcccggggucgugucaccaacuucuuaucuugauguugaccuccauccugcaagcgccuggacgcuguacgcuguggcaaccacagucaucacucccauguugagacacaccauugaaaacaguacagccaacguaucccuggcggcuaucgccaaucaggcagugguuuuaaugggccuagacaaaggauggccaauaagcaagauggaucugggcgugccucuccuugcccuggggugcuacucucaggucaaccccuugacccugacugcugccgugcuccugcuuauuacgcauuaugcaaucaucggaccgggcuuacaggcuaaagccacaagggaggcgcaaaagcggaccgccgcagguauuaugaagaauccaacugucgacgggaucaugaccauagaucuggacccugugauuuacgauucaaaauucgagaagcagcucggacagguuauguugcuggugcuaugugcuguacagcugcuccuuaugcgcacauccugggcccugugcgaagcauugacucuggcuaccggccccaucacaacgcucugggaggguaguccaggcaaauuuuggaacaccacuauugccgugagcauggccaauaucuucagagggucguaucuggcgggagcuggcuuagcauuuucuauaaugaaguccgucgggacaggaaaaaggggcaccgguagccaaggggaaacucuuggagagaaguggaagaaaaagcugaaccagcucucacggaaagaauucgaccuauacaagaaaaguggcaucacagagguugaucgaaccgaggccaaggaaggucugaaaagaggcgagauuacgcaccaugcugugucucgcggguccgccaaguugcagugguuugucgaaaggaauauggugauccccgagggacggguaauugaccugggcugugggcguggaggcuggagcuauuacugcgcaggucucaagaaagugaccgaaguuagaggguauacaaagggaggcccuggccacgaggagccggugcccaugucaacuuacggguggaacaucgucaaacuuaugaguggaaaggauguguucuaccugccaccugaaaaaugugacaccuugcugugcgauauuggugagagcucccccucuccuacagucgaagagagcaggacuauccgcgugcucaagaugguugagccaugguuaaagaauaaccaguucuguauaaaaguacugaaucccuauaugccuaccgugauugaacaccuugagcggcugcaacgaaagcauggcgggaugcuagucagaaacccacucuccaggaauucaacacacgaaauguacuggaucucuaacggaaccggcaauaucguggccaguguuaacauggugucgcgccuguugcugaaccgguuuacuaugacgcauagacgucccacaauugagaaagacgucgaucucggugcugggaccaggcacgugaaugcggaaccggagacuccuaacauggacguaauaggagagcggaucaagcgcauuaaagaagagcacaauagcaccuggcauuaugacgaugaaaacccauacaagacaugggccuaucacggcuccuacgaggugaaggcaacgggcucugcuucaagcaugaucaaugggguugucaaacuucugaccaagcccugggacguggugccuauggucacucagauggccaugacagauaccacuccauucggacagcaacgaguuuuuaaagaaaagguggacacaagaacccccagguccaugccggguacacggcgcguaaugggcauuacugcagagugguuauggagaacccuggggaggaacaaaaagccucgauugugcacgcgggaggaauucaccaagaaagugcguacaaaugccgcuaugggagccgucuuuacugaggaaaaccagugggauagugcgaaggcagccguggaggacgaagauuucuggaaacucguugacagagagcgcgagcugcauaagcuaggcaaaugugguucuugcguguauaauaugauggggaagagggaaaaaaagcuuggagaguuuggcaaggcuaaaggcagccgggccaucugguacauguggcugggggcaagauaccucgaauucgaggcucugggauuuuugaacgaggaucacugguucucacgcgaaaauuccuauaguggugucgagggcgaagggcugcauaagcucggauacauacuuagggacaucagcaaaauucccggcggugccauguaugcugaugacaccgccgggugggacacacgaaucacugaggaugaccugcacaacgaagagaagauuacccagcagauggauccagagcaccggcaauuagcaaaugcgaucuuuaaacugacguaccagaacaaggugguaaagguucagagaccuacacccaccggaacugugauggacauaauuucuaggaaagaucagcgcggcuccggccaagucgggacauauggauugaauaccuucacuaacauggaagugcagcucauccgucagauggagggugaaggcgugcugucaaaggccgaccuagagaacccacaucuucccgaaaaaaagaucacccaguggcuggagacaaaaggggucgagcggcucaagagaauggcuauuagcggagaugacugcguugugaagccuauagaugacagguuugccaaugcacuguuggcuuuaaacgauaugggcaaaguacgcaaggacaucccacaauggcagccgucgaaagguuggcacgauuggcagcaggugcccuucuguucucaucacuuccacgaacugauuaugaaggacgggcgaaaacucgucgugccuugccggccacaagacgagcuuaucggaagagccaggauuagucagggcgcaggcuggucccugcgcgaaacggccugucuagggaaggcguacgcucagauguggagccugauguauuuucauagacgggaucucagguuggccucaaaugcaaucugcuccgccguucccgugcacugggucccuaccucucguacuacauggagcauacaugcucaccaucaauggaugaccacugaggacaugcugacaguguggaaccgaguauggaucgaagauaauccauggauggaggacaagacccccguuacgacaugggagaacgugccuuaccuuggaaaacgcgaagaucaguggugugguagucugauuggccucaccuccagagccacuugggcacagaauaucccgaccgcuauucaccagguccggagcuuaaucgggaacgaggaauuccuggacuacaugccaucuaugaagagguuucgcaaagaggaggaauuggagggagccauuugguga

SEQ ID NO: 15423 - RNA, 9873 nt, Artificial Sequence
  derived and/or modified CDS sequence (opt3) from DENV-3__FJ373306__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacguuggcacaucucucacucagaagguggucaucuucauauuacugaugcuugugaccccaucgaugacaaugcgcuguguaggcguugggaacagagacuuuguggaaggauugucaggugccaccugggucgauguggugcuggagcacggcgggugcgucacgacuauggcgaagaauaaacccacacuagacaucgagcuccagaagaccgaagcaacucaacuggccacacuuaggaaacuguguauugagggaaagaucaccaacauuacgaccgauagccggugcccuacacagggcgaagcuguuuugccagaggaacaggaccagaauuauguguguaaacacacuuacguagaucgcgguugggggaacggaugcggccucuucggcaaggggagucuggugaccugcgccaaguuucaauguuuagagcccaucgagggaaaagucgugcaguaugaaaaucugaaguacacaguuauaauuacugugcauaccggugaccagcaccaggucggcaacgagacacaaggggugaccgcagaaaucacuccucaggcuuccacgacagaggccauucucccagaauauggaacccuuggccuggagugcucuccgcgaacugguuuggacuucaaugagaugauccuacugaccaugaaaaacaaggcguggaugguacauagacagugguuuuucgaucucccccugccuuggacaagcggggccaccacugaaacaccaacguggaauaggaaagagcuucugguuaccuuuaagaacgcacacgcuaaaaagcaagaaguggucguguugggcucccaggagggagccaugcacacugcucucacaggcgccaccgaaauccagaauucagggggaacaaguauuuucgcaggucaucugaagugucgguuaaaaauggacaagcuggagcuaaaaggcaugagcuacgccaugugcacuaacaccuuuguccucaagaaagaggugucugaaacgcagcacgggaccauacugaucaagguugaguacaagggagaagaugugcccuguaaaguaccuuucuccacagaggacggccaagguaaggcucauaacgggcgucuuauuacugcgaauccagucgugaccaaaaaggaggaacccguuaacaucgaggcagaaccgccuuucggcgagucaaauauagugauuggaaucggcgauaacgccuugaaaaucaauugguauaagaaggggagcaguauuggaaaaauguuugaagcuacagcccgcggugcaagaaggauggccauccugggcgacacugcuugggauuucgggucugucggaggcgugcucaacucccuggguaagaugguacaccagauuuuugggagcgccuacaccgcacuuuucucgggcgugucuuggguuaugaaaauaggaaucggcguccuguugacguggauugggcucaauuccaagaacacaucaaugaguuuuagcugcaucgugaucggaauuauaacccuguauuuaggcgcggugguccaggcugacauggguuguguuaucaauuggaaagggaaggagcugaagugcggauccggcauuuucgugacuaacgaggugcauacauggaccgaacaguacaaauuucaagccgauucucccaagcggcuagcaacugccaucgcuggugccugggagaauggcguaugugggauucgaagcaccacacgcauggaaaaccuccuguggaaacagaucgcaaaugagcuuaacuauauauugugggaaaauaacaucaagcugacggucgugguuggagacauuaucggcgugcucgagcaggggaaaagaacccugacuccacagccuauggaguuaaaguacucauggaaaacauggggaaaggcuaagauugucaccgccgaaacacaaaacaguuccuucaucauagauggccccaauacuccagagugccccagcgcgucuagggccuggaacgugugggaaguugaggacuaugguuuugggguguucucaaccaauauuuggcugaaacuucgggaaguauacacgcaguugugugaccaccgccucaugagugcugcagucaaggaugagagagccgugcacgcugacaugggauacuggaucgagagccagaaaaacggcuccuggaagcuggaaaaagccucucuaauugaggugaagacaugcaccuggccuaagucgcauacucuguggagcaaugguguccucgaauccgauaugaucauaccaaaaucacuggcaggcccgaucagucagcacaacuauaggcccggguaccauacccaaacagcgggaccuuggcaccuuggcaaguuggagcuggacuuuaauuauugcgaggggacuaccguugugauuacagaaaacuguggaacgcguggcccaucuuuacggaccacuacaguaagcgguaaacucauccacgaguggugcugucgauccugcacccugcccccucuuagauacaugggggaagauggauguugguauggcauggagauuaggccaaucucagaaaaggaggagaauauggugaaaagccuggucucugccgguuccggcaagguggacaacuucacuauggggguuuugugccucgcuauacuguuugaagaggugaugcgcggaaaguucggcaaaaagcauaugauugccggggucuucuuuacauucgugcuacugcucaguggacagaucaccuggcgggauauggcacacacgcugaucaugauuggcagcaaugcuucugacagaauggguauggggguuacuuaccuugccuugaucgcaaccuuuaaaauucagcccuuccuggccuuaggauuuuuccucaggaagcugacaucccgcgaaaaccuucugcuaggcgugggccucgcuauggcgaccacucugcaauugccggaggauauagaacagauggccaaugggaucgcacugggauuaauggcucucaaacugauuacacaguuugagaccuaucagcuuuggacagcccugaucucauugacuuguaguaacaccauuuucacgcucacagucgccuggcgaaccgcuacucugauccuagcagguguaagccugcuuccugugugccaaucguccucuaugcggaagaccgacuggcucccaaugacaguugccgcgaugggcgugcccccucugcccuuguuuauauucagccugaaggauacuuuaaaacguagaucauggccacucaaugagggggucauggcugugggacugguaaguauccuugccuccucucuguugaggaacgacgugccuauggcaggcccccucgucgccggugggcugcuaauugcuuguuacguuaucaccggaacgagcgcagaucugacaguggaaaaggccgcggacgugaccugggaggaagaggcugaacagacuggcgucucccauaaccuuaugauuacaguggacgaugacggcaccaugcgcaucaaagaugacgagacugagaauauacucacaguucuguugaagaccgccuuacugauuguaucagggaucuuuccauacagcaucccggcaacgcuccugguguggcacacuuggcagaaacagacccaacggaguggaguccuuugggaugugccuucucccccagaaacacagaaggccgagcuggaagaggguguuuauagaauuaaacagcagggcauauucgggaagacccaagugggagucggcgugcagaaggaggguguauuucauacaauguggcacgucacuaggggggcuguguugaccuacaacggaaaacgacuagaacccaauugggccuccguuaagaaagaccugaucagcuauggcggcggguggcgccucucggcacaguggcaaaagggagaggaagugcaggucauugcuguggagccugguaaaaacccaaagaauuuccagacgaugcccggcacauuccagacuaccacaggggaaaucggagccauugcgcuggauuuuaagccuggcaccucagguucuccgaucauaaaccgggaggggaaaguugugggacuuuacggcaauggcgucgugacuaagaacgggggauauguaagugguaucgcccaaaccaaugcagagccagacggccccacaccugaauuagaggaagagauguucaaaaagagaaaccugacgauuauggaucuccacccaggguccggaaaaacuaggaaguacuugcccgcuaucgugcgugaagccauuaagcgccggcugagaacccucauccuggcuccuacaaggguugucgcagccgagauggaggaagcccuuaaaggccugccgauacgauaucagaccacugcuacaaagagcgagcauaccggucgggaaauuguggacuugaugugccacgcgacguuuacuaugcgccuacugucucccgugagagucccaaauuacaaccucaucaucauggaugaggcacauuucacagacccugccagcauugcugccaggggguacaucuccacccggguaggaaugggcgaagcagccgcuauauuuaugaccgcgacucccccaggcacagccgaugcauucccucagucaaaugcucccauucaggacgaggagcgagacaucccagaaagaaguuggaacagcgggaaugaguggauuaccgauuuugccggaaaaacagugugguucguuccgucuaucaaggcagguaacgacauagccaacuguuuacgcaaaaauggcaagaaggugauucaacuguccaggaaaacuuuugauacggaauaucagaagaccaaacuuaacgacugggauuucgucgugacaacugacaucucagagaugggggcuaauuuuaaggccgaucguguuaucgacccucggagaugccugaaacccgugauucucaccgauggaccagagagggucaucuuggcgggccccaugccugugacagcagccagugcugcccagcgccgagguagaguagggcggaacccacagaaggaaaaugaccaauacauuuucaccggccagccccugaacaaugaugaggaccacgcucauuggacugaagcaaagaugcuccuggacaacauaaauacgccugagggaaucauuccggcccuuuucgaaccagagagggagaaaagcgcugccaucgauggcgaauaucgccuaaagggggagucccguaaaaccuuuguggaacugaugagacggggagacuugcccguuugguuagcacacaaggucgcgucugaggguaucaaauacacagauaggaaguggugcuucgacggccagcgcaacaaucagauucuggaagagaacauggauguggagauauggacuaaagaaggggagaagaagaaacuccgaccuagauggcuggacgcccggaccuauucggauccccuugcucugaaggaauuuaaagacuucgccgcaggaaggaagagcaucgcucucgauuuggugacagagauuggccgcgucccaucacaccuggcccauagaaccaggaaugcacuagacaaccugguuaugcuccacacuuccgaacauggugggaaagccuaccggcacgcuguggaggagcuuccugaaacaauggagacgcuguuauugcugggccucaugauccugcuuaccggaggcgcgaugcuguuucucauuagugggaagggaaucgguaagacuucuauaggcuugaucuguguaauugccagcuccgggaugcuguggauggcagaaauccccuuacaauggauugcuucagccaucgugcuagaguucuuuaugaugguccugcucauaccagagccugaaaaacagcguacaccgcaggauaaucaacuugccuaugugguuauuggaauccugaccuuggcagcuauuaucgccgcgaacgagaugggccugcucgaaaccacaaagcgcgaccuggguaugucuaaagagcccgggguggucagcccaacuaguuaccuugauguagaccuccacccugcuuccgccuggacgcuguacgcaguggccaccacaguuauaacucccauguugcgacauaccaucgaaaauagcacagcuaacgugucucuggcagccauugcgaaccaggcugucguguuaaugggccuagacaagggauggccaaucucaaaaauggaucugggcgucccucuccuugcccuggggugcuauucccaggugaaucccuugacccugacugcagccguucuccugcuuauuacgcacuacgcuaucauaggaccgggcuuacaggccaaggcaacaagagaggcucaaaagaggaccgccgcggguauuaugaaaaacccaacuguggacgggaucaugaccaucgaucuggacccuguaauuuaugauaguaaguucgagaaacagcucggacaggugauguugcugguccuaugugccguucagcugcuccuuaugcggacaagcugggcacugugcgaagcuuugacucuggccaccggccccaucacaacgcucugggaggguucgccaggcaaguuuuggaauaccacuauagcagugucuauggcuaacauuuuccgcggguccuaccuggccggagccggcuuagcguuuagcaucaugaaaucagucgggacaggaaagagaggcaccgguagucaaggggaaacucuuggagagaaguggaaaaagaaacugaaucagcucucuaggaaggaauucgaccuauauaaaaaguccggcauuacagagguggaucggaccgaggcuaaagaaggucugaagcgaggcgagaucacgcaucacgcaguaagcagagggucagccaaguugcagugguuuguggaacgcaacaugguuauacccgagggaagggugaucgaccugggcugugggcggggaggcuggaguuacuauugcgcuggucucaaaaaggucaccgaagugcguggguacacaaaaggaggcccuggccaugaggagccgguccccaugagcacuuacggguggaauauugugaagcuuauguccggaaaagauguuuucuaucugccaccugaaaagugugacaccuugcugugcgauaucggugagucuagccccuccccuacaguagaagagucaagaacuauuagggugcucaagauggucgagccaugguuaaaaaacaaucaguucuguaucaaggugcugaaccccuacaugccuaccguuauugaacaccuugagcgccugcaacggaaacacggcgggaugcuagugcgaaauccacucucuagaaacaguacacaugaaauguauuggaucucgaauggaaccggcaacauagucgccagcgugaauaugguauccaggcuguugcugaaccgcuuuacuaugacgcaccggagacccacaauugagaaggacguggaucucggugcagggacccgucauguuaacgccgaaccggagacuccuaauauggacgucaucggagagaggaucaaacggauuaaggaagagcacaacucuaccuggcacuacgacgaugaaaauccauauaagacaugggcuuaccauggcucauaugaggugaaagcgacgggcagcgccuccaguaugauaaacgggguggucaagcuucugaccaaacccugggacguugugccuaugguaacucagauggcaaugacagauaccacuccauucggacagcaacgcguguuuaaggaaaaagucgacacacgaacccccagaucuaugccggguacaaggcgggugaugggcaucacugcugagugguuauggcgcacccuggggagaaauaagaagccuagguugugcacgcgagaggaauucaccaaaaagguucggacaaacgccgcaaugggagccguguuuacugaggaaaaucagugggauagcgcuaaagccgcggucgaggacgaagauuucuggauucucguggaccgugagagagagcugcacaagcuaggcaaaugugguucaugcguauacaacaugauggggaagcgcgaaaaaaagcuuggagaguuuggcaaggcaaaaggcuccagggccaucugguacauguggcugggggcucgguaucucgaauucgaggcccugggauuuuugaaugaggaucauugguucaguagagaaaacagcuacucugguguugagggcgaagggcugcacaagcucggauauauucuucgcgacaucuccaaaauacccggcggugcaauguacgcugaugacaccgccgggugggacacaaggaucacugaggaugaccugcauaaugaagagaagauuacccagcagauggauccagagcaccgacaauuagcuaacgccaucuuuaaacugacguaucagaauaagguggucaaggugcagcggccuacacccaccggaacugugauggacauuaucucaagaaaagaucagaggggcagcggccaagucgggacauacggauugaacaccuucacuaauauggaagcacagcucauacgccagauggagggugaaggcguucugucgaaggcggaccuagagaacccacaccuucccgaaaaaaagauuacccaguggcuggagacaaaagggguggagcgucucaagcggauggccaucucuggagaugacugcguagugaagccuaucgaugacagauuugcuaacgcccuguuggcauuaaaugauaugggcaaagucaggaaggacauuccacaauggcagccgaguaaagguuggcaugauuggcagcaggugcccuucuguucccaccauuuccacgaacugauaaugaaggacgggcgcaaacucguugugccuugccgaccacaagacgagcuuaucggacgggcuagaauuagccagggcgccggcuggucacugagggaaacggcaugucuagggaaggccuaugcgcagauguggucccugauguacuuucaccgcagagaucuccgguuggcuucuaacgccaucugcagcgcaguccccgugcauuggguaccuaccaguaggacuacaugguccauucacgcccaucaccaauggaugaccacugaggacaugcugacaguuuggaaucguguguggaucgaagauaacccauggauggaggacaagacccccgucacgacaugggagaaugugccuuaccuuggaaaacgagaagaucaguggugugguagccugauaggccucaccucucgcgcuacuugggcccagaacaucccgaccgcaauucagcaaguuagaucauuaaucgggaaugaggaauuccuggacuauaugccaaguaugaagcgguuuaggaaagaggaggaauccgagggagcuauuugguga

SEQ ID NO: 15424 - RNA, 9873 nt, Artificial Sequence
  derived and/or modified CDS sequence (opt3) from DENV-3__EU687197__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguuguguggugaauuggaaagggaaggagcugaagugcggauccggcaucuucgucacuaacgagguucauacauggaccgaacaguacaaauuucaagcagauucucccaagcggcuagccacugcuauugccggugcaugggagaauggcgugugugggauccgaagcaccacacgcauggaaaaccuccuguggaaacagauagcuaaugagcuuaacuauaucuugugggaaaauaacauuaagcugacggugguagucggagacaucauuggcgugcucgagcaggggaaaagaacccugacuccacagccuauggaguuaaaguacucauggaaaacauggggaaaggccaagaucguuaccgcggaaacacaaaacaguuccuucauaauugauggccccaauacuccagagugccccaacgccagcagggcuuggaaugugugggaagucgaggacuaugguuuugggguguucaccacgaacaucuggcugaaacuucgggaaguuuacacacaguugugugaccaccgccucaugucugcagccgugaaggaugagagagcuguacacgccgacaugggauacuggauugagucacagaaaaauggcaguuggaagcuggaaaaagcaagccuaaucgaggucaagaccugcacuuggccuaagucccauacccuguggucuaacggugugcucgaaucggauaugauaaucccaaaaagccuggcgggcccgauuucccagcacaauuauaggcccggguaccauacacaaacugccggaccuuggcaccuuggcaaguuggagcuggacuuuaacuauugcgaggggaccacaguggucaucacggaaaauuguggaacccguggcccaucauuacggacuacaaccguuagugguaaacucauucacgaguggugcugucgaucuugcacucugcccccucuuagauacaugggggaagauggauguugguauggcauggagaucaggccaauaagcgaaaaggaggagaacauggugaaaucccugguaucagcugguagcggcaagguggacaauuucacaaugggggucuugugccucgccauucuguuugaagaggugaugcgcggaaaguucggcaaaaagcauaugaucgcagggguuuucuuuaccuucgugcuacugcucucuggacagaucacguggcgggauauggcucacacucugauuaugaucggcuccaacgccagugacagaauggguaugggggucaccuaccuugcauugauugccacauuuaaaauacagcccuuccuggcuuuaggauuuuuccucaggaagcugaccagccgcgaaaaucuucugcuaggcgugggccucgcgauggccacuacacugcaauugccggaggauaucgaacagauggcaaacgggauugcucugggauuaauggcccucaaacugaucacccaguuugagacauaucagcuuuggacugcccugauuucuuugaccuguuccaauacgaucuucacacucaccguugcuuggcgaacugcaacccugauacuagccggugugucacugcuuccugucugccaaaguagcucgaugcggaagacagacuggcucccaaugacuguagcggcuaugggcgugcccccucugcccuuguuuaucuucucccugaaggauaccuuaaaacguagaucuuggccacucaacgaggggguuauggccgugggacuggucagcauucuugcaucaagucuguugaggaacgacgugccuauggccggcccccucguagcuggugggcugcuaaucgcauguuacgugauuacgggaacauccgccgaucugaccgucgaaaaggcggcugacguuacuugggaggaagaggccgaacagacaggcgugucucauaaucuuaugaucaccguggacgaugacggcacuaugcgcauaaaagaugacgagacagagaacauucucaccguccuguugaagacggcauuacugaucgugagcgggaucuuuccauacuccauuccggccacucuccugguuuggcacaccuggcagaaacagacacaacggucaggaguacuuugggaugugccuagccccccagaaacccagaaggcugagcuggaagagggugucuauagaauaaaacagcagggcaucuucgggaagacacaagugggaguuggcgugcagaaggagggugucuuucauacuauguggcacgugaccaggggggccguauuggcauacaauggaaaacgacuagaacccaacugggcuagugucaagaaagaccugauuucuuauggcggcggguggcgccucuccgcccaguggcaaaagggagaggaagugcagguuaucgcgguggagccugguaaaaauccaaagaacuuccagacgaugcccggcacauuccagacuaccacaggggaaauuggagccaucgcacuggauuuuaagccuggcaccagcgguucgccgauaaucaaucgggaggggaaagucgugggacuuuacggcaacggcguugugacuaagaaugggggauaugucucagguauugcucaaaccaacgccgagccagacggccccacaccugaauuagaggaagagauguucaaaaagagaaaucugacgaucauggaucuccacccagggucuggaaaaacuaggaaguacuugcccgcuauugugcgugaagcaaucaagcgccggcugagaacccucauacuggccccuacaaggguaguggccgcugagauggaggaagcgcuuaaaggccugccgauucgauaucagaccacugcaacaaagagugagcauaccggucgggaaaucguugacuugaugugccacgccacguuuacuaugcgccuacugucccccgucagagugccaaacuacaaucucaucauuauggaugaggcucauuucacagacccugccagcaucgcagccaggggguacauaucuacccgggugggaaugggcgaagcugcggccauuuuuaugaccgcaacucccccaggcacagcugaugccuucccucagagcaacgcacccauccaggacgaggagcgagacauuccagaaagauccuggaauucagggaacgaguggaucaccgauuuugccggacgcacagucugguucguaccgaguauaaaagcugguaacgacauugccaauuguuuaaggaagaacggcaaaaaggugauccaacugagccguaagacuuuugauacggaauaucagaaaaccaagcuuaaugacugggauuucguugugacaacugacaucucugagaugggggcgaacuuuaaagcagaucgggucauugacccuagaaggugccugaagcccgugauccucaccgauggaccagagcgcguuauuuuggccggccccaugccugugacagcugccuccgcugcacagcgaagaggucgggucgggaggaauccacagaaagaaaacgaccaauacauauucaccggccagccccugaauaacgaugaggaccacgcccauuggacugaagcuaagaugcuccuggacaauaucaacacgccugagggaauuaucccggcccuuuucgaaccagagcgcgagaagucagcagcgaucgauggcgaauaucgucuaaaaggggagaguagaaagaccuuuguggaacugaugcggaggggagacuugcccguaugguuagcccacaaaguggcuagcgaggguauuaaguacacagaucgcaaauggugcuucgacggccagcgaaauaaccagauacuggaagagaauauggauguugagaucuggacuaaggaaggggagagaaaaaagcuccggccuagguggcuggacgcccgcaccuauuccgauccccuugcacugaaggaauuuaaagacuucgcugccggaagaaagucuauugcacucgauuuggucacagagaucggcagggugccaucgcaccuggcccaucggacccguaacgcucuagacaaucuggugaugcuccacacuagcgaacauggugggaaagcguaccgccacgccgucgaggagcuuccugaaacaauggagacgcuguuauugcugggccucaugauucugcuuaccggaggcgcaaugcuguuucucaucucagggaagggaauagguaaaacuuccaucggcuugauuuguguuaucgcuaguucugggaugcuguggauggccgaaauucccuuacaauggaucgccagcgcaauagugcuagaguucuuuaugaugguacugcucauuccagagccugaaaagcagcgaacaccgcaggauaaccaacuugcuuauguggucaucggaauucugaccuuggccgcgaucauagcugccaaugagaugggccugcucgaaaccacaaagagagaccuggguauguccaaagagcccggggugguuucaccaacuucuuaccuugauguggaccuccacccugcaagcgccuggacgcuguacgcugucgcaaccacaguaaucacucccauguugaggcauaccauugaaaacaguacagccaacgugucccuggcggcuaucgccaaucaggcaguuguguuaaugggccuagacaagggauggccaauuagcaaaauggaucugggcgucccucuccuugcccuggggugcuauucucaggugaaccccuugacccugacugcugccguccuccugcuuaucacgcacuacgcaauaauuggaccgggcuuacaggcuaaggccacacgggaggcgcaaaaacgcaccgccgcagguaucaugaagaauccaacuguggacgggaucaugaccauugaucuggacccuguuaucuaugauucaaaguucgagaaacagcucggacaggugauguugcugguacuaugugcugugcagcugcuccuuaugagaacauccugggcccugugcgaagcauugacucuggcuaccggccccauaacaacgcucugggaggguaguccaggcaaguuuuggaacaccacuauugccgucagcauggccaauaucuucagggggucguaccuggcgggagcuggcuuagcauuuucuauuaugaaauccguugggacaggaaagcggggcaccgguagccaaggggaaacucuuggagagaaauggaagaagaaacugaaccagcucucacgaaaggaauucgaccuauauaaaaagaguggcaucacagagguggauagaaccgaggccaaagaaggucugaagcgcggcgagauaacgcaucacgcugucucuaggggguccgccaaauugcagugguuuguggaacggaauaugguaauccccgagggacgugugauugaccugggcugugggagaggaggcuggagcuacuauugcgcaggucucaagaagguuaccgaagugaggggguacacaaaaggaggcccuggccaugaggagccgguccccaugucaacuuacggguggaacaucgugaagcuuaugaguggaaaagaugucuucuaucugccaccugaaaagugugacaccuugcugugcgauauuggugagagcucccccucuccuacaguggaagagagccgcacuauccggguucucaaaaugguagagccaugguuaaagaauaaccaguucuguauuaaggugcugaaucccuacaugccuaccgucaucgaacaccuugagcgacugcaaagaaaacacggcgggaugcuagugaggaacccacucucccgcaauucaacacaugaaauguauuggauaucuaacggaaccggcaauauuguugccagugugaacauggucucgcggcuguugcugaacagauuuacuaugacgcaccguaggcccacaaucgagaaggacguggaucucggugcugggacccggcauguaaaugcggaaccggagacuccuaacauggacgugaucggagagcgcauuaaacgaauaaaggaagagcacaauagcaccuggcacuacgacgaugaaaacccauauaaaacaugggccuaccauggcuccuaugagguuaaggcaacgggcucugcuucaagcaugaucaauggggucgugaagcuucugaccaaacccugggacguggucccuaugguuacucagauggccaugacagauaccacuccauucggacagcaaagaguguuuaaggaaaaaguagacacaaggaccccccgguccaugccggguacacgcagagugaugggcauuacugcagagugguuauggaggacccuggggcgaaacaagaaaccucgguugugcacgcgugaggaauucaccaagaaggucagaacaaaugccgcuaugggagccguguuuacugaggaaaaccagugggauagugcgaaagcagccguugaggacgaagauuucuggaagcucguggaccgcgagagggagcugcacaaacuaggcaagugugguucuugcgucuacaauaugauggggaaacgggaaaagaaacuuggagaguuuggcaaggcuaagggcagcagagccaucugguacauguggcugggggcacgcuaucucgaauucgaggcucugggauuuuugaacgaggaucauugguucucaagggaaaauuccuacagugguguggagggcgaagggcugcacaaacucggauauauucuucgagacaucagcaagauacccggcggugccauguacgcugaugacaccgccgggugggacacacggaucacugaggaugaccugcauaacgaagagaaaauuacccagcagauggauccagagcacagacaauuagcaaaugcgaucuuuaagcugacguaucagaacaaaguaguuaaggugcagaggccuacacccaccggaacugucauggacauuaucucucgcaaggaucagcguggcuccggccaaguggggacauacggauugaauaccuucacuaacauggaagugcagcucauacggcagauggagggugaaggcguccugucaaaagccgaccuagagaacccacaccuucccgaaaagaaaauuacccaguggcuggagacaaaggggguugagagacucaaaaggauggcuaucagcggagaugacugcgugguaaagccuaucgaugaccgcuuugccaaugcacuguuggcuuuaaacgauaugggcaaggugcgaaaagacauuccacaauggcagccgucgaaggguuggcaugauuggcagcagguccccuucuguucucaccauuuccacgaacugauaaugaaagacgggcggaagcucgugguuccuugcagaccacaagacgagcuuaucggaagggcccgcauuagucagggcgcaggcuggucccugagagaaacggccugucuagggaaagcguaugcucagauguggagccugauguacuuucaccggagggaucuccguuuggccucaaaugcaaucugcuccgccgugcccguccauugggugccuaccucucgaacuacauggagcauucacgcucaucaccaauggaugaccacugaggacaugcugacaguauggaaccgcguuuggaucgaagauaauccauggauggaggacaagacccccgugacgacaugggagaacgucccuuaccuuggaaagagagaagaucaguggugugguagucugauaggccucaccucccgggccacuugggcacagaauaucccgaccgcuauucaucaggugaggagcuuaaucgggaacgaggaauuccuggacuauaugccaucuaugaaacgcuuuagaaaggaggaggaauuggagggagccauuugguga

SEQ ID NO: 15425 - RNA, 9873 nt, Artificial Sequence
  derived and/or modified CDS sequence (opt3) from DENV-3__EU687198__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauugcugaaguugagccggaagacaucgauugcugguguaaccugacuaguaccugggugacauaugggaccugcaaucaggccggagagcaccgccgagacaagcguagcguagcacuugccccccaugugggcaugggucuggauacuagaacacaaaccuggauguccgcugagggggcauggaggcaggucgaaaaaguggagacgugggccuugcggcacccuggauucacuauucucgcucuguuucuggcccauuacaucggcaccucucucacacagaagguugugauauucaucuuacugaugcuugucacuccaucgaugaccaugcgcugugugggcguagggaacagagacuuuguugaaggauugucaggugcgacauggguggaugucgugcuggagcacggcgggugcgugaccacgauggcaaagaauaaacccacucuagacauugagcuccagaagacagaagccacccaacuggcuacucuuaggaaacuguguaucgagggaaagauuacaaacaucaccacggauagccggugcccuacccagggcgaagccgucuugccagaggaacaggaccagaauuauguuuguaaacacacauacguggaucgcgguugggggaacggaugcggccucuucggcaaggggagucugguaacuugcgcaaaguuucaauguuuagagcccauagagggaaaagugguccaguaugaaaaucugaaguacaccgugauuaucacaguucauacuggugaccagcaccaggugggcaacgagacccaaggggucacagcugaaauuaccccucaggccuccacuacggaggcgauccucccagaauauggaacacuuggccuggagugcucuccgcgaaccgguuuggacuucaaugagaugauccuacugacuaugaaaaacaaggccuggauggugcauagacagugguuuuucgaucucccccugccuuggaccagcggggcaacaaccgaaacuccaacauggaauaggaaagagcuucugguaacguuuaagaacgcucacgccaaaaagcaagaaguuguggucuugggcucccaggagggagcuaugcacaccgcccucacuggcgcaacagaaauucagaauucagggggaaccaguauauucgccggucaucugaagugucgguuaaaaauggacaagcuggagcuaaaaggcaugagcuacgcuaugugcacaaacacuuuugugcucaagaaagaggucucugaaacccagcacgggacgauccugauuaagguggaguacaagggagaagauguucccuguaaaaucccuuucuccaccgaggacggccaagguaaggcgcauaacgggcgucuuauaacagcaaauccagugguaacuaaaaaggaggaacccgucaacauugaggccgaaccgccuuucggcgagucaaauaucgugaucggaguuggcgauaacgcuuugaaaauuaauugguauaagaaggggagcaguaucggaaaaauguuugaagccaccgcacgcggugccagaaggauggcuauucugggcgacacagccugggauuucgggucugugggaggcguccucaacucccuggguaagauggugcaccagauauuugggagcgcauacacugcgcuuuucucgggcguaucuugggugaugaaaaucggaauuggcguucuguugaccuggaucgggcucaauuccaagaacacgucaaugaguuuuagcugcaucgcuauuggaauaaucacacuguauuuaggcgccgucgugcaggcagacaccgguugugugauuaauuggaaagggaaggagcugaagugcggauccggcaucuucgucacuaacgagguucauacauggaccgaacaguacaaauuucaagccgauucucccaagcggcuagcuacugccauugcaggugcuugggagaauggcgugugugggauccgaagcaccacacgcauggaaaaccuccuguggaaacagauagccaaugagcuuaacuauaucuugugggaaaauaacauuaagcugacggugguagucggagacaucauuggcgugcucgagcaggggaaaagaacccugacuccacagccuauggaguuaaaguacucauggaaaacauggggaaaggcgaagaucguuaccgccgaaacacaaaacaguuccuucauaauugauggccccaauacuccagagugccccagcgcuucuagggcauggaacgugugggaagucgaggacuaugguuuugggguguucaccacgaauaucuggcugaaacuucgggaaguuuacacacaguugugugaccaccgccucaugucagccgcugugaaggaugagagagccguacacgcagacaugggauacuggauugagagucagaaaaacggcagcuggaagcuggaaaaagcgucccuaaucgaggucaagaccugcacuuggccuaagucucauacccuguggucgaauggugugcucgaaagcgauaugauaaucccaaaaucccuggccggcccgauuucacagcacaacuauaggcccggguaccauacacaaacugcuggaccuuggcaccuuggcaaguuggagcuggacuuuaauuauugcgaggggaccacaguggucaucacggaaaacuguggaacccguggcccaaguuuacggacuacaaccguuucugguaaacucauucacgaguggugcugucgaagcugcacucugcccccucuuagauacaugggggaagauggauguugguauggcauggagaucaggccaauauccgaaaaggaggagaauauggugaaaucacugguaagcgccgguucuggcaagguggacaacuucacaaugggggucuugugccucgcaauucuguuugaagaggugaugcgcggaaaguucggcaaaaagcauaugaucgcugggguuuucuuuaccuucgugcuacugcucuccggacagaucacguggcgggauauggcccacacucugauuaugaucggcaguaaugcaagcgacagaauggguaugggggucaccuaccuugccuugauugcuacauuuaaaauacagcccuuccuggcguuaggauuuuuccucaggaagcugaccucucgcgaaaaccuucugcuaggcgugggccucgccauggcaacuacacugcaauugccggaggauaucgaacagauggcuaaugggauugcccugggauuaauggcccucaaacugaucacccaguuugagacauaucagcuuuggacugcucugauuuccuugaccuguucaaacacgaucuucacacucaccguugcauggcgaacugccacccugauacuagcgggugugagucugcuuccugucugccaaagcucguccaugcggaagucugacuggcucccaaugacaguagcugccaugggcgugcccccucugcccuuguuuaucuucagccugaaggauacuuuaaaacguagaucauggccacucaaugaggggguuauggcagugggacuggucaguauucuugccuccucucuguugaggaacgacgugccuauggcuggcccccucguagcaggugggcugcuaaucgccuguuacgugauuaccggaacgagcgcggaucugacagucgaaaaggcugccgacguuaccugggaggaagaggcagaacagacuggcgugucccauaaccuuaugaucacaguggacgaugacggcaccaugcgcauaaaagaugacgagacugagaauauucucacaguccuguugaagaccgccuuacugaucgugucagggaucuuuccauacagcauuccggcuacgcuccugguuuggcacacuuggcagaaacagacccggagaaguggaguacuuugggaugugccuucucccccagaaacacaaaaggccgagcuggaagagggugucuauaggauaaaacagcagggcaucuucgggaagacccaggugggaguuggcgugcaaaaggagggugucuuucauacaauguggcacgugacucgaggggcaguauugaccuacaacggaaaacgccuagaacccaauugggcuuccgucaagaaagaccugauuagcuauggcggcggguggcggcucucggcccaguggcagaagggagaggaagugcaaguuaucgcgguggagccugguaaaaacccaaagaauuuccagacgaugcccggcacauuccagacuaccacaggggaaauuggagccaucgcacuggauuuuaagccuggcaccucagguucuccgauaaucaacagagaggggaaagucgugggacuuuacggcaauggcguugugacuaagaacgggggauaugucagugguauugcucagaccaaugccgagccagacggccccacaccugaauuagaggaagagauguucaaaaagaggaaccugacgaucauggaucuccacccaggguccggaaaaacucguaaguacuugcccgcuauugugcgcgaagcaaucaagcggagacugaggacccucauacuggccccuacacgaguaguggccgcugagauggaggaagcgcuuaaaggccugccgauucgguaucaaaccacugcaacaaagagcgagcauaccggucgcgaaaucguugacuugaugugccacgccacguuuacuaugagacuacugucucccgucagggugccaaauuacaaccucaucauuauggaugaggcucauuucacagacccugccagcaucgcagcccggggguacauauccacccgagugggaaugggcgaagcugcggccauuuuuaugaccgcaacucccccaggcacagcugaugccuucccucagucaaaugcacccauccaggacgaggagagagacauuccagaacgcaguuggaacagcgggaaugaguggaucaccgauuuugccggaaaaacagucugguucguaccgucuauaaaggcugguaacgacauugccaacuguuuaaggaaaaauggcaagaaggugauccagcugucccguaaaacuuuugauacggaauaucaaaagacccggcuuaacgacugggauuucguugugacaacugacaucucagagaugggggcgaauuuuaaagcagauagagucauugacccuaggcgcugccugaagcccgugauccucaccgauggaccagagcgaguuauuuuggccggccccaugccugugacagcugccagugcugcacagagacgggguagggucgggcgcaacccacagaaagaaaaugaccaguacauauucaccggccaaccccugaacaaugaugaggaccacgcccauuggacugaagcuaagaugcuccuggacaacaucaauacgccugagggaauuaucccggcccuuuucgaaccagagcgugagaagagcgcagcgaucgauggcgaauauagacuaaaaggggagucccggaagaccuuuguggaacugaugaggcgcggagacuugcccguaugguuagcccacaaaguggcuucugaggguauuaaguacacagaucgaaaauggugcuucgacggccagagaaacaaucagauacuggaagagaacauggauguugagaucuggacuaaggaaggggagaaaaagaagcuccggccuagguggcuggacgcccgcaccuauucggauccccuugcacugaaagaauuuaaggacuucgcugccggaagaaaaagcauugcacucgauuuggucacagagaucggcagggugccaucacaccuggcccaucggacccguaaugcucuagacaaccuggugaugcuccacacuuccgaacauggugggaaggcguaccgccacgccgucgaggagcuuccugaaacaauggagacgcuguuauugcugggccucaugauucugcuuaccggaggcgcaaugcuguuucucaucagugggaaaggaauagguaagacuucuaucggcuugauuuguguuaucgcuagcuccgggaugcuguggauggccgaaauucccuuacaguggaucgccucagcaauagugcuagaguucuuuaugaugguacugcucauuccagagccugaaaagcaacgaacaccgcaggauaaucagcuugcuuauguggucaucggaauucugaccuuggccgcgaucauagcugccaacgagaugggccugcucgaaaccacaaaaagagaccuggguaugucuaaggagcccggggugguuagcccaacuaguuaccuugauguggaccuccacccugcauccgccuggacgcuguacgcugucgcaaccacaguaaucacucccauguugaggcauaccauugaaaauagcacagccaacgugucucuggcggcuaucgccaaccaagcaguuguguuaaugggccuagacaaaggauggccaauuucaaagauggaucugggcgucccucuccuugcccuggggugcuauucccaggugaaucccuugacccugacugcugccguccuccugcuuaucacgcacuacgcaauaauuggaccgggcuuacaggcuaaagccacacgggaggcgcagaagcgcaccgccgcagguaucaugaagaacccaacuguggacgggaucaugaccauugaucuggacccuguuaucuaugauaguaaauucgagaagcaacucggacaggugauguugcugguacuaugugcugugcagcugcuccuuaugagaacaagcugggcccugugcgaagcauugacucuggcuaccggccccauaacaacgcucugggaggguucgccaggcaaauuuuggaauaccacuauugccgucucuauggccaacaucuucaggggguccuaccuggcgggagcuggcuuagcauuuagcauuaugaagucaguugggacaggaaaacggggcaccgguagucagggggaaacucuuggagagaaguggaagaaaaagcugaaucaacucucucgaaaagaauucgaccuauauaagaaauccggcaucacagagguggauagaaccgaggccaaggaaggucugaaacgcggcgagauaacgcaucacgcugucagcagggggucagccaaguugcagugguuuguggaacggaacaugguaauccccgagggacgugugauugaccugggcugugggagaggaggcuggaguuacuauugcgcaggucucaagaaaguuaccgaagugaggggguacacaaagggaggcccuggccaugaggagccgguccccaugagcacuuacggguggaauaucgugaaacuuauguccggaaaggaugucuucuaucugccaccugaaaaaugugacaccuugcugugcgauauuggugagucuagccccuccccuacaguggaagagucacgcacuauccggguucucaagaugguagagccaugguuaaagaacaaucaguucuguauuaaagugcugaaccccuacaugccuaccgucaucgaacaccuugagcgacugcagagaaagcacggcgggaugcuagugaggaauccacucucucgcaacaguacacaugaaauguauuggauaucgaauggaaccggcaacauuguugccagcgugaauauggucucccggcuguugcugaacagauuuacuaugacgcaccguaggcccacaaucgagaaagacguggaucucggugcugggacccggcauguaaacgcggaaccggagacuccuaauauggacgugaucggagagcgcauuaagcgaauaaaagaagagcacaacucuaccuggcacuacgacgaugaaaauccauauaagacaugggccuaccauggcucauaugagguuaaggcaacgggcagcgcuuccaguaugaucaacggggucgugaaacuucugaccaagcccugggacguggucccuaugguuacucaaauggccaugacagauaccacuccauucggacagcagagaguguuuaaagaaaagguagacacaaggaccccccggucuaugccggguacacgcagagugaugggcauuacugcagagugguuauggaggacccuggggcgaaauaaaaagccucgguugugcacgcgugaggaauucaccaagaaagucagaacaaacgccgcuaugggagccguguuuacugaggaaaaucaaugggauagcgcgaaggcagccguugaggacgaagauuucuggaaacucguggaccgcgagagggagcugcacaagcuaggcaaaugugguucaugcgucuacaacaugauggggaagcgggaaaaaaagcuuggagaguuuggcaaggcuaaaggcuccagagccaucugguacauguggcugggggcacgcuaucucgaauucgaggcucugggauuuuugaaugaggaucauugguucaguagggaaaacagcuacucugguguggagggcgaagggcugcacaagcucggauauauucuucgagacaucuccaaaauacccggcggugccauguacgcugaugacaccgccgggugggacacacggaucacugaggaugaccugcauaaugaagagaagauuacccagcagauggauccagagcacagacaguuagcaaacgcgaucuuuaaacugacguaucaaaauaagguaguuaaggugcagaggccuacacccaccggaacugucauggacauuaucucacgcaaagaucagcguggcagcggccagguggggacauacggauugaacaccuucacuaauauggaagcccaacucauacggcagauggagggugaaggcgugcugucgaaggcugaccuagagaacccacaccuuucugaaaaaaagauuacccaguggcuggagacaaaaggggucgagagacucaagaggauggccaucaguggagaugacugcguugugaagcccaucgaugaccgcuuugcaaacgcucuguuggccuuaaaugauaugggcaaaguacgaaaggacauuccucaguggcaaccauccaaagguuggcaugauuggcagcaggugccguucuguagccaccauuuccacgaacugauaaugaaggacgggcggaaacucgucgugcccugcagaccucaggacgagcuuaucggaagggcacgcauuucacaaggcgccggcuggucccugagagaaacggcgugucuagggaaggcuuaugcccagauguggucucugauguacuuucaccggagggaucuccguuuggcaagcaacgccaucugcagugcuguuccagugcauuggguccccaccucccgaacuacauggagcauucacgcccaucaccaguggaugaccacugaggacaugcugacaguguggaaucgcguauggaucgaagauaacccuuggauggaggacaagaccccaguuacgacaugggagaaugugcccuaccuuggaaaaagagaagaucaauggugugguucucugauaggccucaccucacgggcaacuugggcucagaacaucccuaccgccauucagcaggucaggaguuuaaucgggaaugaggaauuccuggacuauaugccguccaugaagcgcuuuagaaaagaggaggaaagcgagggagcgauuugguga

SEQ ID NO: 15426 - RNA, 9873 nt, Artificial Sequence
  derived and/or modified CDS sequence (opt3) from DENV-3__EU726769__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauuguuauaggaaucauuacccuguauuuaggcgcggucgugcaggcugacauggguugugugaucaauuggaaagggaaggagcugaagugcggauccggcauuuucgucacuaacgagguucauacauggaccgaacaguacaaauuucaagccgauucucccaagcggcuagcaacugccaucgcuggugccugggagaauggcgugugugggauacgaagcaccacacgcauggaaaaccuccuguggaaacagaucgcaaaugagcuuaacuauauuuugugggaaaauaacaucaagcugacggugguagucggagacauuaucggcgugcucgagcaggggaaaagaacccugacuccacagccuauggaguuaaaguacucauggaaaacauggggaaaggcuaagauaguuaccgccgaaacacaaaacaguuccuucauuaucgauggccccaauacuccagagugccccagcgcgucuagggccuggaacgugugggaagucgaggacuaugguuuugggguguucaccacgaauauuuggcugaaacuucgggaaguuuacacacaguugugugaccaccgccucaugucagcugcagugaaggaugagagagccguacacgcugacaugggauacuggaucgagagucagaaaaacggcagcuggaagcuggaaaaagccucccuaauagaggucaagaccugcacuuggccuaagucucauacccuguggucgaauggugugcucgaaagcgauaugaucauuccaaaaucccuggcaggcccgaucucacagcacaacuauaggcccggguaccauacacaaacugcgggaccuuggcaccuuggcaaguuggagcuggacuuuaauuauugcgaggggaccacaguggucauuacggaaaacuguggaacccguggcccaaguuuacggacuacaaccguuucugguaaacucauccacgaguggugcugucgaagcugcacucugcccccucuuagauacaugggggaagauggauguugguauggcauggagauaaggccaauuuccgaaaaggaggagaauauggugaaaucacugguaagcgccgguucuggcaagguggacaacuucacaaugggggucuugugccucgcuauccuguuugaagaggugaugcgcggaaaguucggcaaaaagcauaugguugccgggguguucuuuaccuucguccuacugcucuccggacagaucacguggcgggauauggcacacacucugauuauggugggcaguaaugcuagcgacagaauggguauggggguuaccuaccuugccuugaucgcaacauuuaaaauucagcccuuccuggccuuaggauuuuuccucaggaagcugaccucucgcgaaaaccuucugcuaggcgugggccucgcuauggcgacuacacugcaauugccggaggauauagaacagauggccaaugggaucgcacugggauuaauggcucucaaacugauuacccaguuugagacauaucagcuuuggacugcccugaucuccuugaccuguucaaacacgauuuucacacucaccgucgccuggcgaacugcuacccugauccuagcagguguaagucugcuuccugugugccaaagcucguccaugcggaagacagacuggcucccaaugacuguugccgcgaugggcgugcccccucugcccuuguuuauauucucucugaaggauaccuuaaaacguagaagcuggccacucaaugagggggucauggcugugggacugguaucaauccuugccaguucccuguugaggaacgacgugccuauggcaggcccccucgucgccggugggcugcuaauugcuuguuacguuaucacgggaacaucugcagaucugaccguggaaaaggccgcggacgugacuugggaggaagaggcugaacagacaggcgucagccauaaccuuaugauuaccguggacgaugacggcacuaugcgcaucaaagaugacgagacagagaauauacucaccguucuguugaagacggccuuacugauuguauccgggaucuuuccauacucaaucccggcaacucuccugguguggcacaccuggcagaaacagacacaacggagcggaguccuuugggaugugccuagucccccagaaacccagaaggccgagcuggaagaggguguuuauagaauuaaacagcagggcauauucgggaagacacaagugggagucggcgugcagaaggaggguguauuucauacuauguggcacgucaccaggggggcuguguugacguacaacggaaaacgacuagaacccaauugggccucuguuaagaaagaccugaucuccuauggcggcggguggcgccucagcgcacaguggcaaaagggagaggaagugcaggucauugcuguggagccugguaaaaacccaaagaauuuccagacaaugcccggcacuuuccagaccacaaccggggaaaucggagccauugcgcuggauuuuaagccuggcacuucggguucaccgaucauaaaccgggaggggaaaguugugggacuuuacggcaauggcgucgugaccaagaacgggggauauguaucugguaucgcccaaacaaaugcagagccagacggccccacgccugaauuagaggaagagauguucaaaaagagaaaccugacuauuauggaucuccacccagggaguggaaaaaccaggaaguacuugcccgcuaucgugcgugaagccauuaagcgccggcugagaacacucauccuggcuccuaccaggguugucgcagccgagauggaggaagcccuuaaaggccugccgauacgauaucagacuacagcuaccaaguccgagcauacgggucgggaaauuguggacuugaugugccacgcgacuuuuacaaugcgccuacugagccccgugagagucccaaauuacaaccucaucaucauggaugaggcacauuucaccgacccugccucuauugcugccaggggguacaucagcacccggguaggaaugggcgaagcagccgcuauauuuaugacugcgacacccccaggcaccgccgaugcauucccucaguccaaugcucccauucaggacgaggagcgagacaucccagaaagaucauggaacagugggaaugaguggauuacagauuuugccggaaaaacugugugguucguuccgagcaucaaggcagguaacgacauagccaacuguuuacgcaaaaauggcaagaaggugauucaacugucuaggaaaacguuugauaccgaauaucagaagacaaaacuuaacgacugggauuucgucgugacuaccgacaucuccgagaugggggcuaauuuuaaggccgaucguguuaucgacccucggagaugccugaaacccgugauucucacagauggaccagagagggucaucuuggcgggccccaugccugugaccgcagccucagcugcccagcgccgagguagaguagggcggaacccacagaaggaaaaugaccaauacauuuucacuggccagccccugaacaaugaugaggaccacgcucauuggacggaagcaaagaugcuccuggacaacauaaauaccccugagggaaucauuccggcccuuuucgaaccagagagggagaaaagugcugccaucgauggcgaauaucgccuaaagggggagagccguaaaacauuuguggaacugaugagacggggagacuugcccguuugguuagcacacaaggucgcguccgaggguaucaaauacacugauaggaaguggugcuucgacggccagcgcaacaaucagauucuggaagagaacauggauguggagauauggaccaaagaaggggagaagaagaaacuccgaccuagauggcuggacgcccggacauauucugauccccuugcucugaaggaauuuaaagacuucgccgcaggaaggaagucgaucgcucucgauuuggugaccgagauuggccgcgucccaagccaccuggcccauagaacuaggaaugcacuagacaaccugguuaugcuccacacaucagaacauggugggaaagccuaccggcacgcuguggaggagcuuccugaaacgauggagacccuguuauugcugggccucaugauccugcuuacuggaggcgcgaugcuguuucucauuuccgggaagggaaucgguaagacaaguauaggcuugaucuguguaauugccucuagcgggaugcuguggaucgcagaaauucccuuacaauggaucgcuuccgccauagugcuagaguucuuuaugaugguccugcucauuccagagccugaaaaacagcguaccccgcaggauaaucaacuugccuaugugguuaucggaauucugaccuuggcagcuaucauagccgcgaacgagaugggccugcucgaaacaacuaagcgcgaccuggguaugucaaaagagcccgggguggucucuccaacgagcuaccuugauguagaccuccacccugcuagugccuggacccuguacgcaguggccacaacuguuaucacccccauguugcgacauacaauugaaaauuccaccgcuaacgugagccuggcagccaucgcgaaccaggcugucguguuaaugggccuagacaagggauggccaauuucuaaaauggaucugggcgucccucuccuugcccuggggugcuauucacaggugaaucccuugacucugacggcagccguucuccugcuuaucacacacuacgcuauaauuggaccgggcuuacaggccaaggcaaccagagaggcucaaaagaggacugccgcggguaucaugaaaaacccaaccguggacgggaucaugacaauugaucuggacccuguaaucuaugauuccaaguucgagaaacagcucggacaggugauguugcugguccuaugugccguucagcugcuccuuaugcggacuaguugggcacugugcgaagcuuugacccuggccacaggccccauaacgacccucugggaggguagcccaggcaaguuuuggaauacuacaauugcagugucgauggcuaacaucuuccgcgggucuuaccuggccggagccggcuuagcguuuuccauuaugaaaagcgucgggaccggaaagagaggcacugguucacaaggggaaacacuuggagagaaguggaaaaagaaacugaaucagcucaguaggaaggaauucgaccuauauaaaaagucuggcaucaccgagguggaucggacggaggcuaaagaaggucugaagcgaggcgagauaacccaucacgcaguauccagagggagcgccaaguugcagugguuuguggaacgcaacaugguuauccccgagggaagggugauugaccugggcugugggcggggaggcuggucauacuauugcgcuggucucaaaaaggucacagaagugcguggguacacuaaaggaggcccuggccaugaggagccgguccccaugaguaccuacggguggaauaucgugaagcuuaugagcggaaaagauguuuucuaucugccaccugaaaagugugacacauugcugugcgauauuggugaguccucucccagcccuacuguagaagaguccagaaccaucagggugcucaagauggucgagccaugguuaaaaaacaaucaguucuguauuaaggugcugaaccccuacaugccuacaguuaucgaacaccuugagcgccugcaacggaaacacggcgggaugcuagugcgaaauccacucucaagaaacucuacccaugaaauguauuggauaaguaauggaacuggcaacauugucgccucggugaauaugguaagcaggcuguugcugaaccgcuuuacgaugacauaccggagacccaccaucgagaaggacguggaucucggugcagggacucgucacguuaacgccgaaccggagaccccuaauauggacgucaucggagagaggauuaaacggauaaaggaagagcauaacuccacauggcacuaugacgaugaaaauccauacaagacgugggcuuaucacggcucuuacgaggugaaagcgaccggcucagccagcuccaugaucaacgggguggucaagcuucugacuaaacccugggacguugugccuaugguaacacagauggcaaugaccgauacuacaccauucggacagcaacgcguguuuaaggaaaaagucgacacccgaacacccagaaguaugccggguacuaggcgggugaugggcauuaccgcugagugguuauggcgcacgcuggggagaaauaagaagccuagguugugcacccgagaggaauucacaaaaaagguucggacuaacgccgcaaugggagccguguuuaccgaggaaaaucagugggauucugcuaaagccgcggucgaggacgaagauuucuggauccucguggaccgugagagagagcugcauaagguaggcaaaugugguagcugcguuuacaacaugauggggaagcgcgaaaaaaagcuaggagaguuuggcaaggcaaaaggcucaagggccauuugguauauguggcuuggggcucgguaccuggaauucgaggcccucggauuucugaaugaggaucacugguucuccagagaaaacaguuauagcgguguggagggcgaaggguugcauaagcugggauacauccuccgcgacauaucuaaaauccccggcggugcaauguaugcugaugacacagccgggugggacacuaggauuaccgaggaugaccuucacaaugaagagaagaucacgcagcagauggauccagagcaucgacaacuggcuaacgccauuuuuaaauuaacauaccagaauaaggucgugaaggugcagcggccuacccccacuggaacagucauggacaucauauccagaaaagaucagaggggcucaggccaaguugggaccuauggacugaacacuuucaccaauauggaagcacaguugauucgccagauggagggugaaggcgugcucagcaaggcggaccuggagaacccacaccuacccgaaaaaaagaucacacaguggcuugagacgaaagggguagagcgucugaagcggauggccaucucgggagaugacugcguggucaagccuauugaugacagauuugcuaacgcccuccuggcauugaaugauaugggcaaagugaggaaggacauaccacaauggcagccgucuaaagguuggcacgauuggcagcagguucccuucuguagucaucacuuccaugaauuaaucaugaaggacgggcgcaaacugguggucccuugccgaccacaagacgagcucauuggacgggcuagaaucucccagggcgccggcuggagccuuagggaaaccgcaugucuggggaaggccuacgcgcagauguggucacuaauguacuuucaccgcagagaucugcggcucgcuuccaacgccauuugcucugcagugcccguacacuggguuccuacuagcaggacaaccuggaguauccaugcccaccaucaauggaugacuacagaggacauguugaccguguggaaucgugucuggauagaagauaacccauggauggaggacaagacgcccgugacaaccugggagaauguuccuuaucugggaaaacgagaagaucaguggugugguucccuuaucggccugacuagccgcgcuaccugggcccagaacauuccgacagcaauccagcaagugagaucucucauugggaaugaggaauucuuagacuacaugccaucaaugaagcgguuuaggaaagaggaggaaagugagggagcuaucugguga

SEQ ID NO: 15427 - RNA, 9873 nt, Artificial Sequence
  derived and/or modified CDS sequence (opt3) from DENV-3__EU687239__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauugcugaaguugagccggaagacaucgauugcugguguaaccugacuaguaccugggugacauaugggaccugcaaucaggccggagagcaccgccgagacaagcguagcguagcacuugccccccaugugggcaugggucuggauacuagaacacaaaccuggauguccgcugagggggcauggaggcaggucgaaaaaguggagacgugggccuugcggcacccuggauucacuauucucgcucuguuucuggcccauuacaucggcaccucucucacacagaagguugugauauucaucuuacugaugcuugucacuccaucgaugaccaugcgcugugugggcguagggaacagagacuuuguugaaggauugucaggugcgacauggguggaugucgugcuggagcacggcgggugcgugaccacgauggcaaagaauaaacccacucuagacauugagcuccagaagacagaagccacccaacuggcuacucuuaggaaacuguguaucgagggaaagauuacaaacaucaccacggauagccggugcccuacccagggcgaagccgucuugccagaggaacaggaccagaauuauguuuguaaacacacauacguggaucgcgguugggggaacggaugcggccucuucggcaaggggagucugguaacuugcgcaaaguuucaauguuuagagcccauagagggaaaagugguccaguaugaaaaucugaaguacaccgugauuaucacaguucauacuggugaccagcaccaggugggcaacgagacccaaggggucacagcugaaauuaccccucaggccuccacuacggaggcgauccucccagaauauggaacacuuggccuggagugcucuccgcgaaccgguuuggacuucaaugagaugauccuacugacuaugaaaaacaaggccuggauggugcauagacagugguuuuucgaucucccccugccuuggaccagcggggcaacaaccgaaacuccaacauggaauaggaaagagcuucugguaacguuuaagaacgcucacgccaaaaagcaagaaguuguggucuugggcucccaggagggagcuaugcacaccgcccucacuggcgcaacagaaauucagaauucagggggaaccaguauauucgccggucaucugaagugucgguuaaaaauggacaagcuggagcuaaaaggcaugagcuacgcuaugugcacaaacacuuuugugcucaagaaagaggucucugaaacccagcacgggacgauccugauuaagguggaguacaagggagaagauguucccuguaaaaucccuuucuccaccgaggacggccaagguaaggcgcauaacgggcgucuuauaacagcaaauccagugguaacuaaaaaggaggaacccgucaacauugaggccgaaccgccuuucggcgagucaaauaucgugaucggaguuggcgauaacgcuuugaaaauuaauugguauaagaaggggagcaguaucggaaaaauguuugaagccaccgcacgcggugccagaaggauggcuauucugggcgacacagccugggauuucgggucugugggaggcguccucaacucccuggguaagauggugcaccagauauuugggagcgcauacacugcgcuuuucucgggcguaucuugggugaugaaaaucggaauuggcguucuguugaccuggaucgggcucaauuccaagaacacgucaaugaguuuuagcugcaucgcuauuggaauaaucacacuguauuuaggcgccgucgugcaggcagacaccgguugugugauuaauuggaaagggaaggagcugaagugcggauccggcaucuucgucacuaacgagguucauacauggaccgaacaguacaaauuucaagccgauucucccaagcggcuagcuacugccauugcaggugcuugggagaauggcgugugugggauccgaagcaccacacgcauggaaaaccuccuguggaaacagauagccaaugagcuuaacuauaucuugugggaaaauaacauuaagcugacggugguagucggagacaucauuggcgugcucgagcaggggaaaagaacccugacuccacagccuauggaguuaaaguacucauggaaaacauggggaaaggcgaagaucguuaccgccgaaacacaaaacaguuccuucauaauugauggccccaauacuccagagugccccagcgcuucuagggcauggaacgugugggaagucgaggacuaugguuuugggguguucaccacgaauaucuggcugaaacuucgggaaguuuacacacaguugugugaccaccgccucaugucagccgcugugaaggaugagagagccguacacgcagacaugggauacuggauugagagucagaaaaacggcagcuggaagcuggaaaaagcgucccuaaucgaggucaagaccugcacuuggccuaagucucauacccuguggucgaauggugugcucgaaagcgauaugauaaucccaaaaucccuggccggcccgauuucacagcacaacuauaggcccggguaccauacacaaacugcuggaccuuggcaccuuggcaaguuggagcuggacuuuaauuauugcgaggggaccacaguggucaucacggaaaacuguggaacccguggcccaaguuuacggacuacaaccguuucugguaaacucauucacgaguggugcugucgaagcugcacucugcccccucuuagauacaugggggaagauggauguugguauggcauggagaucaggccaauauccgaaaaggaggagaauauggugaaaucacugguaagcgccgguucuggcaagguggacaacuucacaaugggggucuugugccucgcaauucuguuugaagaggugaugcgcggaaaguucggcaaaaagcauaugaucgcugggguuuucuuuaccuucgugcuacugcucuccggacagaucacguggcgggauauggcccacacucugauuaugaucggcaguaaugcaagcgacagaauggguaugggggucaccuaccuugccuugauugcuacauuuaaaauacagcccuuccuggcguuaggauuuuuccucaggaagcugaccucucgcgaaaaccuucugcuaggcgugggccucgccauggcaacuacacugcaauugccggaggauaucgaacagauggcuaaugggauugcccugggauuaauggcccucaaacugaucacccaguuugagacauaucagcuuuggacugcucugauuuccuugaccuguucaaacacgaucuucacacucaccguugcauggcgaacugccacccugauacuagcgggugugagucugcuuccugucugccaaagcucguccaugcggaagucugacuggcucccaaugacaguagcugccaugggcgugcccccucugcccuuguuuaucuucagccugaaggauacuuuaaaacguagaucauggccacucaaugaggggguuauggcagugggacuggucaguauucuugccuccucucuguugaggaacgacgugccuauggcuggcccccucguagcaggugggcugcuaaucgccuguuacgugauuaccggaacgagcgcggaucugacagucgaaaaggcugccgacguuaccugggaggaagaggcagaacagacuggcgugucccauaaccuuaugaucacaguggacgaugacggcaccaugcgcauaaaagaugacgagacugagaauauucucacaguccuguugaagaccgccuuacugaucgugucagggaucuuuccauacagcauuccggcuacgcuccugguuuggcacacuuggcagaaacagacccggagaaguggaguacuuugggaugugccuucucccccagaaacacaaaaggccgagcuggaagagggugucuauaggauaaaacagcagggcaucuucgggaagacccaggugggaguuggcgugcaaaaggagggugucuuucauacaauguggcacgugacucgaggggcaguauugaccuacaacggaaaacgccuagaacccaauugggcuuccgucaagaaagaccugauuagcuauggcggcggguggcggcucucggcccaguggcagaagggagaggaagugcaaguuaucgcgguggagccugguaaaaacccaaagaauuuccagacgaugcccggcacauuccagacuaccacaggggaaauuggagccgucgcacuggauuuuaagccuggcaccucagguucuccgaucauaaacagagaggggaaagugguuggacuuuacggcaauggcguggucacuaagaacgggggauaugugagugguaucgcucagaccaaugccgagccagacggccccacaccugaauuagaggaagagauguucaaaaagaggaaccugacgauuauggaucuccacccaggguccggaaaaacucguaaguacuugcccgcuaucguacgcgaagcaauuaagcggagacugaggacccucauccuggccccuacacgagugguugccgcugagauggaggaagcgcuuaaaggccugccgauacgguaucaaaccacugcaacaaagagcgagcauaccggucgcgaaauugucgacuugaugugccacgccacguuuacuaugagacuacugucucccgugagggugccaaauuacaaccucaucaucauggaugaggcucauuucacagacccugccagcauugcagcccggggguacaucuccacccgagucggaaugggcgaagcugcggccauauuuaugaccgcaacucccccaggcacagcugaugccuucccucagucaaaugcacccauucaggacgaggagagagacaucccagaacgcaguuggaacagcgggaaugaguggauuaccgauuuugccggaaaaacaguaugguucgugccgucuaucaaggcugguaacgacauagccaacuguuuaaggaaaaauggcaagaagguuauucagcugucccguaaaacuuuugauacggaauaucaaaagaccaaacuuaacgacugggauuucguggucacaacugacaucucagagaugggggcgaauuuuaaggcagaucgggugaucgacccuagaaggugccugaaacccguuauucucaccgauggaccagagcgcgugaucuuggccggccccaugccugucacagcugccagugcugcacagcgaagaggucggguggggaggaacccacagaaggaaaaugaccaguacauuuucaccggccaaccccugaacaaugaugaggaccacgcccauuggacugaagcuaagaugcuccuggacaacauaaauacgccugagggaaucauuccggcccuuuucgaaccagagcgcgagaaaagcgcagcgaucgauggcgaauaucgucuaaagggggaguccagaaaaaccuuuguagaacugaugcggaggggagacuugcccgugugguuagcccacaagguugcuucugaggguaucaaauacacagaucgcaaguggugcuucgacggccagcgaaacaaucagauucuggaagagaacauggaugucgagauauggacuaaagaaggggagaagaagaaacucagaccucgguggcuggacgccaggaccuauucggauccccuugcacugaaggaauuuaaagacuucgcugccggacgcaagagcaucgcacucgauuuggugacagagauuggcagagugccaucacaccuggcccauaggacccggaaugcucuagacaaccuggucaugcuccacacuuccgaacauggugggaaagcguaccgucacgccguugaggagcuuccugaaacaauggagacgcuguuauugcugggccucaugauccugcuuaccggaggcgcaaugcuguuucucauuagugggaagggaaucgguaagacuucuauaggcuugaucugugugauugcuagcuccgggaugcuguggauggccgaaauccccuuacaguggauugccucagcaaucguacuagaguucuuuaugauggugcugcucauaccagagccugaaaaacaacgcacaccgcaggauaaucagcuugcuuaugucgugauuggaauccugaccuuggccgcgauuaucgcugccaacgagaugggccugcucgaaaccacaaagcgagaccuggguaugucuaaagagcccgggguugugagcccaacuaguuaccuugaugucgaccuccacccugcauccgccuggacgcuguacgcuguagcaaccacagugauaacucccauguugagacauaccaucgaaaauagcacagccaacguuucucuggcggcuauugccaaccaagcaguggucuuaaugggccuagacaagggauggccaaucucaaaaauggaucugggcgugccucuccuugcccuggggugcuauucccaggucaaucccuugacccugacugcugccgugcuccugcuuauuacgcacuacgcaaucauaggaccgggcuuacaggcuaaggccacaagggaggcgcagaagcggaccgccgcagguauuaugaaaaacccaacuguugacgggaucaugaccaucgaucuggacccugugauuuaugauaguaaguucgagaaacaacucggacagguaauguugcuggugcuaugugcuguccagcugcuccuuaugcgcacaagcugggcccugugcgaagcauugacucuggcuaccggccccaucacaacgcucugggaggguucgccaggcaaguuuuggaauaccacuauagccguuucuauggccaacauuuucagaggguccuaccuggcgggagcuggcuuagcauuuagcaucaugaaaucaguggggacaggaaagaggggcaccgguagucagggggaaacucuuggagagaaguggaaaaagaaacugaaucaacucucucggaaggaauucgaccuauauaaaaaguccggcauuacagaggucgaucgaaccgaggccaaagaaggucugaagagaggcgagaucacgcaucacgcugugagccgcgggucagccaaguugcagugguuuguagaaaggaacauggugauacccgagggacggguuaucgaccugggcugugggcguggaggcuggaguuacuauugcgcaggucucaaaaaggugaccgaagucagaggguacacaaaaggaggcccuggccaugaggagccggugcccaugagcacuuacggguggaauauugucaagcuuauguccggaaaagauguguucuaucugccaccugaaaagugugacaccuugcugugcgauaucggugagucuagccccuccccuacaguugaagagucaaggacuauucgcguacucaagaugguggagccaugguuaaaaaacaaucaguucuguaucaagguccugaaccccuacaugccuaccgugauugaacaccuugagcggcugcagcgaaaacacggcgggaugcuaguuagaaauccacucucuaggaacaguacacaugaaauguauuggaucucgaauggaaccggcaacauaguggccagcgucaauauggugucccgccuguugcugaaccgguuuacuaugacgcacagacgucccacaauugagaaggacguagaucucggugcugggaccaggcaugugaacgcggaaccggagacuccuaauauggacguuaucggagagcggaucaaacgcauuaaggaagagcacaacucuaccuggcacuacgacgaugaaaauccauauaagacaugggccuaccauggcucauaugaggucaaagcaacgggcagcgcuuccaguaugauaaacgggguggugaagcuucugaccaaacccugggacgucguuccuauggugacucaaauggccaugacagauaccacuccauucggacagcagcgaguauuuaaggaaaaaguggacacaagaacccccaggucuaugccggguacacggcgcgucaugggcaucacugcagagugguuauggagaacccuggggaggaauaagaagccucgauugugcacgcgggaggaauucaccaaaaaggugcguacaaacgccgcuaugggagccguuuuuacugaggaaaaucaaugggauagcgcgaaagcagccguggaggacgaagauuucuggaagcucgucgacagagagcgcgagcugcacaaacuaggcaagugugguucaugcguguacaacaugauggggaaaagggaaaagaagcuuggagaguuuggcaaagcuaagggcucccgggccauuugguacauguggcugggggcaagauaucucgaauucgaggcucugggauuuuugaaugaggaucauugguucagucgcgaaaacagcuacucugguguagagggcgaagggcugcacaaacucggauauauccuuagggacauuuccaagauccccggcggugccauguacgcugaugacaccgccgggugggacacacgaauaacugaggaugaccugcauaaugaagagaaaaucacccagcagauggauccagagcaccggcaguuagcaaacgcgauuuuuaagcugacguaucaaaauaagguugugaaaguccagagaccuacacccaccggaacugugauggacaucauuucaaggaaggaucagcgcggcagcggccagguggggacauacggauugaacaccuucacuaauauggaagcccaacucauccgucagauggagggugaaggcguccugucgaaagcugaccuagagaacccacaccuuucugaaaagaaaauaacccaguggcuggagacaaaggggguugagcggcucaagagaauggccauuaguggagaugacugcgugguaaaacccaucgaugacagguuugcaaacgcucuguuggccuuaaaugauaugggcaaggugcgcaaagacaucccucaguggcaaccauccaaggguuggcaugauuggcagcaggucccguucuguagccaccauuuccacgaacugauuaugaaagacgggcgaaagcucgugguucccugccggccucaggacgagcuuauaggaagagcaaggaucucacaaggcgccggcuggucccugcgcgaaacggcgugucuagggaaggcuuaugcccagauguggucucugauguacuuucacagacgggaucucagguuggcaagcaacgccauuugcagugcugugccaguccauugggugcccaccucccguacuacauggagcauccacgcccaucaccaguggaugaccacugaggacaugcugacaguauggaaucgaguuuggauugaagauaacccuuggauggaggacaaaaccccagugacgacaugggagaauguccccuaccuuggaaagcgcgaagaucaauggugugguucucugaucggccucaccucaagagcaacuugggcucagaacauaccuaccgccauccagcaggugcggaguuuaauugggaaugaggaauuccuggacuauaugccguccaugaaaagguuucgcaaggaggaggaaagcgagggaguuaucugguga

SEQ ID NO: 15428 - RNA, 9873 nt, Artificial Sequence
  derived and/or modified CDS sequence (opt3) from DENV-3__FJ182004__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauugcugaaguugagccggaagacaucgauugcugguguaaccugacuaguaccugggugacauaugggaccugcaaucaggccggagagcaccgccgagacaagcguagcguagcacuugccccccaugugggcaugggucuggauacuagaacacaaaccuggauguccgcugagggggcauggaggcaggucgaaaaaguggagacgugggccuugcggcacccuggauucacuauucucgcucuguuucuggcccauuacaucggcaccucucucacacagaagguugugauauucaucuuacugaugcuugucacuccaucgaugaccaugcgcugugugggcguagggaacagagacuuuguugaaggauugucaggugcgacauggguggaugucgugcuggagcacggcgggugcgugaccacgauggcaaagaauaaacccacucuagacauugagcuccagaagacagaagccacccaacuggcuacucuuaggaaacuguguaucgagggaaagauuacaaacaucaccacggauagccggugcccuacccagggcgaagccgucuugccagaggaacaggaccagaauuauguuuguaaacacacauacguggaucgcgguugggggaacggaugcggccucuucggcaaggggagucugguaacuugcgcaaaguuucaauguuuagagcccauagagggaaaagugguccaguaugaaaaucugaaguacaccgugauuaucacaguucauacuggugaccagcaccaggugggcaacgagacccaaggggucacagcugaaauuaccccucaggccuccacuacggaggcgauccucccagaauauggaacacuuggccuggagugcucuccgcgaaccgguuuggacuucaaugagaugauccuacugacuaugaaaaacaaggccuggauggugcauagacagugguuuuucgaucucccccugccuuggaccagcggggcaacaaccgaaacuccaacauggaauaggaaagagcuucugguaacguuuaagaacgcucacgccaaaaagcaagaaguuguggucuugggcucccaggagggagcuaugcacaccgcccucacuggcgcaacagaaauucagaauucagggggaaccaguauauucgccggucaucugaagugucgguuaaaaauggacaagcuggagcuaaaaggcaugagcuacgcuaugugcacaaacacuuuugugcucaagaaagaggucucugaaacccagcacgggacgauccugauuaagguggaguacaagggagaagaugcgcccuguaaaaucccuuucuccaccgaggacggccaagguaaggcacauaacgggcgucuuauaacagccaauccaguugugacuaaaaaggaggaacccguaaacauugaggcugaaccgccuuucggcgagucaaauaucgucaucggaauuggcgauaacgccuugaaaaucaauugguauaagaaggggagcaguauuggaaaaauguuugaagcaaccgcccgcggugcuagaaggauggccauacugggcgacacagcaugggauuucgggucugugggaggcguucucaacucccuggguaagauggugcaccagaucuuugggagcgcguacacugcucuuuucucgggcgucucuugggugaugaaaauuggaaucggcguacuguugaccuggaucgggcucaauuccaagaacacgucaaugaguuuuagcugcauugccauaggaaucauuacacuguauuuaggcgcagugguucaggccgacaccgguugugucaucaauuggaaagggaaggagcugaagugcggauccggcauuuucgugacuaacgaggugcauacauggaccgaacaguacaaauuucaagcugauucucccaagcggcuagccacugcaaucgcuggugccugggagaauggcgucugugggauacgaagcaccacacgcauggaaaaccuccuguggaaacagguugcgaaugagcuuaacuauaucuugugggaaaauaacauuaagcugacgguggugguaggagacaucauuggcguccucgagcaggggaaaagaacccugacuccacagccuauggaguuaaaguacucauggaaaacauggggaaaggccaagaucgugaccgcugaaacacaaaacaguuccuucauaauugauggccccaauacuccagagugccccagcgcaucuagggccuggaacguuugggaaguggaggacuaugguuuuggggucuucaccacgaauaucuggcugaaacuucgggaaguguacacacaguugugugaccaccgccucaugucagcugccguuaaggaugagagagcagugcacgcggacaugggauacuggauugagagucagaaaaacggcagcuggaagcuggaaaaagccucccuaaucgagguaaagaccugcacuuggccuaagucucauacccuguggucgaaugguguccucgaaagcgauaugauaaucccaaaaucccuggcuggcccgauuucacagcacaacuauaggcccggguaccauacacaaacugccggaccuuggcaccuuggcaaguuggagcuggacuuuaauuauugcgaggggaccacaguggugaucacggaaaacuguggaacccguggcccaaguuuacggacuacaaccgucucugguaaacucauucacgaguggugcugucgaagcugcacucugcccccucuuagauacaugggggaagauggauguugguauggcauggagaucaggccaauauccgaaaaggaggagaauaugguuaaaucacuggugagcgcagguucuggcaagguagacaacuucacaauggggguguugugccucgcuauucuguuugaagaggucaugcgcggaaaguucggcaaaaagcauaugaucgccgggguguucuuuaccuucguucuacugcucuccggacagaucacguggcgggauauggcacacacucugauuaugaucggcaguaaugccagcgacagaauggguaugggggugaccuaccuugcuuugauugcgacauuuaaaauacagcccuuccuggccuuaggauuuuuccucaggaagcugaccucucgcgaaaaccuucugcuaggcgucggccucgcaauggcuacuacacugcaauugccggaggauaucgaacagauggccaaugggauugcccugggauuaauggcucucaaacugaucacccaguuugagacauaucagcuuuggacugcacugauuuccuugaccuguucaaacacgaucuucacacucaccguggccuggcgaacugcgacccugauacuagcugguguuagucugcuuccugugugccaaagcucguccaugcggaagucugacuggcucccaaugacagucgccgcaaugggcguacccccucugcccuuguuuaucuucagccugaaggauacuuuaaaacguagaucauggccacucaaugagggggugauggccguuggacuggugaguauucuugcuuccucucuguugaggaacgacgucccuauggcaggcccccucguggccggugggcugcuaaucgcguguuacguaauuaccggaacgagcgcugaucugacaguggaaaaggccgcagacgucaccugggaggaagaggccgaacagacuggcguuucccauaaccuuaugaucacaguggacgaugacggcaccaugcgcauaaaagaugacgagacugagaauauucucacagugcuguugaagaccgcuuuacugaucgucucagggaucuuuccauacagcauuccggccacgcuccugguguggcacacuuggcagaaacagacccggagaaguggaguucuuugggauguaccuucucccccagaaacacaaaaggcagagcuggaagaggguguguauaggauaaaacagcagggcaucuucgggaagacccaggucggagugggcguucaaaaggaggguguguuucauacaauguggcacgucacucgaggggcuguguugaccuacaacggaaaacgccuagaacccaauugggccuccguaaagaaagaccugauuagcuauggcggcggguggcggcucucggcgcaguggcagaagggagaggaaguccaagugaucgccguugagccugguaaaaacccaaagaauuuccagacgaugcccggcacauuccagacuaccacaggggaaauuggagcaaucgcucuggauuuuaagccuggcaccucagguucuccgauaaucaacagagaggggaaaguggucggacuuuacggcaauggcgugguuacuaagaacgggggauaugugagugguauugcccagaccaaugcugagccagacggccccacaccugaauuagaggaagagauguucaaaaagaggaaccugacgaucauggaucuccacccaggguccggaaaaacucguaaguacuugcccgcaauuguccgcgaagccaucaagcggagacugaggacccucauacuggccccuacacgagugguagcugcggagauggaggaagcacuuaaaggccugccgauucgguaucaaaccacugccacaaagagcgagcauaccggucgcgaaaucguggacuugaugugccacgcuacguuuacuaugagacuacugucucccguuagggucccaaauuacaaccucaucauuauggaugaggcccauuucacagacccugcaagcaucgccgcucggggguacauauccacccgagugggaaugggcgaagcggccgcaauuuuuaugaccgcuacucccccaggcacagccgaugcauucccucagucaaaugcccccauccaggacgaggagagagacauuccagaacgcaguuggaacagcgggaaugaguggaucaccgauuuugcuggaaaaacagugugguucgucccgucuauaaaggccgguaacgacauugcgaacuguuuaaggaaaaauggcaagaagguaauccagcugucccguaaaacuuuugauacggaauaucaaaagaccaaacuuaacgacugggauuucgugguuacaacugacaucucagagaugggggcaaauuuuaaggccgaucgggugauugacccuagaaggugccugaaacccgucauccucaccgauggaccagagcgcgugauuuuggcuggccccaugccuguuacagccgcuagugcagcccagcgaagaggucggguggggaggaacccacagaaggaaaaugaccaguacauauucaccggccaaccccugaacaaugaugaggaccacgcucauuggacugaagccaagaugcuccuggacaacaucaauacgccugagggaauuaucccggcacuuuucgaaccagagcgcgagaaaagcgcggccaucgauggcgaauaucgucuaaagggggaguccagaaaaaccuuugucgaacugaugcggaggggagacuugcccgugugguuagcucacaagguagccucugaggguauuaaauacacagaucgcaaguggugcuucgacggccagcgaaacaaucagauacuggaagagaacauggauguggagaucuggacuaaagaaggggagaagaagaaacucagaccucgguggcuggacgcaaggaccuauucggauccccuugcucugaaggaauuuaaagacuucgccgcaggacgcaagagcauugcccucgauuugguuacagagaucggcagagucccaucacaccuggcucauaggacccggaaugcgcuagacaaccuggugaugcuccacacuuccgaacauggugggaaagccuaccgucacgcaguggaggagcuuccugaaacaauggagacgcuguuauugcugggccucaugauucugcuuaccggaggcgcuaugcuguuucucaucagugggaagggaauagguaagacuucuaucggcuugauuugugucaucgccagcuccgggaugcuguggauggccgaaauucccuuacaguggaucgcaucagcuauaguucuagaguucuuuaugauggugcugcucauuccagagccugaaaaacaacgcacaccgcaggauaaucagcuugccuauguagugaucggaauucugaccuuggcggcuaucauagccgcaaacgagaugggccugcucgaaaccacaaagcgagaccuggguaugucuaaagagcccggggucgugagcccaacuaguuaccuugauguugaccuccacccugccuccgcuuggacgcuguacgcaguggccaccacagucaucacucccauguugagacauaccauugaaaauagcacagcgaacguaucucuggcugccaucgcaaaccaagccgugguuuuaaugggccuagacaagggauggccaauuucaaaaauggaucugggcgugccucuccuugcucuggggugcuauucccaggucaaucccuugacccugacugccgcagugcuccugcuuaucacgcacuacgcuauaauuggaccgggcuuacaggccaaggcgacaagggaggcccagaagcggaccgcagcugguaucaugaaaaacccaacugucgacgggaucaugaccauugaucuggacccugugaucuaugauaguaaguucgagaaacaacucggacagguuauguugcuggugcuaugugccguacagcugcuccuuaugcgcacaagcugggcacugugcgaagcuuugacucuggccaccggccccauaacaacgcucugggaggguucgccaggcaaguuuuggaauaccacuauugccgugucuauggcgaacaucuucagaggguccuaccuggcuggagcaggcuuagccuuuagcauuaugaaaucagucgggacaggaaagaggggcaccgguagucagggggaaacucuuggagagaaguggaaaaagaaacugaaucaacucucucggaaggaauucgaccuauauaaaaaguccggcaucacagagguugaucgaaccgaggcuaaagaaggucugaagagaggcgagauaacgcaucacgccgugagccgcgggucagcaaaguugcagugguuugucgaaaggaacauggugauccccgagggacggguaauugaccugggcugugggcguggaggcuggaguuacuauugcgccggucucaaaaaggugaccgaaguuagaggguacacaaaaggaggcccuggccaugaggagccggugcccaugagcacuuacggguggaauaucgucaagcuuauguccggaaaagauguguucuaucugccaccugaaaagugugacaccuugcugugcgauauuggugagucuagccccuccccuacagucgaagagucaaggacuauccgcgugcucaagaugguugagccaugguuaaaaaacaaucaguucuguauuaagguacugaaccccuacaugccuaccgugaucgaacaccuugagcggcugcagcgaaaacacggcgggaugcuagucagaaauccacucucuaggaacaguacacaugaaauguauuggauaucgaauggaaccggcaacauuguggcuagcguuaauauggugucccgccuguugcugaaccgguuuacuaugacgcacagacgucccacaaucgagaaggacgucgaucucggugcggggaccaggcaugugaacgccgaaccggagacuccuaauauggacguaaucggagagcggauuaaacgcauaaaggaagagcacaacucuaccuggcacuacgacgaugaaaauccauauaagacaugggcauaccauggcucauaugaggugaaagcuacgggcagcgccuccaguaugaucaacgggguugucaagcuucugaccaaacccugggacguggugccuauggucacucaaauggcaaugacagauaccacuccauucggacagcagcgaguuuuuaaggaaaaaguggacacaagaacccccaggucuaugccggguacacggcgcguaaugggcauuacugccgagugguuauggagaacccuggggaggaauaagaagccucgauugugcacgcgggaggaauucaccaaaaaggugcguacaaacgcugccaugggagcggucuuuacugaggaaaaucaaugggauagcgcaaaagccgcuguggaggacgaagauuucuggaagcucguugacagagagcgcgagcugcacaaacuaggcaagugugguucaugcguguacaacaugauggggaaaagggaaaagaagcuuggagaguuuggcaaagccaagggcucccgggcaaucugguacauguggcugggggcuagauaucucgaauucgaggcccugggauuuuugaaugaggaucauugguucagucgcgaaaacagcuacucuggugucgagggcgaagggcugcacaaacucggauauauucuuagggacaucuccaagauacccggcggugcuauguacgccgaugacaccgcagggugggacacacgaaucacugaggaugaccugcauaaugaagagaaaauuacccagcagauggauccagagcaccggcaguuagcgaacgccaucuuuaagcugacguaucaaaauaaggugguaaaaguucagagaccuacacccaccggaacugugauggacauuaucucaaggaaggaucagcgcggcagcggccaggucgggacauacggauugaacaccuucacuaauauggaagcucaacucauacgucagauggagggugaaggcgugcugaccaaagccgaccuagagaacccacaccuuucggaaaagaaaauuacacaguggcuggagacgaaggggguggagcggcucaagagaauggcaaucucuggagaugacugcgucguuaaacccaucgaugacagguuugcuaacgcccuguuggcauuaaaugauaugggcaaggugcgcaaagacauuccucaguggcaaccaaguaaggguuggcaugauuggcagcagguaccguucuguucccaccauuuccacgaacugauaaugaaagacgggcgaaagcucgugguccccugccggccucaggacgagcuuaucggaagagccaggauuagccaaggcgcgggcuggucacugcgcgaaaccgcuugucuagggaaggccuaugcacagauguggucccugauguacuuucacagacgggaucucagguuggccucuaacgcuaucugcagcgccgugccaguucauugggugcccacuagucguacaaccugguccauucacgcacaucaccaguggaugacuacagaggacaugcugaccgucuggaaucgaguguggaucgaagauaacccuuggauggaggacaaaacgccaguaacaaccugggagaauguucccuaccuuggaaagcgcgaagaucaauggugugguagccugauaggccucacuucuagagcuaccugggcccagaacaucccuacagcgauucagcaggugcggucauuaaucgggaaugaggaauuccuggacuauaugccgaguaugaaaagguuucgcaaggaggaggaauccgagggagcuauuugguga

SEQ ID NO: 15429 - RNA, 9873 nt, Artificial Sequence
  derived and/or modified CDS sequence (opt3) from DENV-3__FJ024465__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauugcugaaguugagccggaagacaucgauugcugguguaaccugacuaguaccugggugacauaugggaccugcaaucaggccggagagcaccgccgagacaagcguagcguagcacuugccccccaugugggcaugggucuggauacuagaacacaaaccuggauguccgcugagggggcauggaggcaggucgaaaaaguggagacgugggccuugcggcacccuggauucacuauucucgcucuguuucuggcccauuacaucggcaccucucucacacagaagguugugauauucaucuuacugaugcuugucacuccaucgaugaccaugcgcugugugggcguagggaacagagacuuuguugaaggauugucaggugcgacauggguggaugucgugcuggagcacggcgggugcgugaccacgauggcaaagaauaaacccacucuagacauugagcuccagaagacagaagccacccaacuggcuacucuuaggaaacuguguaucgagggaaagauuacaaacaucaccacggauagccggugcccuacccagggcgaagccgucuugccagaggaacaggaccagaauuauguuuguaaacacacauacguggaucgcgguugggggaacggaugcggccucuucggcaaggggagucugguaacuugcgcaaaguuucaauguuuagagcccauagagggaaaagugguccaguaugaaaaucugaaguacaccgugauuaucacaguucauacuggugaccagcaccaggugggcaacgagacccaaggggucacagcugaaauuaccccucaggccuccacuacggaggcgauccucccagaauauggaacacuuggccuggagugcucuccgcgaaccgguuuggacuucaaugagaugauccuacugacuaugaaaaacaaggccuggauggugcauagacagugguuuuucgaucucccccugccuuggaccagcggggcaacaaccgaaacuccaacauggaauaggaaagagcuucugguaacguuuaagaacgcucacgccaaaaagcaagaaguuguggucuugggcucccaggagggagcuaugcacaccgcccucacuggcgcaacagaaauucagaauucagggggaaccaguauauucgccggucaucugaagugucgguuaaaaauggacaagcuggagcuaaaaggcaugagcuacgcuaugugcacaaacacuuuugugcucaagaaagaggucucugaaacccagcacgggacgauccugauuaagguggaguacaagggagaagauguucccuguaaaaucccuuucuccaccgaggacggccaagguaaggcgcauaacgggcgucuuauaacagcaaauccagugguaacuaaaaaggaggaacccgucaacauugaggccgaaccgccuuucggcgagucaaauaucgugaucggaauuggcgauaacgcuuugaaaaucaauugguauaagaaggggagcaguauuggaaaaauguuugaagccaccgcacgcggugccagaaggauggcuauacugggcgacacagccugggauuucgggucuguuggaggcgugcucaacucccuggguaagaugguccaccagaucuuugggagcgcauacacugcgcuuuucucgggcgugucuuggguaaugaaaauuggaaucggcgugcuguugaccuggaucgggcucaauuccaagaacacgucaaugaguuuuagcugcauugcuauaggaaucauuacacuguauuuaggcgccguuguccaggcagacaccgguugugugaucaauuggaaagggaaggagcugaagugcggauccggcauuuucgugacuaacgagguccauacauggaccgaacaguacaaauuucaagccgauucucccaagcggcuagcuacugccaucgcaggugcuugggagaauggcguuugugggauacgaagcaccacacgcauggaaaaccuccuguggaaacagaucgccaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggcgaagauagugaccgccgaaacacaaaacaguuccuucauuaucgauggccccaauacuccagagugccccagcgcuucuagggcauggaacguuugggaaguggaggacuaugguuuuggggucuucaccacgaauauuuggcugaaacuucgggaaguguacacacaguugugugaccaccgccucaugucagccgcuguuaaggaugagagagccgugcacgcagacaugggauacuggaucgagagucagaaaaacggcagcuggaagcuggaaaaagcgucccuaauagagguaaagaccugcacuuggccuaagucucauacccuguggucgaaugguguccucgaaagcgauaugaucauuccaaaaucccuggccggcccgaucucacagcacaacuauaggcccggguaccauacacaaacugcuggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgccgguucuggcaagguagacaacuucacaauggggguguugugccucgcaauccuguuugaagaggucaugcgcggaaaguucggcaaaaagcauaugaucgcugggguguucuuuaccuucguucuacugcucuccggacagauuacguggcgggauauggcccacacucugaucaugauuggcaguaaugcaagcgacagaauggguaugggggugaccuaccuugccuugauagcuacauuuaaaauccagcccuuccuggcguuaggauuuuuccucaggaagcugaccucucgcgaaaaccuucugcuaggcgucggccucgccauggcaacuacacugcaauugccggaggauauugaacagauggcuaaugggaucgcccugggauuaauggcccucaaacugauuacccaguuugagacauaucagcuuuggacugcucugaucuccuugaccuguucaaacacgauauucacacucaccguggcauggcgaacugccacccugauccuagcggguguuagucugcuuccugugugccaaagcucguccaugcggaagucugacuggcucccaaugacagucgcugccaugggcguacccccucugcccuuguuuauuuucagccugaaggauacuuuaaaacguagaucauggccacucaaugagggggugauggcaguuggacuggugaguauccuugccuccucucuguugaggaacgacgucccuauggcuggcccccucguggcaggugggcugcuaauugccuguuacguaaucaccggaacgagcgcggaucuggcuguggaaaaggccgcagacgucacaugggaggaagaggccgaacagaccggcguuucccauaaccuuaugauaacuguggacgaugacggcacaaugcgcauuaaagaugacgagaccgagaauauccucacugugcuguugaagacagcuuuacugaucgucucagggauuuuuccauacagcauaccggccacccuccugguguggcacacguggcagaaacagacucaacggaguggaguucuuugggauguaccuucucccccagaaacccagaaggcagagcuggaagaggguguguauagaaucaaacagcagggcauuuucgggaagacacaagucggagugggcguucagaaggaggguguguuucauaccauguggcacgucacaaggggggcuguguugacuuacaacggaaaacgacuagaacccaauugggccuccguaaagaaagaccugaucagcuauggcggcggguggcgccucucggcgcaguggcaaaagggagaggaaguccaggugauugccguugagccugguaaaaacccaaagaauuuccagaccaugcccggcacguuccagacaacuaccggggaaaucggagcaauagcucuggauuuuaagccuggcacaucagguucuccgaucauuaaccgggaggggaaaguggucggacuuuacggcaauggcgugguuaccaagaacgggggauaugugagugguaucgcccaaacuaaugcugagccagacggccccaccccugaauuagaggaagagauguucaaaaagagaaaccugacaauuauggaucuccacccaggguccggaaaaacgaggaaguacuugcccgcaaucguccgugaagccauaaagcgccggcugagaacucucauucuggccccuaccagggugguagcugcggagauggaggaagcacuuaaaggccugccgauccgauaucagacaaccgccacuaagagcgagcauacaggucgggaaaucguggacuugaugugccacgcuaccuuuacgaugcgccuacugucucccguuagagucccaaauuacaaccucauuaucauggaugaggcccauuucacugacccugcaagcauagccgcuaggggguacauuuccacacgggugggaaugggcgaagcggccgcaaucuuuaugaccgcuacccccccaggcacugccgaugcauucccucagucaaaugcccccauucaggacgaggagcgagacaucccagaaagaaguuggaacagcgggaaugaguggauaacagauuuugcuggaaaaaccgugugguucgucccgucuauuaaggccgguaacgacaucgcgaacuguuuacgcaaaaauggcaagaagguaauccaacuguccaggaaaacauuugauacugaauaucagaagacgaaacuuaacgacugggauuucgugguuaccacagacauuucagagaugggggcaaauuuuaaggccgaucgugugaucgacccucggagaugccugaaacccgucauucucacugauggaccagagagggugauauuggcuggccccaugccuguuaccgccgcuagugcagcccagcgccgagguagaguggggcggaacccacagaaggaaaaugaccaauacaucuucacaggccagccccugaacaaugaugaggaccacgcucauuggaccgaagccaagaugcuccuggacaacauuaauacuccugagggaaucaucccggcacuuuucgaaccagagagggagaaaagcgcggccauugauggcgaauaucgccuaaagggggagucccguaaaacguuugucgaacugaugagacggggagacuugcccgugugguuagcucacaagguagccucugaggguauaaaauacaccgauaggaaguggugcuucgacggccagcgcaacaaucagauccuggaagagaacauggauguggagauuuggacaaaagaaggggagaagaagaaacuccgaccuagauggcuggacgcacggacuuauucggauccccuugcucugaaggaauuuaaagacuucgccgcaggaaggaagagcaucgcccucgauuugguuaccgagauuggccgcgucccaucacaccuggcucauagaacaaggaaugcgcuagacaaccuggugaugcuccacaccuccgaacauggugggaaagccuaccggcacgcaguggaggagcuuccugaaacuauggagacacuguuauugcugggccucaugauccugcuuacgggaggcgcuaugcuguuucucauaagugggaagggaaucgguaagaccucuauuggcuugaucugugucauugccagcuccgggaugcuguggauggccgaaauccccuuacaauggauagcaucagcuauuguucuagaguucuuuaugauggugcugcucaucccagagccugaaaaacagcguacuccgcaggauaaucaacuugccuauguagugauuggaauccugacauuggcggcuauaaucgccgcaaacgagaugggccugcucgaaaccaccaagcgcgaccuggguaugucuaaagagcccggggucgugagcccaacaaguuaccuugauguugaccuccacccugccuccgcuuggacucuguacgcaguggccacgaccgucauuacacccauguugcgacauacuaucgaaaauagcaccgcgaacguaucucuggcugccauugcaaaccaggccgugguuuuaaugggccuagacaagggauggccaaucucaaaaauggaucugggcgugccucuccuugcucuggggugcuauucccaggucaaucccuugacacugaccgccgcagugcuccugcuuauaacucacuacgcuauuaucggaccgggcuuacaggccaaggcgacgagagaggcccaaaagaggacagcagcugguaucaugaaaaacccaaccgucgacgggauuaugacuaucgaucuggacccugugauauaugauaguaaguucgagaaacagcucggacagguuauguugcuggugcuaugugccguacagcugcuccuuaugcggaccagcugggcacugugcgaagcuuugacacuggccacuggccccauuaccacacucugggaggguucgccaggcaaguuuuggaauacgaccaucgccgugucuauggcgaacauuuuccgcggguccuaccuggcuggagcaggcuuagccuuuagcaucaugaaaucagucgggacuggaaagagaggcacagguagucaaggggaaacccuuggagagaaguggaaaaagaaacugaaucagcucucuaggaaggaauucgaccuauauaaaaaguccggcauaacugagguugaucggacagaggcuaaagaaggucugaagcgaggcgagaucacccaucacgccgugagcagagggucagcaaaguugcagugguuugucgaacgcaacauggugauucccgagggaaggguaaucgaccugggcugugggcggggaggcuggaguuacuauugcgccggucucaaaaaggugacggaaguucguggguacaccaaaggaggcccuggccaugaggagccggugcccaugagcacauacggguggaauauugucaagcuuauguccggaaaagauguguucuaucugccaccugaaaagugugacacuuugcugugcgauaucggugagucuagccccuccccuaccgucgaagagucaagaacaauuagggugcucaagaugguugagccaugguuaaaaaacaaucaguucuguaucaagguacugaaccccuacaugccuacugugauagaacaccuugagcgccugcaacggaaacacggcgggaugcuaguccgaaauccacucucuagaaacaguacccaugaaauguauuggauuucgaauggaacaggcaacaucguggcuagcguuaauaugguguccaggcuguugcugaaccgcuuuaccaugacucaccggagacccacgaucgagaaggacgucgaucucggugcggggacacgucaugugaacgccgaaccggagaccccuaauauggacguaauuggagagaggauaaaacggaucaaggaagagcacaacucuacuuggcacuacgacgaugaaaauccauauaagaccugggcauaccauggcucauaugaggugaaagcuacaggcagcgccuccaguaugauuaacgggguugucaagcuucugacgaaacccugggacguggugccuaccgucacucagauggcaaugacagauaccacuccauucggacagcaacgcguuuuuaaggaaaaaguggacacacgaacccccagaucuaugccggguacaaggcggguaaugggcaucacugccgagugguuauggcgcacccuggggagaaauaagaagccuagguugugcacgcgagaggaauucaccaaaaaggugcggacaaacgcugccaugggagcggucuuuacugaggaaaaucagugggauagcgcaaaagccgcuguggaggacgaagauuucuggaagcucguugaccgugagagagagcugcacaaacuaggcaagugugguucaugcguguacaacaugauggggaaacgcgaaaagaagcuuggagaguuuggcaaagccaagggcuccagggcaauuugguacauguggcugggggcucgguaucucgaauucgaggcccugggauuuuugaaugaggaucauugguucaguagagaaaacagcuacucuggugucgagggcgaagggcugcacaaacucggauauauccuucgcgacauauccaagauccccggcggugcuauguacgccgaugacaccgcagggugggacacaaggauuacugaggaugaccugcauaaugaagagaaaaucacccagcagauggauccagagcaccgacaauuagcgaacgccauuuuuaagcugacguaucagaauaaggugguaaaaguucagcggccuacacccaccggaacugugauggacaucauaucaagaaaggaucagaggggcagcggccaagucgggacauacggauugaacaccuucacuaauauggaagcucagcucauucgccagauggagggugaaggcgugcugucgaaagccgaccuagagaacucucaccuuagugaaaagaaaaucacccaguggcuggagacaaaggggguggagcgucucaagcggauggcaaucuccggagaugacugcgucguuaaaccaauugaugacagauuugcuaacgcccuguuggcauuaaaugauaugggcaaggugaggaaagacauaccccaauggcagccuagcaaggguuggcaugauuggcagcagguaccauucuguucacaccauuuccacgaacugaucaugaaagacgggcgcaagcucguggucccgugccgaccccaagacgagcuuauuggacgggccagaaucucccagggcgcgggcuggucucugagggaaacggcuugucuagggaaggccuaugcacagauguggagccugauguacuuucaccgcagagaucuccgguuggccaguaacgcuauuugcuccgccgugccuguucauugggugccaaccagcaggacuacauggucuauccacgcacaucaccaauggaugaccacugaggacaugcugacagucuggaaucguguguggauagaagauaaccccuggauggaggacaaaaccccuguaacgacaugggagaauguuccauaccuuggaaagcgagaagaucaguggugugguucacugaucggccucaccagucgcgcuacuugggcccagaacauucccaccgcgauccagcaagugagauccuuaauugggaaugaggaauuccuggacuauaugccuagcaugaaacgguuuaggaaggaggaggaaucugagggagcuaucugguga

SEQ ID NO: 15430 - RNA, 9873 nt, Artificial Sequence
  derived and/or modified CDS sequence (opt3) from DENV-3__FJ024466__SS-prME
accagccugugccucaugaugauccuucccgccgcucuggcauuccacuugacuuccagagacggcgagccuaggaugauuguggggaagaacgaacggggaaaaucuuuacuguuuaagacugccucagguauaaauauguguacgcuaaucgcgauggaucucggcgagaugugcgacgauaccgucacuuacaaauguccacauauugcugaaguugagccggaagacaucgauugcugguguaaccugacaaguaccugggugaccuaugggaccugcaaucaggccggagagcaccgccgagacaagcguagcgucgcacuugccccacaugugggcaugggucuggauacuagaacacaaaccuggauguccgcugagggggcauggaggcaggucgaaaaaguggagacgugggccuugcggcacccuggauucacuauucucgcucuguuucuggcccauuacaucggcaccucucucacacagaagguugugauauucaucuuacugaugcuugucacuccaucgaugaccaugcgcugugugggcguagggaacagagacuuuguugaaggauugucaggugcgacauggguggaugucgugcuggagcacggcgggugcgugaccacgauggcaaagaauaaacccacucuagacauugagcuccagaagacagaagccacccaacuggcuacucuuaggaaacuguguaucgagggaaagauuacaaacaucaccacggauagccggugcccuacccagggcgaagccgucuugccagaggaacaggaccagaauuauguuuguaaacacacauacguggaucgcgguugggggaacggaugcggccucuucggcaaggggagucugguaacuugcgcaaaguuucaauguuuagagcccauagagggaaaagugguccaguaugaaaaucugaaguacaccgugauuaucacaguucauacuggugaccagcaccaggugggcaacgagacccaaggggucacagcugaaauuaccccucaggccuccacuacggaggcgauccucccagaauauggaacacuuggccuggagugcucuccgcgaaccgguuuggacuucaaugagaugauccuacugacuaugaaaaacaaggccuggauggugcauagacagugguuuuucgaucucccccugccuuggaccagcggggcaacaaccgaaacuccaacauggaauaggaaagagcuucugguaacguuuaagaacgcucacgccaaaaagcaagaaguuguggucuugggcucccaggagggagcuaugcacaccgcccucacuggcgcaacagaaauucaaaauucagggggaaccaguauauucgccggucaucugaagugucgguuaaaaauggacaagcuggagcuaaaaggcaugagcuacgcuaugugcacaaacacuuuugugcucaagaaagaggucucugaaacccagcacgggacgauccugauuaagguggaguacaagggagaagaugcgcccuguaaaaucccuuucuccaccgaggacggccaagguaaggcacauaacgggcgucuuauaacagccaauccaguugugacuaaaaaggaggaacccguaaacauugaggcugaaccgccuuucggcgagucaaauaucgucaucggaauuggcgauaacgccuugaaaaucaauugguauaagaaggggagcaguauuggaaaaauguuugaagcaaccgcccgcggugcuagaaggauggccauacugggcgacacagcaugggauuucgggucugugggaggcguucucaacucccuggguaagauggugcaccagaucuuugggagcgcguacacugcucuuuucucgggcgucucuugggugaugaaaauuggaaucggcguacuguugaccuggaucgggcucaauuccaagaacacgucaaugaguuuuagcugcauugccauaggaaucauuacacuguauuuaggcgcagugguucaggccgacaccgguugugucaucaauuggaaagggaaggagcugaagugcggauccggcauuuucgugacuaacgaggugcauacauggaccgaacaguaccgguuucaagcugauucucccaaacgacuagccacugcaaucgcuggugccugggagaauggcgucugugggauacgcagcaccacaagaauggaaaaccuccuguggaagcagaucgcgaaugagcuuaacuauauuuugugggaaaauaacaucaaacugacgguuguggugggagacauuaucggcguacucgagcaggggaagaggacccugacuccacagccuauggaguuaaaauacucauggaagacauggggaaaagccaagauagucaccgcugaaacacaaaacaguuccuucauuaucgauggccccaauacuccagagugccccagcgcaucucgggccuggaacgugugggaaguugaggacuaugguuuugggguguucaccacgaauauuuggcugaaacuucgcgaagucuacacacaguugugugaccacagacucaugucagcugccgugaaagaugagagggcaguucacgcggacaugggauacuggaucgagagucagaagaacggcagcuggaaacuggaaaaggccucccuaauagaggugaaaaccugcacuuggccuaagucucauacccuguggucgaaugguguacucgaaagcgauaugaucauuccaaagucccuggcuggcccgaucucacagcacaacuaucgucccggguaccauacacaaacugccggaccuuggcaccuuggcaaauuggagcuggacuuuaauuauugcgaggggaccacagucgugauuacggauaacuguggaacccggggcccaaguuuacgaacuacaaccgugucugguaagcucauccacgaauggugcuguagaagcugcacucugcccccucuuagguacaugggggaggacggauguugguauggcauggaaauacgcccaauuuccgagaaagaagagaauauggucaagucacugguuagcgcagguucuggcaaaguggauaacuucacaauggggguauugugccucgcuauccuguuugaggaagugaugcggggaaaguucggcaagaaacauaugaucgccggggucuucuuuaccuucgugcuacugcucuccggacagauuacguggagagacauggcacacacucugaucaugauuggcaguaaugccagcgauaggauggguauggggguuaccuaccuugcuuugauagcgacauuuaagauccagcccuuccuggccuuaggauuuuuccuccgcaaacugaccucucgagagaaccuucugcuaggcgugggccucgcaauggcuacuacacugcaauugccggaagacauugagcagauggccaaugggaucgcccugggauuaauggcucucaagcugauuacccaguuugaaacauaucagcuuuggacugcacugaucuccuugaccuguucaaacacgauauucacacucaccgucgccuggcggacugcgacccugauccuagcuggugugagucugcuuccuguuugccaaagcucguccaugcguaaaucugauuggcucccaaugacaguggccgcaaugggcguacccccucugcccuuguuuauuuucagccugaaggacacuuuaaagagaaggucauggccacucaaugaggggguaauggccgugggacugguuaguauccuugcuuccucucuguugcgcaacgaugugccuauggcaggcccccucgucgccggugggcugcuaauugcguguuacgugaucaccggaacgagcgcugaccugacaguagagaaagccgcagacgugaccugggaagaggaagccgagcagacuggcgucucccauaaccuuaugauaacaguugaugacgauggcaccaugcggauuaaggacgaugaaacugagaauauccucacagugcuguugaaaaccgcuuuacugaucgugucagggauuuuuccauacagcauaccggccacgcuccuggucuggcacacuuggcagaagcagaccagaaggaguggagugcuuugggacguuccuucucccccagagacacaaaaagcagaacuggaggaagguguauaucgaaucaagcagcagggcauuuucgggaaaacccaggugggagucggcgugcaaaaggaggguguuuuucauacaauguggcacgugacucgcggggcugucuugaccuacaacggaaagcggcuagagcccaauugggccuccgugaaaaaggaucugaucagcuauggcggcggguggagacucucggcgcaguggcagaaaggagaagagguacaagucauugccguggaaccugguaagaaccccaagaauuuccagacgaugcccggcacauuccagacuaccacaggggagaucggagcaauagcucuggacuuuaagccuggcaccucagguucuccgaucauuaacagggaagggaagguugugggacuuuacggcaauggcgucgugacuaaaaacgggggauauguuagugguaucgcccagaccaaugcugagccagauggccccacaccugaguuagaagaggaaauguucaagaaacguaaccugacgauuauggaccuccacccaggguccggaaagacucgcaaauacuugcccgcaaucgugcgggaggccauaaagagaaggcugcgaacccucauucuggccccuacacgggucguggcugcggaaauggaggaggcacuuaagggccugccgauccgcuaucaaaccacugccacaaaaagcgaacauaccgguagagagaucguagauuugaugugccacgcuacguuuacuaugaggcuacugucucccgugcggguuccaaauuacaaccucauuaucauggacgaagcccauuucacagauccugcaagcauagccgcucgaggguacauuuccaccagagucggaaugggcgaggcggccgcaaucuuuaugaccgcuacucccccaggcacagccgacgcauucccucagucaaaugcccccauucaggacgaagaacgcgauaucccagagaggaguuggaacagcgggaaugaauggauaaccgacuuugcuggaaagacagugugguucgugccgucuauuaaagccgguaacgauaucgcgaacuguuuacguaagaauggcaaaaaggucauccagcugucccggaagacuuuugacacggaguaucagaagaccaaacuuaacgauugggacuucguagugacaacugauauuucagaaaugggggcaaauuuuaaagccgacagaguuaucgauccuaggcgcugccugaagcccgugauucucaccgacggaccagagcgagucauauuggcuggccccaugccugugacagccgcuagugcagcccagagacgggguaggguugggcgcaacccacagaaagagaaugaucaguacaucuucaccggccaaccccugaacaaugacgaagaccacgcucauuggacugaggccaagaugcuccuggauaacauuaauacgccugaaggaaucaucccggcacuuuucgagccagaacgugaaaagagcgcggccauugacggcgaguauagacuaaaaggggaaucccggaagaccuuuguggagcugaugaggcgcggagauuugcccgucugguuagcucacaaaguggccucugaagguauaaaguacacagaccgaaaauggugcuucgauggccagagaaacaaucagauccuggaggaaaacauggacguagagauuuggacuaaggagggggagaagaagaagcuccggccuagguggcuggaugcacgcaccuauucggacccccuugcucugaaagaguuuaaggauuucgccgcaggaagaaaaagcaucgcccucgacuuggugacagaaauuggcaggguuccaucacaccuggcucaucggacccguaaugcgcuagauaaccuggucaugcuccacacuuccgagcauggugggaaggccuaccgccacgcaguggaggaacuuccugagacaauggaaacgcuguuauugcugggccucaugauccugcuuaccggaggcgcuaugcuguuucucauaagugggaaaggaaucgguaagacuucuauuggcuugaucugugugauugccagcuccgggaugcuguggauggccgagauccccuuacaguggauagcaucagcuauuguccuagaguucuuuaugaugguucugcucaucccagagccugagaagcaacgaacaccgcaggacaaucagcuugccuaugugguaauuggaauccugaccuuggcggcuauaaucgccgcaaacgaaaugggccugcucgagaccacaaaaagagaucuggguaugucuaaggaacccgggguggucagcccaacaaguuaccuugacguggaccuccacccugccuccgcuuggacgcuguacgcaguugccaccacagugauuacucccauguugaggcauaccaucgagaauagcacagcgaacgucucucuggcugccauugcaaaccaagccguaguguuaaugggccuagauaaaggauggccaaucucaaagauggaccugggcguuccucuccuugcucuggggugcuauucccaggugaaucccuugacccugacugccgcaguccuccugcuuauaacgcacuacgcuauuaucggaccgggcuuacaggccaaagcgacacgggaagcccagaagcgcaccgcagcugguaucaugaagaacccaacuguggaugggauuaugaccaucgaccuggauccugucauauaugacaguaaauucgagaagcaacucggacaggugauguugcugguucuaugugccgugcagcugcuccuuaugagaacaagcugggcacugugcgaggcuuugacucuggccaccggccccauuacaacgcucugggaagguucgccaggcaaauuuuggaauaccacuaucgccguaucuauggcgaacauuuucaggggguccuaccuggcuggagcaggcuuagccuuuagcaucaugaagucaguggggacaggaaaacggggcaccgguagucagggggagacucuuggagaaaaguggaagaaaaagcugaaucaacucucucgaaaagaguucgaucuauauaagaaauccggcauaacagaagucgacagaaccgaggcuaaggagggucugaaacgcggcgaaaucacgcaucacgccguuagcagggggucagcaaaguugcagugguuuguggagcggaacauggucauucccgaaggacgugugaucgaucugggcugugggagaggaggcuggaguuacuauugcgccggucucaagaaaguaaccgaggugaggggguacacaaagggaggcccuggccaugaggaaccgguucccaugagcacuuacggguggaauauugugaaacuuauguccggaaaggacgucuucuaucugccaccugagaaaugugauaccuugcugugcgacaucggugaaucuagccccuccccuacaguggaggaaucacgcacuauucggguccucaagaugguggagccaugguuaaagaacaaucaguucuguaucaaaguucugaaccccuacaugccuaccguaauagagcaccuugaacgacugcagagaaagcacggcgggaugcuagugaggaauccacucucucgcaacaguacacaugagauguauuggauuucgaauggaaccggcaacaucgucgcuagcgugaauaugguuucccggcuguugcugaacagauuuacuaugacgcaccguaggcccacaaucgaaaaagauguggaccucggugcggggacccggcaugucaacgccgagccggaaacuccuaauauggacgugauuggagagcgcauaaagcgaaucaaagaggaacacaacucuaccuggcacuacgaugacgagaauccauauaagacaugggcauaccauggcucauaugaaguaaaggcuacgggcagcgccuccaguaugauuaacggggugguuaaacuucugaccaagcccugggaugucgugccuauggugacucaaauggcaaugacagacaccacuccauucggacagcagagagucuuuaaagagaagguugauacaaggacaccccggucuaugccggguacacgcagagugaugggcaucacugccgaaugguuauggaggacccuggggcgaaauaaaaagccucgguugugcacgcgugaggaguucaccaagaaaguaagaacaaacgcugccaugggagcgguguuuacugaagagaaucaaugggacagcgcaaaggccgcugucgaagaugaggacuucuggaaacucguggaucgcgaaagggagcugcacaagcuaggcaaaugugguucaugcguuuacaacaugauggggaagcgggagaagaaacuuggagaauuuggcaaagccaaaggcuccagagcaauuugguacauguggcugggggcucgcuaucucgaguucgaagcccugggauuuuugaaugaggaccauugguucaguagggagaacagcuacucugguguggaaggcgaggggcugcacaagcucggauauauccuucgagauauauccaaaauccccggcggugcuauguacgccgacgacaccgcagggugggauacacggauuacugaagacgaucugcauaaugaggaaaagaucacccaccagauggacccagagcacagacaguuagcgaacgccauuuuuaaacugacguaucagaauaaggucgugaagguacaaaggccuacacccaccggaacuguuauggauaucauaucacgcaaagaccagcguggcagcggccagguggggacauacggauugaacaccuucacuaauauggaggcucagcucauucggcaaauggaaggugagggcguccugucgaaggccgaucuagaaaacccacaucuuucugagaaaaagaucacccaguggcuggaaacaaaagggguggagagacucaagaggauggcaaucaguggagacgauugcguggucaagcccauugacgaucgcuuugcuaacgcccuguuggcauuaaaugacaugggcaaaguucgaaaggauauaccucaguggcagccauccaaagguuggcacgacuggcaacaggugccguucuguagccaucacuuccacgagcugaucaugaaggacgggcggaaacucguagugcccugcagaccucaggaugaacuuauuggaagggcccgcaucucacagggcgcgggcuggucccugagagagacggcuugucuagggaaggccuaugcacaaauguggucucugauguacuuucaucggagggaccuccguuuggccagcaacgcuauuugcagugccgucccagugcacuggguucccaccucccgaacuacauggagcauccaugcacaccaucaguggaugaccacugaagauaugcugacaguguggaaucgcgucuggauagaggacaacccuuggauggaagauaagaccccagugacgacaugggagaauguacccuaccuuggaaaaagagaggaccaguggugugguucucugaucggccucaccucacgggcuacuugggcccaaaacauuccuaccgcgauccagcagguuaggaguuuaauugggaaugaagaguuccuggauuauaugccguccaugaagcgcuuuagaaaagaagaggagagcgaaggagcuaucugguga

SEQ ID NO: 15431 - RNA, 9873 nt, Artificial Sequence
  derived and/or modified CDS sequence (opt3) from DENV-3__FJ024467__SS-prME
accagccugugccucaugauggugcuucccgccgcucuggcauuccacuugacauccagagacggcgagccuaggaugaucgucgggaagaacgaacggggaaaaucuuuacuguuuaagacugccucagguauuaauauguguacgcuaauagcgauggaucucggcgagaugugcgacgauaccguuacauacaaauguccacauaucacugaaguggagccggaagacauugauugcugguguaaccugaccaguacauggguaaccuaugggacuugcaaucaggcuggagagcaccgccgagacaagcguagcguggcccuugcaccccaugucggcaugggucuggauacaagaacccaaacguggauguccgccgagggggcuuggaggcagguggaaaaaguugagacuugggcauugcggcacccuggauucaccauccucgcccuguuucuggcucauuacauuggcacaucucucacucagaagguggucaucuucauauuacugaugcuugugaccccaucgaugacaaugcgcuguguaggcguugggaacagagacuuuguggaaggauugucaggugccaccugggucgauguggugcuggagcacggcgggugcgucacgacuauggcgaagaauaaacccacacuagacaucgagcuccagaagaccgaagcaacucaacuggccacacuuaggaaacuguguauugagggaaagaucaccaacauuacgaccgauagccggugcccuacacagggcgaagcuguuuugccagaggaacaggaccagaauuauguguguaaacacacuuacguagaucgcgguugggggaacggaugcggccucuucggcaaggggagucuggugaccugcgccaaguuucaauguuuagagcccaucgagggaaaagucgugcaguaugaaaaucugaaguacacaguuauaauuacugugcauaccggugaccagcaccaggucggcaacgagacacaaggggugaccgcagaaaucacuccucaggcuuccacgacagaggccauucucccagaauauggaacccuuggccuggagugcucuccgcgaacugguuuggacuucaaugagaugauccuacugaccaugaaaaacaaggcguggaugguacauagacagugguuuuucgaucucccccugccuuggacaagcggggccaccacugaaacaccaacguggaauaggaaagagcuucugguuaccuuuaagaacgcacacgcuaaaaagcaagaaguggucguguugggcucccaggagggagccaugcacacugcucucacaggcgccaccgaaauccagaauucagggggaacaaguauuuucgcaggucaucugaagugucgguuaaaaauggacaagcuggagcuaaaaggcaugagcuacgccaugugcacuaacaccuuuguccucaagaaagaggugucugaaacgcagcacgggaccauacugaucaagguugaguacaagggagaagaugcucccuguaaaauuccuuucuccacagaggacggccaagguaaggcgcauaacgggcgucuuaucacugcaaauccagugguaaccaaaaaggaggaacccgucaacauagaggccgaaccgccuuucggcgagucaaauauugugaucggaaucggcgauaacgcuuugaaaauuaauugguauaagaaggggagcaguaucggaaaaauguuugaagccacagcacgcggugccagaaggauggcuauucugggcgacacugccugggauuucgggucuguuggaggcgugcucaacucccuggguaagaugguccaccagauauuugggagcgcauacaccgcgcuuuucucgggcgugucuuggguaaugaaaaucggaauuggcgugcuguugacguggaucgggcucaauuccaagaacacaucaaugaguuuuagcugcaucgcuauuggaguuauaacccuguauuuaggcgccgucgugcaggcagacauggguugugugaucaauuggaaagggaaggagcugaagugcggauccggcauuuucgucacuaacgagguucauacauggaccgaacaguacaaauuucaagccgauucucccaagcggcuagcuacugccaucgcaggugcuugggagaauggcgugugugggauucgaagcaccacacgcauggaaaaccuccuguggaaacagaucgccaaugagcuuaacuauauauugugggaaaauaacaucaagcugacggugguagucggagacauuaucggcgugcucgagcaggggaaaagaacccugacuccacagccuauggaguuaaaguacucauggaaaacauggggaaaggcgaagauuguuaccgccgaaacacaaaacaguuccuucaucauagauggccccaauacuccagagugccccagcgcuucuagggcauggaacgugugggaagucgaggacuaugguuuugggguguucaccacgaauauuuggcugaaacuucgggaaguuuacacacaguugugugaccaccgccucaugucagccgcugugaaggaugagagagccguacacgcagacaugggauacuggaucgagagucagaaaaacggcagcuggaagcuggaaaaagcgucccuaauugaggucaagaccugcacuuggccuaagucucauacccuguggucgaauggugugcucgaaagcgauaugaucauaccaaaaucccuggccggcccgaucucacagcacaaccauaggcccggguaucaaacacagacugcuggaccuuggcaccuuggcaaguuggagcuggacuuuaauuacugcgaggggaccacaguggucauuacggaaaacuguggaacccguggcccaaguuuacggacuacaaccguuucugguaaacucauccacgaguggugcugucgaagcugcacucugcccccucuuagauauaugggggaagauggauguugguacggcauggagauuaggccaaucuccgaaaaggaggagaauauggugaaaucacugguaagcgccgguucuggcaagguggacaacuucacaaugggggucuugugccucgcaauacuguuugaagagaugaugcgcggaaaguucggcaaaaagcauaugauugcugggguguucuuuaccuucguucuacugcucuccggacagaucacguggcgggauauggcccacacucugaucaugauuggcaguaaugcaagcgacagaauggguaugggggugaccuaucuugccuugaucgcugcguuuaaaauucaacccuuccuggccuuaggauuuuuccucaggaagcugacaucucgcgaaaaccuucugcuaggcgucggccucgcaauggcuaccacucugcaguugccggaggauauagaacagauggccaaugggaucgcccugggauuaauggcucucaaacugauuacacaguuugagaccuaccaacuuuggacagcacugaucuccuugacuuguucaaacaccauguucacgcucacaguggccuggcgaaccgcgacucugauucuagcugguguuagucugcuuccugugugccagagcucguccaugcggaagaccgacuggcucccaauggccgucgcagccaugggcguacccccucugcccuuguuuaucuucucucugaaggauacauuaaaacguagaagcuggccacucaaugagggggugauggcuguuggacuggugucaauacuugcaaguucccuguugaggaacgacgucccuauggccggcccccucguggcgggugggcugcuaaucgcuuguuauguaauuacuggaaccucugccgaucugacgguggaaaaggcagccgacaucacaugggaggaagaggcugaacagaccggcgucagccauaaccuuaugauuacuguugacgaugacggcacaaugcgcaucaaagaugacgagaccgagaauauacucacugugcuguugaagacagccuuacugauuguguccggggucuuuccauacucaaucccggcaacccuccugguguggcacacguggcagaaacaaacucagcggagcggaguucuuugggauguaccuagucccccagaaacccagaaggcugagcuggaagaggguguguacagaaucaaacagcaaggcauuuucgggaagacacaggucggagugggcguucagaaggaggguguguuucauaccauguggcacgucacaaggggggccguguugacuuauaacggaaaacgacuagaacccaauugggcgucuguaaagaaagaccugauauccuacggcggcggguggcgccucagcgcccaauggcagaagggagaggaaguccaggugaucgcaguugagccugguaaaaacccaaagaauuuccagaccaugcccggcacguuccaaacaacuaccggggaaauuggagcuaucgcccuggauuuuaagccuggcacaucggguucaccgauuaucaaccgggaggggaaaguggucggacuuuauggcaauggcgugguuaccaagaacgggggauacgugucugguauagcucagacuaaugcagagccagacggccccaccccugaauuagaggaagagauguucaaaaagagaaaccugacaaucauggaucuccacccagggaguggaaaaacgaggaaguauuugcccgccauuguccgugaagccaucaagcgccggcugagaacucucauucuggcuccuaccagggugguagcggcagagauggaggaagcccuuaaaggccugccgauccgauaccagacaaccgcuacuaaguccgagcauacaggucgggaaauaguggacuugaugugccacgccaccuuuacgaugcgccuacugagccccguuagagucccaaauuauaaccucauuaucauggaugaggcacauuucacugacccugccucuaucgcugcgaggggguacauuagcacacgggugggaaugggcgaagccgcagcuaucuuuaugaccgccacccccccaggcacugcagaugccuucccucaguccaaugcucccauacaagacgaggagaaagacauuccagaacgaucauggaacagugggaaugaguggaucacagauuuugccggaaagaccgugugguucgucccgagcauuaaagcggguaacgacaucgcaaacuguuuaagaaagaauggcaagaaaguaauacagcugucucgcaagacauuugauacugaauaccagaaaacgaagcuuaacgacugggauuucgugguuaccacagacauuuccgagaugggggccaauuuuaaagcugauagggugaucgacccucgucggugccugaagcccgucauccucacugauggaccagagagagugauuuuggccggccccaugccuguuaccgcugcaucagccgcucagaggcgcggucgaguggggagaaacccacaaaaggaaaaugaccaguauaucuucacaggccagccccugaacaaugaugaggaccacgcccauuggaccgaagcaaaaaugcuccuggacaacauuaauacuccugagggaauaaucccggcgcuuuucgaaccagagcgggagaagagugccgcuauugauggcgaauacaggcuaaaaggggagagccgcaagacguuugucgaacugaugcguagaggagacuugcccgugugguuagcccacaaaguagcauccgaggguaucaaguauaccgaucggaaauggugcuucgacggccagaggaacaaucaaauccuggaagagaacauggauguggagauuuggacaaaggaaggggagaagaaaaagcuccgcccucgauggcuggacgcuagaacuuacucugauccccuugcccugaaagaauuuaaggacuucgcagccggacggaaaucgauagcucucgauuugguuaccgagaucggcagggucccaagccaccuggcgcaucgcacaagaaaugcccuagacaaccuggugaugcuccacaccucagaacauggugggagggcauaucggcacgcuguggaggagcuuccugaaacuauggagacacuguuauugcugggccucaugauucugcuuacgggaggcgccaugcuguuucucaucuccgggaagggaauugguaagaccaguaucggcuugauaugugucaucgccucuagcgggaugcuguggauggcagaaauucccuuacaguggaucgcuuccgccauuguucuagaguucuuuaugauggugcugcucaucccagagccugaaaaacagcguacuccgcaagauaaucagcuugcguacguagugauaggaauucugacauuggcugccaucauugcagccaacgagaugggccugcucgaaaccaccaagcgcgaccuggguaugucaaaagagcccggggucgugucuccaacaagcuaucuugauguugaccuccacccugcuagugcauggacucuguacgccguggcgacgaccgucaucacacccauguugcgacauacuauagaaaauuccaccgcuaacguaagccuggccgcaaucgccaaccaggcugugguuuuaaugggccuagacaagggauggccaauuucuaaaauggaucugggcgugccucuccuugcccuggggugcuacucacaggucaaucccuugacacugaccgcagcugugcuccugcuuaucacucacuaugccauuaucggaccgggcuuacaagcgaaggccacgagagaggcacagaagaggacagcugccgguauaaugaaaaacccaaccgucgacgggauuaugacuaucgaucuggacccugugaucuacgauuccaaguucgagaaacagcucggacagguuauguugcuggugcuaugugcaguacaacugcuccuuaugcggaccaguugggcucugugcgaagccuugacacuggccacuggccccauuaccacacucugggaggguagcccaggcaaguuuuggaauacgaccaucgcggugucgauggcuaacauauuccgcgggucuuaucuggcaggagccggcuuagcuuuuuccauuaugaaaagcgucgggacuggaaagagaggcacagguucacagggggaaacccuuggagagaaguggaaaaagaaacugaaucagcucaguaggaaggaauucgaccuauacaaaaagucuggcaucacugagguugaucggacagaggccaaagaaggucugaagcgaggcgagaccacgcaucacgcaguguccagagggaccgccaaguugcagugguuugucgaacgcaacauggugauucccgagggaaggguaaucgaccugggcugugggcggggaggcuggagcuauuacugcgcuggucucaaaaaggugacagaaguucguggguauacuaaaggaggcccuggccaugaggagccggugcccaugucaaccuacggguggaauauagucaagcuuaugaguggaaaagauguguucuaccugccaccugaaaagugugacacauugcugugcgauaucggugagagcucccccucuccuacugucgaagagagcagaaccauuagggugcucaagaugguugagccaugguuaaaaaacaaucaauucuguaucaagguacugaaccccuauaugccuacagugauugaacaccuugagcgccugcagcggaaacacggcgggaugcuaguccgaaauccacucuccagaaacucaacccaugaaauguacuggaucucuaauggaacuggcaacauuguggcgaguguuaauauggugucgaggcuguugcugaaccgcuuuacgaugacacaccggagacccaccaucgagaaggacgucgaucucggugccgggacucgucaugugaacgcagaaccggagaccccuaauauggacguaauaggagagaggauuaaacggaucaaggaagagcacaacagcacauggcacuaugacgaugaaaauccauacaagacgugggcuuaucauggcuccuacgaggugaaagccaccggcucugcaucaagcaugaucaacgggguugucaagcuucugacuaaacccugggacguggugccuauggucacacagauggccaugaccgauacuacaccauucggacaacagcgcguuuuuaaggaaaaaguggacacccgaacacccagauccaugccggguacuaggcgggcuaugggcauuaccgccgagugguuauggcgcacgcuggggagaaauaagaagccuagguugugcacccgagaggaauucacaaaaaagguacggacuaacgcggcaaugggagccguguuuaccgaggaaaaucagugggauagugcuaaagccgcagucgaggacgaaaacuucuggaagcucguggaucgugagagagagcugcacaaacuaggcaagugugguucuugcguuuauaauaugauggggaaacgcgaaaagaagcuuggagaguuuggcaaagcuaagggcagcagggccauaugguacauguggcugggggcucgguaccucgaauucgaggcccugggauuuuugaacgaggaccauugguucucaagagaaaauuccuauagugguguggagggcgaagggcugcacaaacucggauacauccuucgcgauauuagcaagauccccggcggugcaauguaugcggacgauacagccgggugggacacuaggauuaccgaggacgaucugcauaacgaagagaaaaucacgcagcaaauggacccagagcaccgacaguuagcuaaugccauauuuaagcugacauaccagaacaaggucgugaaaguacagcggccuacccccacuggaacaguuauggauaucauuucuagaaaggaccaaaggggcuccggccagguggggaccuauggauugaauacuuucaccaacauggaagcacagcucauccgccagauggagggugaaggcguccugucaaaagcugaucuagagaacccacaccuucccgaaaagaaaauuacacaauggcuggagacgaaggggguggagcgucuccggagaauggccaucagcggagacgauugcguggucaagccuauagacgauagguuugcaaaugcccuguuggcguuaaacgacaugggcaaaguucgcaaggauauuccacaguggcagccgucgaaagguuggcaugacuggcagcaagugcccuucuguucucaccauuuccacgaacugaucaugaaggaugggcgaaaacucguagugccuugccggccacaggacgagcuuaucggaagagcuaggauuagucagggcgccggcuggucccugcgcgaaaccgcaugucuagggaaggccuacgcucaaauguggagccugauguauuuucacagacgggaccucagguuggccucaaaugcaauaugcuccgcuguccccgugcauuggguuccuacuucucguacaaccuggagcauccacgcccaucaccaguggaugacuacagaggauaugcugaccguguggaaccgagucuggauugaagacaauccauggauggaggauaagacgcccgugacaaccugggagaacguaccuuaccuuggaaaacgcgaagaccaguggugugguagucugaucggccucacuuccagagcgaccugggcucagaauauuccgacagccauccaacagguucggagcuuaauagggaacgaggaauuccuggauuacaugccaucuaugaagagguuucgcaaagaggaggaaucagagggagcaaucugguga

SEQ ID NO: 15432 - RNA, 9873 nt, Artificial Sequence
  derived and/or modified CDS sequence (opt3) from DENV-3__FJ024468__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggagugaucacccuguauuuaggcgccguuguccaggcagacauggguugugugauuaauuggaaagggaaggagcugaagugcggauccggcaucuucgugacuaacgagguccauacauggaccgaacaguacaaauuucaagccgauucucccaagcggcuagcuacugccauugcaggugcuugggagaauggcguuugugggauccgaagcaccacacgcauggaaaaccuccuguggaaacagauagccaaugagcuuaacuauaucuugugggaaaauaacauuaagcugacgguggugguaggagacaucauuggcguccucgagcaggggaaaagaacccugacuccacagccuauggaguuaaaguacucauggaaaacauggggaaaggcgaagaucgugaccgccgaaacacaaaacaguuccuucauaauugauggccccaauacuccagagugccccagcgcuucuagggcauggaacguuugggaaguggaggacuaugguuuuggggucuucaccacgaauaucuggcugaaacuucgggaaguguacacacaguugugugaccaccgccucaugucagccgcuguuaaggaugagagagccgugcacgcagacaugggauacuggauugagagucagaaaaacggcagcuggaagcuggaaaaagcgucccuaaucgagguaaagaccugcacuuggccuaagucucauacccuguggucgaaugguguccucgaaagcgauaugauaaucccaaaaucccuggccggcccgauuucacagcacaacuauaggcccggguaccauacacaaacugcuggaccuuggcaccuuggcaaguuggagcuggacuuuaauuauugcgaggggaccacaguggugaucacggaaaacuguggaacccguggcccaaguuuacggacuacaaccgucucugguaaacucauucacgaguggugcugucgaagcugcacucugcccccucuuagauacaugggggaagauggauguugguauggcauggagaucaggccaauauccgaaaaggaggagaauaugguuaaaucacuggugagcgccgguucuggcaagguagacaacuucacaauggggguguugugccucgcaauucuguuugaagaggucaugcgcggaaaguucggcaaaaagcauaugaucgcugggguguucuuuaccuucguucuacugcucuccggacagaucacguggcgggauauggcccacacucugauuaugaucggcaguaaugcaagcgacaaaauggguaugggggugaccuaccuugccuugauugcuacauuuaagauacagcccuuccuggcguuaggauuuuuccucagaaaacugaccucuagggaaaaccuucugcuaggcgucggccucgccauggcaacuacacugcaauugccggaggauaucgaacagauggcuaaugggauugcccugggauuaauggcccucaagcugaucacccaguuugagacauaucagcuuuggacugcucugauuuccuugaccuguucaaacacgauguucacacucaccguggcauggcgcacugccacccugauccuagcggguguuagucugcuuccugugugccaaagcucguccaugcgaaagacagacuggcucccaauggcugucgccgcaaugggcguacccccucugcccuuguuuauauucucucugaaagauacuuuaaagcggcguagcuggccacucaaugagggggugauggccguuggacuggugucaauccuugcuaguucccuguugagaaacgacgucccuauggcaggcccccucguggccggugggcugcuaauugcguguuacguaaucaccggaacgucugcugaucugacaguggaaaaagccgcagacauuaccugggaggaagaggccgaacagacuggcgucagccauaaccuuaugaucacaguugacgaugacggcaccaugaggauaaaggaugacgagacugagaauauucucacagugcuguugaaaaccgcuuuacugaucguguccggggucuuuccauacucaaucccggccacgcuccugguguggcacacuuggcagaagcagacccaacgcagcggaguucuuugggauguaccuagucccccagaaacacagaaagcagagcuggaagaggguguguaucggauuaagcagcagggcauauucgggaagacccaagucggagugggcguucagaaagaggguguguuucauacaauguggcacgucacuagaggggcuguguugaccuacaacggaaagaggcuagaacccaauugggccucuguaaaaaaggaccugaucuccuauggcggcggguggcgacucagcgcgcaguggcaaaaaggagaggaaguccaggugauugccguugagccugguaagaacccaaagaauuuccagacgaugcccggcacauuccagacuaccacaggggaaaucggagcaauugcucuggauuuuaaaccuggcaccucggguucaccgaucauaaaccgcgaggggaagguggucggacuuuacggcaauggcgugguuacuaaaaacgggggauaugugucugguaucgcccaaaccaaugcugagccagacggccccacaccugaauuagaggaagagauguucaagaaacggaaccugacgauuauggaucuccacccagggaguggaaagacuagaaaguacuugcccgcaaucgucagggaagccauuaaacgucgccugcggacccucauccuggccccuacaagagugguagcugcggagauggaggaagcacuuaagggccugccgauaagguaucagaccacugccacaaaauccgagcauaccggucgagaaauuguggacuugaugugccacgcuacguuuacuaugcggcuacugagccccguucgcgucccaaauuacaaccucaucaucauggaugaggcccauuucacagacccugcaucuauugccgcuagaggguacaucagcaccagggugggaaugggcgaagcggccgcaauauuuaugaccgcuacucccccaggcacagccgaugcauucccucaguccaaugcccccauucaggacgaggagcgggacaucccagaacgaucauggaacagugggaaugaguggauuaccgauuuugcuggaaagacagugugguucgucccgagcaucaaagccgguaacgacauagcgaacuguuuaagaaagaauggcaagaaaguaauucaacugucucgcaagacuuuugauacggaauaucagaaaaccaagcuuaacgacugggauuucgugguuacaacugacaucuccgagaugggggcaaauuuuaaagccgauagggugaucgacccucgucggugccugaagcccgucauucucaccgauggaccagagagagugaucuuggcuggccccaugccuguuacagccgcuucagcagcccagaggcgcggucgaguggggagaaacccacagaaggaaaaugaccaauacauuuucaccggccagccccugaacaaugaugaggaccacgcucauuggacugaagccaaaaugcuccuggacaacauaaauacgccugagggaaucauuccggcacuuuucgaaccagagcgggagaagagugcggccaucgauggcgaauauaggcuaaaaggggagagccgcaagaccuuugucgaacugaugcguagaggagacuugcccgugugguuagcucacaaaguagccuccgaggguaucaaguacacagaucggaaauggugcuucgacggccagaggaacaaucagauucuggaagagaacauggauguggagauauggacuaaggaaggggagaagaaaaagcuccgcccucgauggcuggacgcaagaaccuauucugauccccuugcucugaaagaauuuaaggacuucgccgcaggacggaaaucgaucgcccucgauuugguuacagagauuggcagggucccaagccaccuggcucaucgcaccagaaaugcgcuagacaaccuggugaugcuccacacuucagaacauggugggagggccuaccggcacgcaguggaggagcuuccugaaacaauggagacgcuguuauugcugggccucaugauccugcuuaccggaggcgcuaugcuguuucucauuuccgggaagggaaucgguaagacuaguauaggcuugaucugugucauugccucuagcgggaugcuguggauggccgaaauccccuuacaauggauugcauccgcuaucguucuagaguucuuuaugauggugcugcucauaccagagccugaaaaacagcguacaccgcaggauaaucaacuugccuauguagugauuggaauccugaccuuggcggcuauuaucgccgcaaacgagaugggccugcucgaaaccacaaagcgcgaccuggguaugucaaaagagcccggggucgugucuccaacuagcuaccuugauguugaccuccacccugccagugcuuggacgcuguacgcaguggccaccacagucauaacucccauguugcgacauaccaucgaaaauuccacagcgaacguaagccuggcugccauugcaaaccaggccgugguuuuaaugggccuagacaagggauggccaaucucuaaaauggaucugggcgugccucuccuugcucuggggugcuauucacaggucaaucccuugacccugacugccgcagugcuccugcuuauuacgcacuacgcuaucauaggaccgggcuuacaggccaaggcgacaagagaggcccaaaagaggaccgcagcugguauuaugaaaaacccaacugucgacgggaucaugaccaucgaucuggacccugugauuuaugauuccaaguucgagaaacagcucggacagguuauguugcuggugcuaugugccguacagcugcuccuuaugcggacaaguugggcacugugcgaagcuuugacucuggccaccggccccaucacaacgcucugggaggguagcccaggcaaguuuuggaauaccacuauagccgugucgauggcgaacauuuuccgcgggucuuaccuggcuggagcaggcuuagccuuuuccaucaugaaaagcgucgggacaggaaagagaggcaccgguucacaaggggaaacucuuggagagaaguggaaaaagaaacugaaucagcucaguaggaaggaauucgaccuauauaaaaagucuggcauuacagagguugaucggaccgaggcuaaagaaggucugaagcgaggcgagacgacccaucacgccguguccagagggacagcaaaguugcagugguuugucgaacgcaacauggugauccccgagggaaggguaauagaccugggcugugggcggggaggcuggagcuacuauugcgccggucucaaaaaggugacugaaguucguggguacaccaaaggaggcccuggccaugaggagccggugcccaugucaacauacggguggaauaucgucaagcuuaugaguggaaaagauguguucuaucugccaccugaaaagugugacacuuugcugugcgauauuggugagagcucccccucuccuaccgucgaagagagcagaacaaucagggugcucaagaugguugagccaugguuaaaaaacaaucaguucuguauuaagguacugaaccccuacaugccuaccgugaucgaacaccuugagcgccugcaacggaaacacggcgggaugcuaguccgaaauccacucuccagaaacucaacucaugaaauguauuggauuucuaauggaacgggcaacaucguggcuaguguuaauauggugucgaggcuguugcugaaccgcuuuacaaugacccaccggagacccacuauagagaaggacgucgaucucggugcggggacccgucaugugaacgccgaaccggagacaccuaauauggacguaauuggagagaggaucaaacggaucaaggaagagcacaacagcacguggcacuacgacgaugaaaauccauauaagaccugggcauaccauggcuccuaugaggugaaagcuacuggcucugccucaagcaugauuaacgggguugucaagcuucugacaaaacccugggacguggugccuauggucacccagauggcaaugacugauacaaccccauucggacagcaacgcguuuuuaaggaaaaaguggacacacgaacucccagauccaugccggguaccaggcggguaaugggcauaacggccgagugguuauggcgcacccuggggagaaauaagaagccuagguugugcacacgagaggaauucacuaaaaaggugcggaccaacgcugccaugggagcggucuuuacagaggaaaaucagugggauagugcaaaagccgcuguggaggacgaagauuucuggaagcucguugaccgugagagagagcugcacaaacuaggcaagugugguucuugcguguacaacaugauggggaaacgcgaaaagaagcuuggagaguuuggcaaagccaagggcagcagggcaaucugguacauguggcugggggcucgguaucucgaauucgaggcccugggauuuuugaaugaggaucauugguucucaagagaaaacuccuacaguggugucgagggcgaagggcugcacaaacucggauauauucuucgcgacaucagcaagauucccggcggugcuauguacgccgaugacacugcagggugggacaccaggaucacggaggaugaccugcauaaugaagagaaaauaacacagcagauggauccagagcaccgacaauuagcgaacgccaucuuuaagcugaccuaucagaauaaggugguaaaaguucagcggccuacucccacaggaaccgugauggacauuaucucuagaaaggaucagaggggcuccggccaagucgggacuuacggauugaacaccuucacaaauauggaagcucagcucauucgccagauggagggugaaggcgugcugucaaaagccgaccuagagaacccacaccuucccgaaaagaaaaucacgcaguggcuggagaccaaggggguggagcgucuccggagaauggcaauaagcggagaugacugcgucguuaagccuauugaugacagguuugcuaacgcccuguuggcauuaaaugauaugggcaaagugcgcaaggacaucccacaauggcagccgucgaaagguuggcaugauuggcagcagguacccuucuguucucaccauuuccacgaacugaucaugaaggacgggcgaaaacucguggucccuugccggccacaagacgagcuuauuggaagagccaggauaagucagggcgcgggcuggucccugcgcgaaacugcuugucuagggaaggccuaugcacagauguggagccugauguacuuucacagacgggaucucagguuggccucaaacgcuaucugcuccgccgugcccguucauugggugccuacaucucguaccacuuggagcauucacgcacaucaccaauggaugacaaccgaggacaugcugacggucuggaaucgaguguggaucgaagauaacccauggauggaggacaagacacccguaaccacuugggagaauguuccuuaccuuggaaaacgcgaagaucaguggugugguagucugauuggccucaccuccagagcuacaugggcccagaacaucccgacugcgauacagcaagugcggagcuuaaucgggaaugaggaauuccuggacuauaugccaucuaugaagagguuucgcaaagaggaggaaucagagggagcuauuugguga

SEQ ID NO: 15433 - RNA, 9873 nt, Artificial Sequence
  derived and/or modified CDS sequence (opt3) from DENV-3__FJ024470__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugccuugccagaggaacaggaccagaauuaugucuguaaacacacuuacguugaucgcgguugggggaacggaugcggccucuucggcaaggggagucuggugaccugcgcaaaguuucaauguuuagagcccauagagggaaaaguagugcaguaugaaaaucugaaguacacagucauuaucacugugcauaccggugaccagcaccagguuggcaacgagacacaaggggugaccgcugaaauuacuccucaggccuccacgacagaggcgauccucccagaauauggaacccuuggccuggagugcucuccgcgaacugguuuggacuucaaugagaugauccuacugaccaugaaaaacaaggccuggaugguccauagacagugguuuuucgaucucccccugccuuggacaagcggggcaaccacugaaacaccaacguggaauaggaaagagcuucuggugaccuuuaagaacgcucacgccaaaaagcaagaaguaguuguguugggcucccaggagggagcuaugcacacugcccucacaggcgcaaccgaaauucagaauucagggggaacaaguauauucgccggucaucugaagugucgguuaaaaauggacaagcuggagcuaaaaggcaugagcuacgcuaugugcacuaacaccuuuguccucaagaaagaggugucugaaacgcagcacgggaccauccugauuaaggucgaguacaagggagaagaugugcccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgcaggugcuugggagaauggcgucugugggauacgaagcaccacacgcauggaaaaccuccuguggaaacagaucgccaaugagcuuaacuauauuuugugggaaaauaacaucaagcugacgguuguggugggagacauuaucggcguacucgagcaggggaaaagaacccugacuccacagccuauggaguuaaaguacucauggaaaacauggggaaaggcgaagauagucaccgccgaaacacaaaacaguuccuucauuaucgauggccccaauacuccagagugccccagcgcuucuagggcauggaacgugugggaaguugaggacuaugguuuugggguguucaccacgaauauuuggcugaaacuucgggaagucuacacacaguugugugaccaccgccucaugucagccgcugugaaggaugagagagccguucacgcagacaugggauacuggaucgagagucagaaaaacggcagcuggaagcuggaaaaagcgucccuaauagaggugaagaccugcacuuggccuaagucucauacccuguggucgaaugguguacucgaaagcgauaugaucauuccaaaaucccuggccggcccgaucucacagcacaaccauaggcccggguaucacacacaaacugcuggaccuuggcaccuuggcaaguuggagcuggacuuuaauuacugcgaggggaccacagucgugauuacggaaaacuguggaacccguggcccaaguuuacggacuacaaccgugucugguaaacucauccaugaguggugcugucgaagcugcacucugcccccucuuagauauaugggggaagauggauguugguacggcauggagauaaggccaauuuccgaaaaggaggagaauauggucaaaucacugguuagcgccgguucuggcaagguggacaacuucacaauggggguauugugccucgcaauccuguuugaagaggugaugcgcggaaaguucggcaaaaagcacaugaucgcuggggucuucuuuaccuucgugcuacugcucuccggacagauuacguggcgggauauggcccauacucugaucaugauuggcaguaaugcaagcgacagaauggguauggggguuaccuaucuugccuugauagcuacauuuaaaauccagcccuuccuggcguuaggauuuuuccucaggaagcugaccucucgcgaaaaccuucugcuaggcgugggccucgccauggcaacuacacugcaauugccggaggauauugaacagauggcuaaugggaucgcccugggauuaauggcccucaaacugauuacccaguuugagacauaccagcuuuggacugcucugaucuccuugaccuguucaaacacgauauucacacucaccgucgcauggcgaacugccacccugauccuagcgggugugagucugcuuccuguuugccaaagcucguccaugcggaagacagacuggcucccaauggcuguggccgcaaugggcguccccccucugcccuuguuuauuuucucucugaaggauacuuuaaaacguagaagcuggccacucaaugaggggguaauggccgugggacugguuucaauccuugcuaguucccuguugaggaacgacgugccuauggcaggcccccucgucgccggugggcugcuaauugcguguuaugugaucaccggaacgucugcugaucugacaguagaaaaggccgcagacauaaccugggaggaagaggccgaacagacuggcgugagccacaaccuuaugauuacagucgacgaugacggcaccaugcgcaucaaagaugacgagacugagaauauccucacaguucuguugaagaccgcuuuacugauuguguccgggauauuuccauacucaaucccggccacgcuccugguguggcauacuuggcagaaacagacccaacggagcggaguccuuugggaugugccuagucccccagaaacacagaaggcagagcuggaagaggguguuuacagaauuaaacagcagggcaucuucgggaagacccaaguaggagugggcguccagaaggaggguguguuucacacaauguggcacguuacuaggggggcuguguugaccuauaacggaaaacgacuagaacccaauugggccucugucaagaaagaccugauuuccuacggcggcggguggcgccucagcgcgcaguggcaaaagggagaggaagugcagguaaucgccgucgagccugguaaaaacccaaagaauuuccagacgaugcccggcacauuccagacuaccacaggggaaauaggagcaaucgcucuggauuuuaagccuggcaccucggguucaccgauuaucaaccgggaggggaaagugguuggacuuuauggcaauggcguggucacuaagaacgggggauacgugucugguauugcccaaaccaaugcugagccagacggccccacaccugaauuagaggaagagauguucaaaaagagaaaccugacgaucauggaucuccauccagggaguggaaaaacuaggaaguauuugcccgcaauaguucgugaagccauuaagcgccggcugagaacccucauccuggccccuacaaggguggucgcugcggagauggaggaagcacuuaaaggccugccgauccgauaccagaccacugccacaaaguccgagcacaccggucgggaaauuguggacuugaugugccaugcuacguuuacuaugcgccuacugagccccguaagagugccaaauuauaaccucaucauaauggaugaggcccacuucacagacccugcaucuauugccgcuaggggguacaucagcacccggguuggaaugggcgaagcggccgcaauuuuuaugaccgcuacucccccaggcacagccgaugcauucccucaguccaaugcccccauccaggacgaggagcgagacauaccagaaagaucauggaacagugggaaugaguggauuaccgauuuugcuggaaaaacagucugguucgugccgagcaucaaggccgguaacgacaucgcgaacuguuuacgcaaaaauggcaagaaggugauucaacugucuaggaaaacuuuugauacggaauaccagaagaccaaacuuaacgacugggauuucgucguaacaacugacaucuccgagaugggggcaaauuuuaaggccgaucgugugauugacccucggagaugccugaaacccguuauacucaccgauggaccagagagggugaucuuggcuggccccaugccugucacagccgcuucagcagcccagcgccgagguagaguggggcggaacccacagaaggaaaaugaccaauauauuuucaccggccagccccugaacaaugaugaggaccaugcucacuggacugaagccaagaugcuccuggacaacaucaauacgccugagggaaucauuccggcacuuuucgaaccagagagggagaaaagugcggccauagauggcgaauaccgccuaaagggggagagccguaaaaccuuuguugaacugaugagacggggagacuugcccgugugguuagcucacaaggucgccuccgaggguaucaaauauacagauaggaaguggugcuucgacggccagcgcaacaaucagauucuggaagagaacauggauguggagaucuggacuaaagaaggggagaagaagaaacuccgaccuagauggcuggacgcacggaccuacucugauccccuugcucugaaggaauuuaaagacuucgccgcaggaaggaagucgauugcccucgauuugguaacagagaucggccgcgugccaagccaucuggcucacagaaccaggaaugcgcuagacaaccugguuaugcuccauacuucagaacacggugggcgggccuaucgucacgcagucgaggagcuuccugaaacaauggagacgcuguuauugcugggccucaugauacugcuuaccggaggcgcuaugcuguuucucaucuccgggaaaggaauugguaagacuaguaucggcuugauuugugugaucgccucuagcgggaugcuguggauggccgaaauacccuuacaauggauugcauccgcuaucgugcuagaguucuuuaugaugguccugcucauuccagagccugaaaagcagcgcacaccgcaggauaaucaacuugccuacguugugaucggaauacugaccuuggcggcuaucauugccgcaaacgagaugggccugcucgaaaccacaaaacgagaccuggguaugucaaaggagcccgggguagugucuccaacuagcuaucuugaugucgaccuccauccugccagugcuuggacgcuguacgcaguggccaccacaguuaucacucccauguugagacacaccauugaaaauuccacagcgaacgugagccuggcugccaucgcaaaccaggccgucguauuaaugggccuagacaaaggauggccaauaucuaagauggaucugggcgugccucuccuugcucuggggugcuacucacagguuaaucccuugacccugacugccgcagugcuccugcuuauuacgcauuaugcuaucaucggaccgggcuuacaggccaaagcgacaagggaggcccaaaagcggaccgcagcugguauuaugaagaacccaacugucgacgggaucaugaccauagaucuggacccugugauuuacgauuccaaauucgagaagcagcucggacaggucauguugcuggugcuaugugccguucagcugcuccuuaugcgcacaaguugggcacugugcgaagcuuugacucuggccaccggccccaucacaacgcucugggaggguagcccaggcaaauuuuggaauaccacuauugccgugucgauggcgaacaucuucagagggucuuaucuggcuggagcaggcuuagccuuuuccauaaugaagagcguagggacaggaaaaaggggcaccgguucacaaggggaaacucuuggagagaaguggaagaaaaagcugaaucagcucagucggaaagaauucgaccuauacaagaaaucuggcaucacagagguggaucgaaccgaggcuaaggaaggucugaaaagaggcgagauuacgcaccaugccgucucccgcgggagcgcaaaguugcagugguuuguugaaaggaacauggugauccccgagggacgggucauugaccugggcugugggcguggaggcuggucauauuacugcgccggucucaagaaagugaccgaaguaagaggguauacaaagggaggcccuggccacgaggagccggugcccaugaguacuuacggguggaauaucguuaaacuuaugagcggaaaggauguguucuaccugccaccugaaaaaugugacaccuugcugugcgauauuggugaguccucucccagcccuacagucgaagaguccaggacuauccgcgugcucaagauggucgagccaugguuaaagaacaaucaguucuguauaaaagugcugaaccccuauaugccuaccguuauugaacaccuugagcggcugcaacgaaagcauggcgggaugcuaguaagaaauccacucucaaggaacucuacacacgaaauguacuggaucaguaauggaaccggcaacaucguggcuucggucaauauggugagccgccuguugcugaaccgguuuacuaugacgcauagacgucccacaauugagaaagacguugaucucggugcggggaccaggcacgugaacgccgaaccggagacuccuaauauggacgucauaggagagcggaucaagcgcauuaaagaagagcacaacuccaccuggcauuaugacgaugaaaauccauacaagacaugggcauaucacggcucuuacgaggugaaggcuacgggcucagccagcuccaugaucaacgggguagugaaacuucugaccaagcccugggacguugucccuauggugacucagauggcaaugacagauaccacuccauucggacagcaacgaguguuuaaagaaaaggucgacacaagaacccccaggaguaugccggguacacggcgcguuaugggcauuacugccgagugguuauggagaacccuggggaggaauaaaaagccucgauugugcacgcgggaggaauucaccaagaaagugcguacaaacgcugccaugggagcgguauuuacugaggaaaaucagugggauucugcaaaggccgcuguggaggacgaagauuucuggaaacucgucgacagagagcgcgagcugcauaagcuaggcaaaugugguagcugcguguauaacaugauggggaagagggaaaaaaagcuuggagaguuuggcaaggccaaaggcucacgggcaaucugguacauguggcugggggcuagauaccucgaauucgaggcccugggauuuuugaaugaggaucacugguucucccgcgaaaacaguuauagcgguguugagggcgaagggcugcauaagcucggauacauacuuagggacaucucuaaaauucccggcggugcuauguaugccgaugacaccgcagggugggacacacgaaucacugaggaugaccugcacaaugaagagaagauuacccagcagauggauccagagcaccggcaauuagcgaacgccaucuuuaaacugacguaccagaauaagguggucaaggugcagagaccuacacccaccggaacuguaauggacauaauuuccaggaaagaucagcgcggcucaggccaaguugggacauauggauugaacaccuucacuaauauggaagcucagcucauccgucagauggagggugaaggcgugcugagcaaggccgaccuagagucgcaucaccuuccagaaaaaaagaucacccaguggcuggagacaaaaggggucgagcggcucaagagaauggcaauuucuggagaugacugcguggugaagcccauagaugacagguuugcuaacgcccuguuggcauuaaacgauaugggcaaaguccgcaaggacaucccucaauggcagccaaguaaagguuggcaugauuggcagcagguuccguucuguucccaccacuuccaugaacugauuaugaaggacgggcgaaaacucgugguacccugccggccucaagacgagcuuaucggaagagccaggauuagccagggcgcgggcuggucacugcgcgaaacggcuugucuagggaaggccuacgcacagauguggucccugauguauuuucacagacgggaucucagguuggccucuaaugcuaucugcagcgccgugccaguccauugggugcccaccagucguacuacaugguccauacacgcacaucaccaauggaugaccacugaggacaugcugacaguuuggaaccgaguguggaucgaagauaauccuuggauggaggacaagaccccagucacgacaugggagaacgugcccuaccuuggaaaacgcgaagaucaguggugugguagccugauuggccucaccucuagagcuacuugggcccagaauaucccuaccgcgauucagcaaguacggucauuaaucgggaacgaggaauuccuggacuacaugccgaguaugaagagguuucgcaaagaggaggaauccgagggagcuauuugguga

SEQ ID NO: 15434 - RNA, 9873 nt, Artificial Sequence
  derived and/or modified CDS sequence (opt3) from DENV-3__FJ024471__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugccuugccagaggaacaggaccagaauuaugucuguaaacacacuuacguugaucgcgguugggggaacggaugcggccucuucggcaaggggagucuggugaccugcgcaaaguuucaauguuuagagcccauagagggaaaaguagugcaguaugaaaaucugaaguacacagucauuaucacugugcauaccggugaccagcaccagguuggcaacgagacacaaggggugaccgcugaaauuacuccucaggccuccacgacagaggcgauccucccagaauauggaacccuuggccuggagugcucuccgcgaacugguuuggacuucaaugagaugauccuacugaccaugaaaaacaaggccuggaugguccauagacagugguuuuucgaucucccccugccuuggacaagcggggcaaccacugaaacaccaacguggaauaggaaagagcuucuggugaccuuuaagaacgcucacgccaaaaagcaagaaguaguuguguugggcucccaggagggagcuaugcacacugcccucacaggcgcaaccgaaauucagaauucagggggaacaaguauauucgccggucaucugaagugucgguuaaaaauggacaagcuggagcuaaaaggcaugagcuacgcuaugugcacuaacaccuuuguccucaagaaagaggugucugaaacgcagcacgggaccauccugauuaaggucgaguacaagggagaagaugugcccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgcaggugcuugggagaauggcgucugugggauacgaagcaccacacgcauggaaaaccuccuguggaaacagaucgccaaugagcuuaacuauauuuugugggaaaauaacaucaagcugacgguuguggugggagacauuaucggcguacucgagcaggggaaaagaacccugacuccacagccuauggaguuaaaguacucauggaaaacauggggaaaggcgaagauagucaccgccgaaacacaaaacaguuccuucauuaucgauggccccaauacuccagagugccccagcgcuucuagggcauggaacgugugggaaguugaggacuaugguuuugggguguucaccacgaauauuuggcugaaacuucgggaagucuacacacaguugugugaccaccgccucaugucagccgcugugaaggaugagagagccguucacgcagacaugggauacuggaucgagagucagaaaaacggcagcuggaagcuggaaaaagcgucccuaauagaggugaagaccugcacuuggccuaagucucauacccuguggucgaaugguguacucgaaagcgauaugaucauuccaaaaucccuggccggcccgaucucacagcacaaccauaggcccggguaucacacacaaacugcuggaccuuggcaccuuggcaaguuggagcuggacuuuaauuacugcgaggggaccacagucgugauuacggaaaacuguggaacccguggcccaaguuuacggacuacaaccgugucugguaaacucauccaugaguggugcugucgaagcugcacucugcccccucuuagauauaugggggaagauggauguugguacggcauggagauaaggccaauuuccgaaaaggaggagaauauggucaaaucacugguuagcgccgguucuggcaagguggacaacuucacaauggggguauugugccucgcaauccuguuugaagaggugaugcgcggaaaguucggcaaaaagcacaugaucgcuggggucuucuuuaccuucgugcuacugcucuccggacagauuacguggcgggauauggcccauacucugaucaugauuggcaguaaugcaagcgacagaauggguauggggguuaccuaucuugccuugauagcuacauuuaaaauccagcccuuccuggcguuaggauuuuuccucaggaagcugaccucucgcgaaaaccuucugcuaggcgugggccucgccauggcaacuacacugcaauugccggaggauauugaacagauggcuaaugggaucgcccugggauuaauggcccucaaacugauuacccaguuugagacauaccagcuuuggacugcucugaucuccuugaccuguucaaacacgauauucacacucaccgucgcauggcgaacugccacccugauccuagcgggugugagucugcuuccuguuugccaaagcucguccaugcggaagacagacuggcucccaauggcuguggccgcaaugggcguccccccucugcccuuguuuauuuucucucugaaggauacuuuaaaacguagaagcuggccacucaaugaggggguaauggccgugggacugguuucaauccuugcuaguucccuguugaggaacgacgugccuauggcaggcccccucgucgccggugggcugcuaauugcguguuaugugaucaccggaacgucugcugaucugacaguagaaaaggccgcagacauaaccugggaggaagaggccgaacagacuggcgugagccacaaccuuaugauuacagucgacgaugacggcaccaugcgcaucaaagaugacgagacugagaauauccucacaguucuguugaagaccgcuuuacugauuguguccgggauauuuccauacucaaucccggccacgcuccugguguggcauacuuggcagaaacagacccaacggagcggaguccuuugggaugugccuagucccccagaaacacagaaggcagagcuggaagaggguguuuacagaauuaaacagcagggcaucuucgggaagacccaaguaggagugggcguccagaaggaggguguguuucacacaauguggcacguuacuaggggggcuguguugaccuauaacggaaaacgacuagaacccaauugggccucugucaagaaagaccugauuuccuacggcggcggguggcgccucagcgcgcaguggcaaaagggagaggaagugcagguaaucgccgucgagccugguaaaaacccaaagaauuuccagacgaugcccggcacauuccagacuaccacaggggaaauaggagcaaucgcucuggauuuuaagccuggcaccucggguucaccgauuaucaaccgggaggggaaagugguuggacuuuauggcaauggcguggucacuaagaacgggggauacgugucugguauugcccaaaccaaugcugagccagacggccccacaccugaauuagaggaagagauguucaaaaagagaaaccugacgaucauggaucuccauccagggaguggaaaaacuaggaaguauuugcccgcaauaguucgugaagccauuaagcgccggcugagaacccucauccuggccccuacaaggguggucgcugcggagauggaggaagcacuuaaaggccugccgauccgauaccagaccacugccacaaaguccgagcacaccggucgggaaauuguggacuugaugugccaugcuacguuuacuaugcgccuacugagccccguaagagugccaaauuauaaccucaucauaauggaugaggcccacuucacagacccugcaucuauugccgcuaggggguacaucagcacccggguuggaaugggcgaagcggccgcaauuuuuaugaccgcuacucccccaggcacagccgaugcauucccucaguccaaugcccccauccaggacgaggagcgagacauaccagaaagaucauggaacagugggaaugaguggauuaccgauuuugcuggaaaaacagucugguucgugccgagcaucaaggccgguaacgacaucgcgaacuguuuacgcaaaaauggcaagaaggugauucaacugucuaggaaaacuuuuaacacggaauaccagaagaccaaacuuaaugauugggacuucgucguaacaacugauaucuccgagaugggggcaaacuuuaaggccgaccgugugauugauccucggagaugccugaaacccguuauacucaccgacggaccagagagggugaucuuggcuggccccaugccugucacagccgcuucagcagcccagcgccgagguagaguggggcggaauccacagaaggaaaacgaucaauauauuuucaccggccagccccugaauaacgacgaggaucaugcucacuggacugaagccaagaugcuccuggacaauaucaacacgccugagggaaucauuccggcacuuuucgaaccagagagggagaaaagugcggccauagacggcgaauaccgccuaaagggggagagccguaaaaccuuuguugaacugaugagacggggagauuugcccgugugguuagcucacaaggucgccuccgaggguaucaaauauacagacaggaaguggugcuucgauggccagcgcaauaaccagauucuggaagagaauauggacguggagaucuggacuaaagaaggggagaagaagaaacuccgaccuagauggcuggaugcacggaccuacucugacccccuugcucugaaggaauuuaaagauuucgccgcaggaaggaagucgauugcccucgacuugguaacagagaucggccgcgugccaagccaucuggcucacagaaccaggaacgcgcuagauaaucugguuaugcuccauacuucagaacacggugggcgggccuaucgucacgcagucgaggagcuuccugaaacaauggagacgcuguuauugcugggccucaugauacugcuuaccggaggcgcuaugcuguuucucaucuccgggaaaggaauugguaagacuaguaucggcuugauuugugugaucgccucuagcgggaugcuguggauggccgaaauacccuuacaauggauugcauccgcuaucgugcuagaguucuuuaugaugguccugcucauuccagagccugaaaagcagcgcacaccgcaggacaaccaacuugccuacguugugaucggaauacugaccuuggcggcuaucauugccgcaaaugagaugggccugcucgaaaccacaaaacgagaucuggguaugucaaaggagcccgggguagugucuccaacuagcuaucuugacgucgaucuccauccugccagugcuuggacgcuguacgcaguggccaccacaguuaucacucccauguugagacacaccauugaaaacuccacagcgaacgugagccuggcugccaucgcaaaucaggccgucguauuaaugggccuagacaaaggauggccaauaucuaagauggaccugggcgugccucuccuugcucuggggugcuacucacagguuaaccccuugacccugacugccgcagugcuccugcuuauuacgcauuaugcuaucaucggaccgggcuuacaggccaaagcgacaagggaggcccaaaagcggaccgcagcugguauuaugaagaauccaacugucgaugggaucaugaccauagaccuggauccugugauuuacgacuccaaauucgagaagcagcucggacaggucauguugcuggugcuaugugccguucagcugcuccuuaugcgcacaaguugggcacugugcgaagcuuugacucuggccaccggccccaucacaacgcucugggaggguagcccaggcaaauuuuggaacaccacuauugccgugucgauggcgaauaucuucagagggucuuaucuggcuggagcaggcuuagccuuuuccauaaugaagagcguagggacaggaaaaaggggcaccgguucacaaggggaaacucuuggagagaaguggaagaaaaagcugaaccagcucagucggaaagaauucgaucuauacaagaaaucuggcaucacagagguggaccgaaccgaggcuaaggaaggucugaaaagaggcgagauuacgcaccaugccgucucccgcgggagcgcaaaguugcagugguuuguugaaaggaauauggugauccccgagggacgggucauugaucugggcugugggcguggaggcuggucauauuacugcgccggucucaagaaagugaccgaaguaagaggguauacaaagggaggcccuggccacgaggagccggugcccaugaguacuuacggguggaacaucguuaaacuuaugagcggaaaggacguguucuaccugccaccugaaaaaugugauaccuugcugugcgacauuggugaguccucucccagcccuacagucgaagaguccaggacuauccgcgugcucaagauggucgagccaugguuaaagaauaaccaguucuguauaaaagugcugaaucccuauaugccuaccguuauugaacaccuugagcggcugcaacgaaagcauggcgggaugcuaguaagaaacccacucucaaggaauucuacacacgaaauguacuggaucaguaacggaaccggcaauaucguggcuucggucaacauggugagccgccuguugcugaaccgguuuacuaugacgcauagacgucccacaauugagaaagauguugaccucggugcggggaccaggcacgugaaugccgaaccggagacuccuaacauggaugucauaggagagcggaucaagcgcauuaaagaagagcacaauuccaccuggcauuaugacgacgaaaacccauacaagacaugggcauaucacggcucuuacgaggugaaggcuacgggcucagccagcuccaugaucaaugggguagugaaacuucugaccaagcccugggauguugucccuauggugacucagauggcaaugacagacaccacuccauucggacagcaacgaguguuuaaagaaaaggucgauacaagaacccccaggaguaugccggguacacggcgcguuaugggcauuacugccgagugguuauggagaacccuggggaggaacaaaaagccucgauugugcacgcgggaggaauucaccaagaaagugcguacaaaugcugccaugggagcgguauuuacugaggaaaaccagugggacucugcaaaggccgcuguggaggaugaagacuucuggaaacucgucgauagagagcgcgagcugcauaagcuaggcaaaugugguagcugcguguauaauaugauggggaagagggaaaaaaagcuuggagaguuuggcaaggccaaaggcucacgggcaaucugguacauguggcugggggcuagauaccucgaauucgaggcccugggauuuuugaacgaggaccacugguucucccgcgaaaauaguuauagcgguguugagggcgaagggcugcauaagcucggauacauacuuagggauaucucuaaaauucccggcggugcuauguaugccgacgauaccgcagggugggacacacgaaucacugaggacgaucugcacaacgaagagaagauuacccagcagauggacccagagcaccggcaauuagcgaaugccaucuuuaaacugacguaccagaacaagguggucaaggugcagagaccuacacccaccggaacuguaauggauauaauuuccaggaaagaccagcgcggcucaggccaaguugggacauauggauugaauaccuucacuaacauggaagcucagcucauccgucagauggagggugaaggcgugcugagcaaggccgaucuagagucgcaucaccuuucugaaaaaaagaucacccaguggcuggagacaaaaggggucgagcggcucaagagaauggcaauuaguggagacgauugcguggugaagccaauagacgauagguuugcuaacgcccuguuggcauuaaaugacaugggcaaaguccgcaaggauaucccccaauggcagccuuccaaagguuggcaugacuggcagcagguuccauucuguagccaccacuuccaugaacugauuaugaaggaugggcgaaaacucgugguaccgugccggccccaagacgagcuuaucggaagagccaggauuucacagggcgcgggcuggucccugcgcgaaacggcuugucuagggaaggccuacgcacagauguggucucugauguauuuucacagacgggaccucagguuggccagcaacgcuaucugcagugccgugccuguccauugggugccaaccucccguacuacauggagcauacacgcacaucaccaauggaugaccacugaggauaugcugacaguuuggaaucgaguguggaucgaagacaaccccuggauggaggauaagaccccugucacgacaugggagaaugugccauaccuuggaaaacgcgaagaccaguggugugguucucugauuggccucaccucaagagcuacuugggcccagaacauccccaccgcgauucagcaaguacggaguuuaaucgggaaugaggaauuccuggauuacaugccuuccaugaagagguuucgcaaagaggaggaaagcgagggagcuauuugguga

SEQ ID NO: 15435 - RNA, 9873 nt, Artificial Sequence
  derived and/or modified CDS sequence (opt3) from DENV-3__FJ182005__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaagugccuuucuccacagaggacggccaagguaaggcucauucagggcgucuuaucacugcgaacccaguagucaccaaaaaggaggaacccgugaauauagaggcagaaccgccuuucggcgagagcaacauuguuaucggaaucggcgauaaugccuugaaaauuaacugguauaagaaggggaguucuaucggaaaaauguuugaagcuacagcccgcggugcaagaaggauggccauucugggcgacacugcuugggauuucggguccgugggaggcguccucaauagccuggguaagauggugcaccagauauuugggucggccuacaccgcacuuuucucuggcguauccugggugaugaaaaucggaauuggcauccuguugacguggaucgggcucaacucaaagaauacaaguaugagcuuuuccugcauuguuauaggaaucauuacccuguauuuaggcgcggucgugcaggcugacauggguugugugaucaacuggaaagggaaggagcugaagugcggaucuggcauuuucgucacuaaugagguucauacauggaccgaacaguacaaauuucaagccgauagccccaagcggcuagcaacugccaucgcuggugccugggagaacggcgugugugggauacgaucaaccacacgcauggaaaaucuccuguggaaacagaucgcaaacgagcuuaauuauauuuugugggaaaacaauaucaagcugacggugguagucggagacauuaucggcgugcucgagcaggggaaaagaacccugacuccacagccuauggaguuaaaguacaguuggaaagcuuggggaaaggccaagauaguuacagcggaaacccaaaacuccagcuucauuaucgauggccccaacacaccagagugccccucugccucaagggcuuggaaugugugggaagucgaggacuaugguuuugggguguucacuaccaacauuuggcugaaacuucgggaaguuuacacgcaguugugugaccaccgccucaugagugcagccgugaaggaugagagagcuguacacgccgacaugggauacuggaucgagagccagaaaaauggcuccuggaagcuggaaaaagcaucucuaauagaggucaagacaugcaccuggccuaagucgcauacucuguggagcaacggugugcucgaauccgauaugaucauuccaaaaucacuggcgggcccgaucagucagcacaauuauaggcccggguaccauacccaaacagccggaccuuggcaccuuggcaaguuggagcuggacuuuaacuauugcgaggggacuaccguggucauuacagaaaauuguggaacgcguggcccaucuuuacggaccacuacaguuagcgguaaacucauccacgaguggugcugucgauccugcacccugcccccucuuagauacaugggggaagauggauguugguauggcauggagauaaggccaauuucagaaaaggaggagaacauggugaaaagccugguaucugcugguuccggcaagguggacaauuucacuaugggggucuugugccucgccauccuguuugaagaggugaugcgcggaaaguucggcaaaaagcauaugaucgcagggguuuucuuuacauucgugcuacugcucaguggacagauuaccuggcgggauauggcucacacgcugaucaugauuggcagcaacgccucugacagaauggguaugggggucacuuaccuugcauugauagccaccuuuaaaauccagcccuuccuggcuuuaggauuuuuccucaggaagcugacaucccgcgaaaaucuucugcuaggcgugggccucgcgauggccaccacucugcaauugccggaggauauugaacagauggcaaacgggaucgcucugggauuaauggcccucaaacugauuacacaguuugagaccuaucagcuuuggacagcccugaucucauugacuuguaguaauaccauauucacgcucacaguugcuuggcgaaccgcaacucugauccuagccggugugagccugcuuccugucugccaaucguccucuaugcggaagaccgacuggcucccaaugacaguagcggcuaugggcgugcccccucugcccuuguuuauuuucagccugaaggauacuuuaaaacguagaucauggccacucaacgaggggguuauggccgugggacuggucaguauccuugcauccucucuguugaggaaugacgugccuauggccggcccccucguagcuggugggcugcuaauugcauguuacgugaucaccggaacgagcgccgaucugacagucgaaaaggcggcugacguuaccugggaggaagaggccgaacagacuggcgugucccauaaccuuaugauaacaguggacgaugacggcaccaugcgcauuaaagaugacgagacugagaacauccucacaguccuguugaagaccgcauuacugaucgugucagggauuuuuccauacagcauaccggccacgcuccugguuuggcacacuuggcagaaacagacccaacggaguggaguacuuugggaugugccuucucccccagaaacacagaaggcugagcuggaagagggugucuauagaaucaaacagcagggcauuuucgggaagacccaagugggaguuggcgugcagaaggagggugucuuucauacaauguggcacgugacuaggggggccguauugaccuacaauggaaaacgacuagaacccaacugggcauccgucaagaaagaccugaucagcuauggcggcggguggcgccucucggcucaguggcaaaagggagaggaagugcagguuauugccguggagccugguaaaaauccaaagaacuuccagacgaugcccggcacauuccagacuaccacaggggaaaucggagcgauagcccuggauuuuaagccuggcaccucagguucuccgaucauuaaucgggaggggaaagucgugggacuuuacggcaacggcguugugacuaagaaugggggauaugucagugguaucgcacaaaccaacgcugagccagacggccccacaccugaauuagaggaagagauguucaaaaagagaaaucugacgauuauggaucuccacccaggguccggaaaaacuaggaaguacuugcccgccaucgugcgugaagcuauaaagcgccggcugagaacccucauucuggcaccuacaaggguaguggccgccgagauggaggaagcucuuaaaggccugccgauccgauaucagaccacugcgacaaagagcgagcauaccggucgggaaaucguugacuugaugugccacgcaacguuuacuaugcgccuacugucucccgucagagugccaaacuacaaucucauuaucauggaugaggcccauuucacagacccugcuagcauagccgcaaggggguacauuuccacccgggugggaaugggcgaagccgcugcgaucuuuaugaccgccacucccccaggcacagcagaugcuuucccucagucaaacgcccccauucaggacgaggagcgagacaucccagaaagaaguuggaauagcgggaacgaguggauaaccgauuuugcaggaaaaacagucugguucguaccgucuauuaaggccgguaaugacaucgcuaacuguuuacgcaaaaacggcaagaaggugauccaacuguccaggaaaacuuuugauacggaauaucagaagaccaaacuuaaugacugggauuucguugugacaacugacauuucagagaugggggccaacuuuaaggcggaucgugucaucgacccucggagaugccugaaacccgugauucucaccgauggaccagagaggguuauauuggcaggccccaugccugugacagccgcuagugccgcucagcgccgagguagagucgggcggaauccacagaaggaaaacgaccaauacaucuucaccggccagccccugaauaacgaugaggaccacgcacauuggacugaagccaagaugcuccuggacaauauuaacacgccugagggaaucaucccggcucuuuucgaaccagagagggagaaaagcgccgcaauugauggcgaauaucgccuaaagggggagucccguaaaaccuuuguggaacugaugagacggggagacuugcccguaugguuagcgcacaagguggccucugaggguauaaaauacacagauaggaaguggugcuucgacggccagcgcaauaaccagauccuggaagagaauauggauguugagauuuggacuaaagaaggggagaagaagaaacuccgaccuagauggcuggacgcucggaccuauucggauccccuugcccugaaggaauuuaaagacuucgcagcuggaaggaagagcaucgcccucgauuuggucacagagauuggccgcgugccaucacaccuggcacauagaaccaggaacgcccuagacaaucuggugaugcuccacacuuccgaacauggugggcgggcuuaccgucacgcggucgaggagcuuccugaaacaauggagacgcuguuauugcugggccucaugauccugcuuaccggaggcgccaugcuguuucucauaagugggaaaggaaucgguaagacuucuauuggcuugaucuguguuauugcaagcuccgggaugcuguggauggcugaaauccccuuacaauggauagccucagccauugugcuagaguucuuuaugaugguacugcucaucccagagccugaaaagcagcgcacaccgcaggauaaccaacuugcauauguggucauuggaauccugaccuuggcugccauaaucgcggcuaaugagaugggccugcucgaaaccacaaaacgagaccuggguaugucuaaggagcccggggugguuagcccaacuaguuaccuugauguggaccuccacccugccuccgcauggacgcuguacgccgucgcuaccacaguaauuacucccauguugagacauaccaucgaaaacagcacagcaaaugugucucuggccgcgauugcuaaccaggccguuguguuaaugggccuagacaaaggauggccaaucucaaagauggaucugggcgucccucuccuugcacuggggugcuauucccaggugaaccccuugacccugacugccgcuguccuccugcuuauaacgcacuacgccauuaucggaccgggcuuacaggcaaaagcuacaagggaggcccaaaagcggaccgcggccgguaucaugaagaauccaacuguggacgggauuaugaccaucgaucuggacccuguuauauaugauaguaaauucgagaagcagcucggacaggugauguugcugguacuaugugcagugcagcugcuccuuaugcgcacaagcugggcucugugcgaagccuugacucuggcaaccggccccauuacaacgcucugggaggguucgccaggcaaauuuuggaacaccacuaucgcugucucuauggccaauauuuucagaggguccuaccuggccggagcgggcuuagcuuuuagcaucaugaagucaguugggacaggaaaaaggggcaccgguagucaaggggaaacucuuggagagaaguggaagaaaaagcugaaccagcucucucggaaagaauucgaccuauauaagaaauccggcauaacagagguggaucgaaccgaggcaaaggaaggucugaaaagaggcgagaucacgcaucacgccgucagccgcgggucagcuaaguugcagugguuuguggaaaggaauaugguaauucccgagggacgggugaucgaccugggcugugggcguggaggcuggaguuacuauugcgccggucucaagaaaguuaccgaagugagaggguacacaaagggaggcccuggccaugaggagccgguccccaugagcacuuacggguggaacauugugaaacuuauguccggaaaggaugucuucuaucugccaccugaaaaaugugacaccuugcugugcgauaucggugagucuagccccuccccuacaguggaagagucaaggacuauucgcguucucaagaugguagagccaugguuaaagaauaaccaguucuguaucaaagugcugaaucccuacaugccuaccgucauagaacaccuugagcggcugcaacgaaagcacggcgggaugcuagugagaaacccacucucuaggaauaguacacaugaaauguauuggauuucgaacggaaccggcaauaucguugcaagcgugaacauggucucccgccuguugcugaaucgguuuacuaugacgcacagacgucccacaaucgagaaagacguggaucucggugccgggaccaggcauguaaacgcugaaccggagacuccuaacauggacgugauuggagagcggauaaagcgcaucaaagaagagcacaauucuaccuggcacuacgacgaugaaaacccauauaagacaugggcguaccauggcucauaugagguuaaggccacgggcagcgcauccaguaugauuaauggggucgugaaacuucugaccaagcccugggacguggucccuaugguuacucagauggcuaugacagauaccacuccauucggacagcaacgaguguuuaaagaaaagguagacacaagaacccccaggucuaugccggguacacggcgcgugaugggcaucacugccgagugguuauggagaacccuggggaggaacaaaaagccucgauugugcacgcgggaggaauucaccaagaaaguccguacaaaugcagccaugggagcuguguuuacugaggaaaaccagugggauagcgccaaggcggcaguugaggacgaagauuucuggauucucguggacagagagcgcgagcugcacaaacuaggcaagugugguucaugcgucuacaauaugauggggaaaagggaaaagaaacuuggagaguuuggcaaggccaagggcucccgggcuaucugguacauguggcugggggccagauaucucgaauucgaggcacugggauuuuugaacgaggaucauugguucagucgcgaaaauagcuacucugguguggagggcgaagggcugcacaaacucggauauauacuuagggacaucuccaagauucccggcggugcuauguacgccgaugacaccgcugggugggacacacgaaucacugaggaugaccugcauaacgaagagaaaauuacccagcagauggauccagagcaccggcaauuagccucagcaaucuuuaagcugacguaucagaauaaaguaguuaaggugcagagaccuacacccaccggaacugucauggacauaauuagcaggaaggaucagcgcggcucgggccaaguggggacauacggauugaacaccuucacuaauauggaagcgcagcucauccgucagauggagggugaaggcgugcugucuaaagccgaccuagagaacccacaccuucccgaaaagaaaaucacccaguggcuggagacaaagggggucgagcggcucaaaagaauggcuauuaguggagaugacugcguugugaagccuauagaugacagguuugccaaugcacuguuggcuuuaaacgauaugggcaagguacgcaaagacaucccacaauggcagccguccaaggguuggcaugauuggcagcaggugcccuucuguagccaccauuuccacgaacugauuaugaaagacgggcgaaagcucgucgugccuugccggccacaagacgagcuuaucggaagagccaggauuucacagggcgcaggcuggucccugcgcgaaacggccugucuagggaaagcguaugcucagauguggucucugauguacuuucacagacgggaucucagguuggccagcaacgcaaucugcagugccguucccgugcauugggucccuaccucccguacuacauggagcauacacgcucaucaccaauggaugaccacugaggacaugcugacaguguggaaucgaguauggaucgaagauaacccauggauggaggacaagacccccguuacgacaugggagaaugugccuuaccuuggaaagcgcgaagaucaguggugugguucucugauuggccucaccucaagagccacuugggcacagaacaucccgaccgcuauucagcaaguccggaguuuaaucgggaaugaggaauuccuggacuauaugccauccaugaaaagguuucgcaaggaggaggaaagcgagggagccauuugguga

SEQ ID NO: 15436 - RNA, 9873 nt, Artificial Sequence
  derived and/or modified CDS sequence (opt3) from DENV-3__FJ373302__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauugcugaaguugagccggaagacaucgauugcugguguaaccugacuaguaccugggugacauaugggaccugcaaucaggccggagagcaccgccgagacaagcguagcguagcacuugccccccaugugggcaugggucuggauacuagaacacaaaccuggauguccgcugagggggcauggaggcaggucgaaaaaguggagacgugggccuugcggcacccuggauucacuauucucgcucuguuucuggcccauuacaucggcaccucucucacacagaagguugugauauucaucuuacugaugcuugucacuccaucgaugaccaugcgcugugugggcguagggaacagagacuuuguugaaggauugucaggugcgacauggguggaugucgugcuggagcacggcgggugcgugaccacgauggcaaagaauaaacccacucuagacauugagcuccagaagacagaagccacccaacuggcuacucuuaggaaacuguguaucgagggaaagauuacaaacaucaccacggauagccggugcccuacccagggcgaagccgucuugccagaggaacaggaccagaauuauguuuguaaacacacauacguggaucgcgguugggggaacggaugcggccucuucggcaaggggagucugguaacuugcgcaaaguuucaauguuuagagcccauagagggaaaagugguccaguaugaaaaucugaaguacaccgugauuaucacaguucauacuggugaccagcaccaggugggcaacgagacccaaggggucacagcugaaauuaccccucaggccuccacuacggaggcgauccucccagaauauggaacacuuggccuggagugcucuccgcgaaccgguuuggacuucaaugagaugauccuacugacuaugaaaaacaaggccuggauggugcauagacagugguuuuucgaucucccccugccuuggaccagcggggcaacaaccgaaacuccaacauggaauaggaaagagcuucugguaacguuuaagaacgcucacgccaaaaagcaagaaguuguggucuugggcucccaggagggagcuaugcacaccgcccucacuggcgcaacagaaauucagaauucagggggaaccaguauauucgccggucaucugaagugucgguuaaaaauggacaagcuggagcuaaaaggcaugagcuacgcuaugugcacaaacacuuuugugcucaagaaagaggucucugaaacccagcacgggacgauccugauuaagguggaguacaagggagaagaugcgcccuguaaaaucccuuucuccaccgaggacggccaagguaaggcacauaacgggcgucuuauaacagccaauccaguugugacuaaaaaggaggaacccguaaacauugaggcugaaccgccuuucggcgagucaaauaucgucaucggaauuggcgauaacgccuugaaaaucaauugguauaagaaggggagcaguauuggaaaaauguuugaagcaaccgcccgcggugcuagaaggauggccauacugggcgacacagcaugggauuucgggucugugggaggcguucucaacucccuggguaagauggugcaccagaucuuugggagcgcguacacugcucuuuucucgggcgucucuugggugaugaaaauuggaaucggcguacuguugaccuggaucgggcucaauuccaagaacacgucaaugaguuuuagcugcauugccauaggaaucauuacacuguauuuaggcgcagugguucaggccgacaccgguugugucaucaauuggaaagggaaggagcugaagugcggauccggcauuuucgugacuaacgaggugcauacauggaccgaacaguacaaauuucaagcugauucucccaagcggcuagccacugcaaucgcuggugccugggagaauggcgucugugggauacgaagcaccacacgcauggaaaaccuccuguggaaacagaucgcgaaugagcuuaacuauauuuugugggaaaauaacaucaagcugacgguuguggugggagacauuaucggcguacucgagcaggggaaaagaacccugacuccacagccuauggaguuaaaguacucauggaaaacauggggaaaggccaagauagucaccgcugaaacacaaaacaguuccuucauuaucgauggccccaauacuccagagugccccagcgcaucuagggccuggaacgugugggaaguugaggacuaugguuuugggguguucaccacgaauauuuggcugaaacuucgggaagcuuacacacaguugugugaccaccgccucaugucagccgcagucaaggaugagagagcggugcacgccgacaugggauacuggaucgagagucagaaaaagggcagcuggaaacuggaaaaggcuucccuaauagagguuaagaccugcacuuggccuaaaucucauacccuguggucgaacggugugcucgaaagcgauaugaucauuccaaagucccuggccggcccgaucucacagcacaauuauaggcccggguaccauacacaaacugcaggaccuuggcaccuuggcaaauuggagcuggacuuuaacuauugcgaggggaccacaguagucauuacggaaaauuguggaacccguggcccaaguuuacggacuacaaccgugucugguaagcucauccacgaguggugcugucgaagcugcacucugcccccucuuagauacaugggggaagauggauguugguauggcauggagauaaggccaauuuccgaaaaagaggagaacauggugaagucacuggucagcgcugguucuggcaagguugacaauuucacaauggggguguugugccucgccauccuguuugaagagguaaugcgcggaaaauucggcaagaaacauaugaucgcagggguguucuuuaccuucguccuacugcucuccggacagauuacguggcgggauauggcccacacucugaucaugauuggcaguaacgcuagcgacagaauggguaugggggugaccuaccuugcguugauagccacauuuaagauccagcccuuccuggcauuaggauuuuuccucaggaaacugaccucucgcgaaaaucuucugcuaggcguuggccucgcuauggccacuacacugcaauugccggaggauauugaacagauggccaacgggaucgcucugggauuaauggcacucaagcugauuacccaguuugagacauaucagcuuuggacugcccugaucuccuugaccuguucaaauacgauauucacacucaccguggcguggcgaacugcuacccugauccuagccggugucagucugcuuccugugugccaaagcucguccaugcggaagucugacuggcucccaaugacaguugcagccaugggcgugcccccucugcccuuguuuauuuucagccugaaagauacuuuaaagcguagaucauggccacucaacgagggggucauggcuguaggacuggugaguauccuugcauccucucuguugaggaaugacguuccuauggccggcccccucguggcgggugggcugcuaauugcuuguuacgucaucaccggaacgagcgccgaucugacaguggaaaaagcagccgacguaaccugggaggaagaggcugaacagacuggcgugucccauaaccuuaugauaacagucgacgaugacggcaccaugcgcauuaaggaugacgagacugagaacauccucacaguucuguugaaaaccgccuuacugaucgugucagggauuuuuccauacagcauaccggcaacgcuccugguguggcacacuuggcagaagcagacccggagaaguggaguccuuugggaugugccuucucccccagaaacacaaaaagcugagcuggaagaggguguuuauaggaucaagcagcagggcauuuucgggaagacccagguaggagugggcguccaaaaagaggguguguuucauacaauguggcacguuacucgaggggccguguugaccuacaauggaaagcgccuagaacccaacugggcguccgucaaaaaggaccugaucagcuauggcggcggguggcggcucucggcccaguggcagaaaggagaggaagugcaaguaauugcagucgagccugguaagaauccaaagaacuuccagacgaugcccggcacauuccagacuaccacaggggaaaucggagcuauagcccuggauuuuaaaccuggcaccucagguucuccgaucauuaauagagaggggaaggugguuggacuuuacggcaacggcguggucacuaaaaaugggggauaugugagugguaucgcucagaccaacgcagagccagacggccccacaccugaauuagaggaagagauguucaagaaaaggaaucugacgauuauggaucuccacccaggguccggaaagacucguaaguacuugcccgccaucguucgcgaagccauaaaacggagacugaggacccucauucuggcuccuacacgaguggucgcggcagagauggaggaagcccuuaagggccugccgauccgguaucaaaccacugcuacaaaaagcgagcauaccggucgcgaaaucguggacuugaugugccacgccacguuuacuaugagacuacugucucccguaagggugccaaacuacaaucucauuaucauggaugaggcacauuucacagacccugccagcauagcugcgcggggguacauuuccacccgaguuggaaugggcgaagccgcagcuaucuuuaugaccgccacucccccaggcacagcagaugccuucccucagucaaacgcucccauucaggacgaggagagagacaucccagaacgcaguuggaauagcgggaacgaguggauaaccgauuuugccggaaagacagucugguucgugccgucuauuaaagcggguaaugacaucgcaaacuguuuaaggaagaacggcaagaaagugauccagcugucccguaagacuuuugauacggaauaucaaaaaaccaagcuuaaugacugggauuucgucguaacaacugacauuucagagaugggggccaacuuuaaagcugaucgggugaucgacccuagaaggugccugaagcccguuauucucaccgauggaccagagcgcgugauauuggccggccccaugccugucacagcugcaagugccgcucagcgaagaggucggguggggaggaauccacagaaggaaaacgaccaguacaucuucaccggccaaccccugaauaacgaugaggaccacgcccauuggacugaagcaaaaaugcuccuggacaauauuaacacgccugagggaaucaucccggcgcuuuucgaaccagagcgcgagaagagcgccgcuauugauggcgaauaucgucuaaaaggggaguccagaaagaccuuuguugaacugaugcggaggggagacuugcccgugugguuagcccacaaagucgcaucugaggguauaaaguacacagaucgcaaauggugcuucgacggccagcgaaauaaccagauccuggaagagaauauggauguggagauuuggacuaaggaaggggagaagaaaaagcucagaccucgguggcuggacgcuaggaccuauucggauccccuugcccugaaagaauuuaaggacuucgcagccggacgcaaaagcaucgcucucgauuugguaacagagauuggcagagugccaucacaccuggcgcauaggacccggaacgcccuagacaaucugguuaugcuccacacuuccgaacauggugggaaggcauaccgucacgcugucgaggagcuuccugaaacaauggagacgcuguuauugcugggccucaugauccugcuuaccggaggcgccaugcuguuucucauaagugggaagggaaucgguaaaacuucuauuggcuugaucugugugauugccagcuccgggaugcuguggauggcagaaauccccuuacaguggauagcuucagccauugugcuagaguucuuuaugaugguccugcucaucccagagccugaaaagcaacgcacaccgcaggauaaccagcuugcguauguugugauuggaauccugaccuuggcugccauaaucgcagccaaugagaugggccugcucgaaaccacaaaacgagaccuggguaugucuaaggagcccgggguagugagcccaacuaguuaccuugaugucgaccuccacccugcuuccgcauggacgcuguacgccguggcgaccacaguuauuacucccauguugagacauaccaucgaaaacagcacagcuaaugugucucuggccgcaauugccaaccaagcugucguauuaaugggccuagacaaaggauggccaaucucaaagauggaucugggcgugccucuccuugcccuggggugcuauucccagguuaaccccuugacccugacugcagcugugcuccugcuuauaacgcacuacgccauuaucggaccgggcuuacaggcgaaggccacaagggaggcacagaaacggaccgcugccgguaucaugaagaauccaacugucgacgggauuaugaccaucgaucuggacccugugauauaugauaguaaauucgagaagcaacucggacaggucauguugcuggugcuaugugcaguucagcugcuccuuaugcgcacaagcugggcucugugcgaagccuugacucuggccaccggccccauuacaacgcucugggaggguucgccaggcaaauuuuggaacaccacuaucgcggugucuauggcuaauauuuucagaggguccuaccuggcaggagccggcuuagcuuuuagcaucaugaagucaguagggacaggaaagaggggcaccgguaguaaaggggaaacucuuggagagaaguggaaaaagaaacugaaccagcucucucggaaggaauucgaccuauauaaaaaguccggcauaacagagguggaucgaaccgaggccaaggaaggucugaaaagaggcgagaucacgcaucacgcagucagccgcgggucagccaaguugcaaugguuuguugaaaggaauauggugauucccgagggacgggucaucgaccugggcugugggcguggaggcuggaguuacuauugcgcuggucucaaaaaggugaccgaaguaagaggguacacaaaaggaggcccuggccaugaggagccggugcccaugagcacuuacggguggaacauuguuaagcuuauguccggaaaggauguguucuaucugccaccugaaaaaugugacaccuugcugugcgauaucggugagucuagccccuccccuacagucgaagagucaaggacuauucgcgugcucaagauggucgagccaugguuaaaaaauaaccaguucuguaucaaggugcugaaucccuacaugccuaccguuauagaacaccuugagcggcugcagcgaaaacacggcgggaugcuaguaagaaacccacucucuaggaauaguacacaugaaauguauuggauuucgaacggaaccggcaauaucguggcgagcgucaacauggugucccgccuguugcugaaucgguuuacuaugacgcacagacgucccacaaucgagaaggacguugaucucggugccgggaccaggcaugugaacgcagaaccggagacuccuaacauggacgucauuggagagcggauaaagcgcaucaaagaagagcacaauucuaccuggcacuacgacgaugaaaacccauauaagacaugggcuuaccauggcucauaugaggugaaagccacgggcagcgcauccaguaugauuaaugggguagugaagcuucugaccaaacccugggacguugucccuauggugacucagauggccaugacagauaccacuccauucggacaacagcgaguguuuaaggaaaaggucgacacaagaacccccaggucuaugccggguacacggcgcguuaugggcaucacugcugagugguuauggagaacccuggggaggaacaaaaagccucgauugugcacgcgggaggaauucaccaaaaaggugcguacaaaugccgcgaugggagcaguauuuacugaggaaaaccagugggauagcgccaaagcugccguggaggacgaagauuucuggaagcucgucgacagagagcgcgagcugcacaaacuaggcaagugugguucaugcguguacaauaugauggggaagagggaaaaaaagcuuggagaguuuggcaaagcaaagggcucccgggcuauuugguacauguggcugggggccagauaucucgaauucgaggcucugggauuuuugaacgaggaucauugguucagucgcgaaaauagcuacucugguguugagggcgaagggcugcacaaacucggauauauccuuagggacauauccaagauccccggcggugccauguacgcagaugacaccgcggggugggacacacgaauuacugaggaugaccugcauaacgaagagaagaucacccaacagauggauccagagcaccggcaguuagccaaugcuauuuuuaaacugacguaucagaacaagguggucaaagugcaaagaccuacacccaccggaacuguaauggacaucauaucaaggaaggaucagcgcggcagcggccagguugggacauacggauugaauaccuucacuaacauggaagcccagcucauucgucaaauggagggugaaggcgugcugucgaaagcagaccuagagaauccacaccuuucugaaaagaagaucacccaguggcuggagacaaaaggggucgagcggcucaagagaauggcuaucaguggagaugacugcguggugaaacccauugaugacagguuugccaacgcacuguuggccuuaaacgauaugggcaagguccgcaaagacauaccucaguggcagccauccaaggguuggcaugauuggcaacagguuccguucuguagccaccauuuccacgaacugaucaugaaggacgggcgaaaacucgugguacccugccggccucaggacgagcuuauuggaagagcgaggaucucacagggcgcuggcuggucccugcgcgaaacggccugucuagggaaggcauaugcccaaauguggucucugauguacuuucacagacgggaucucagguuggcuagcaaugccauuugcagugcagugccaguccauugggugcccaccucccguacuacauggagcauccacgcucaucaccaguggaugaccacugaggacaugcugacaguuuggaaccgaguguggauagaagauaauccuuggauggaggacaaaaccccagucacgacaugggagaacgugcccuaccuuggaaagcgcgaagaucaguggugugguucucugaucggccucaccucaagagccacuugggcgcaaaauauuccuaccgcuauccagcagguacggaguuuaauugggaacgaggaauuccuggacuauaugccguccaugaaaagguuucgcaaggaggaggaaagcgagggagccaucugguga

SEQ ID NO: 15437 - RNA, 9873 nt, Artificial Sequence
  derived and/or modified CDS sequence (opt3) from DENV-3__FJ182007__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauugcugaaguugagccggaagacaucgauugcugguguaaccugacuaguaccugggugacauaugggaccugcaaucaggccggagagcaccgccgagacaagcguagcguagcacuugccccccaugugggcaugggucuggauacuagaacacaaaccuggauguccgcugagggggcauggaggcaggucgaaaaaguggagacgugggccuugcggcacccuggauucacuauucucgcucuguuucuggcccauuacaucggcaccucucucacacagaagguugugauauucaucuuacugaugcuugucacuccaucgaugaccaugcgcugugugggcguagggaacagagacuuuguugaaggauugucaggugcgacauggguggaugucgugcuggagcacggcgggugcgugaccacgauggcaaagaauaaacccacucuagacauugagcuccagaagacagaagccacccaacuggcuacucuuaggaaacuguguaucgagggaaagauuacaaacaucaccacggauagccggugcccuacccagggcgaagccgucuugccagaggaacaggaccagaauuauguuuguaaacacacauacguggaucgcgguugggggaacggaugcggccucuucggcaaggggagucugguaacuugcgcaaaguuucaauguuuagagcccauagagggaaaagugguccaguaugaaaaucugaaguacaccgugauuaucacaguucauacuggugaccagcaccaggugggcaacgagacccaaggggucacagcugaaauuaccccucaggccuccacuacggaggcgauccucccagaauauggaacacuuggccuggagugcucuccgcgaaccgguuuggacuucaaugagaugauccuacugacuaugaaaaacaaggccuggauggugcauagacagugguuuuucgaucucccccugccuuggaccagcggggcaacaaccgaaacuccaacauggaauaggaaagagcuucugguaacguuuaagaacgcucacgccaaaaagcaagaaguuguggucuugggcucccaggagggagcuaugcacaccgcccucacuggcgcaacagaaauucagaauucagggggaaccaguauauucgccggucaucugaagugucgguuaaaaauggacaagcuggagcuaaaaggcaugagcuacgcuaugugcacaaacacuuuugugcucaagaaagaggucucugaaacccagcacgggacgauccugauuaagguggaguacaagggagaagaugcgcccuguaaaaucccuuucuccaccgaggacggccaagguaaggcacauaacgggcgucuuauaacagccaauccaguugugacuaaaaaggaggaacccguaaacauugaggcugaaccgccuuucggcgagucaaauaucgucaucggaaccggcgauaacgccuugaaaauuaauugguauaagaaggggagcaguaucggaaaaauguuugaagcaacagcccgcggugcuagaaggauggccauucugggcgacacugcaugggauuucgggucugugggaggcguucucaacucccuggguaagauggugcaccagauauuugggagcgcguacaccgcucuuuucucgggcgucucuugggugaugaaaaucggaauuggcguacuguugacguggaucgggcucaauuccaagaacacaucaaugaguuuuagcugcaucgccauuggaauaaucacccuguauuuaggcgcagugguucaggccgacacugguugugucauuaauuggaaagggaaggagcugaagugcggauccggcaucuucgugacaaacgaggugcauaccuggacugaacaguacaaauuucaagcugauucucccaagcggcuagccaccgcaauugcuggugccugggagaauggcgucugugggauccgaagcacaacgcgcauggaaaaccuccuguggaaacagauagcgaaugagcuuaacuauaucuugugggaaaauaacauuaagcugaccguuguggugggagacaucauuggcguacucgagcaggggaaaagaacucugacaccacagccuauggaguuaaaguacucauggaaaaccuggggaaaggccaagaucgucacagcugaaacucaaaacaguuccuucauaauugauggccccaauaccccagagugccccagcgcaucuagggccuggaacgugugggaaguugaggacuaugguuuugggguguucacgacaaauaucuggcugaaacuucgggaagucuacacccaguugugugaccaccgccucaugucagcugccgugaaggaugagagagcaguucacgcggacaugggauacuggauugagagucagaaaaacggcagcuggaagcuggaaaaagccucccuaaucgaggugaagacuugcaccuggccuaagucucauacacuguggucgaaugguguacucgaaagcgauaugauaaucccaaaaucccuggcuggcccgauuucacagcacaacuauaggcccggguaccauacucaaaccgccggaccuuggcaccuuggcaaguuggagcuggacuuuaauuauugcgaggggacaacggucgugaucaccgaagauuguggaacucguggcccaaguuuacggacaaccacugugucugguaaacucauucacgaguggugcugucgaagcugcacacugcccccucuuagauacaugggggaagacggauguugguauggcauggagaucaggccaauauccgaaaaggaggagaacauggucaaaucacugguuagcgcagguucuggcaagguggauaauuucaccauggggguauugugccucgcuauucuguuugaagaggugaugcgcggaaaguucggcaaaaagcauaugaucgccggggucuucuuuacguucgugcuacugcucuccggacagaucacuuggcgggacauggcacacacccugauuaugaucggcaguaacgccagcgauagaauggguauggggguuacauaccuugcuuugauugcgaccuuuaaaauacagcccuuccuggccuuaggauuuuuccucaggaagcugacuucucgcgaaaaucuucugcuaggcgugggccucgcaauggcuacaacccugcaauugccggaggacaucgaacagauggccaacgggauugcccugggauuaauggcucucaaacugaucacacaguuugagacuuaucagcuuuggaccgcacugauuuccuugacguguucaaauacaaucuucacccucacugucgccuggcgaaccgcgacacugauacuagcuggugugagucugcuuccuguuugccaaagcucguccaugcggaagucugauuggcucccaaugacuguggccgcaaugggcguccccccucugcccuuguuuaucuucagccugaaggacaccuuaaaacguagaucauggccacucaacgaggggguaauggccgugggacugguuaguauucuugcuuccucucuguugaggaaugaugugccuauggcaggcccccucgucgccggugggcugcuaaucgcguguuacgugauuacgggaacaagcgcugaccugaccguagaaaaggccgcagacgugacuugggaggaagaggccgaacagacaggcgucucccauaaccuuaugaucaccguugaugacgauggcacuaugcgcauaaaagacgaugagacagagaacauucucaccgugcuguugaagacggcuuuacugaucgugucagggaucuuuccauacagcauuccggccacucuccuggucuggcacaccuggcagaaacagacacggagaaguggagugcuuugggacguuccuucucccccagaaacccaaaaggcagagcuggaagaggguguauauaggauaaaacagcagggcaucuucgggaagacacaggugggagucggcgugcaaaaggaggguguuuuucauacuauguggcacgugacccgaggggcugucuugacguacaauggaaaacgccuagaacccaacugggccuccgugaagaaagaucugauuagcuauggcggcggguggcggcucucggcgcaguggcagaagggagaggaaguacaagucaucgccguggagccugguaaaaauccaaagaacuuccagacaaugcccggcacuuuccagaccacaaccggggaaauuggagcaaucgcucuggacuuuaagccuggcacuucagguucuccgauaaucaauagagaggggaaaguugugggacuuuacggcaacggcgucgugaccaagaaugggggauauguuagugguauugcccagacaaacgcugagccagauggccccacgccugaauuagaggaagagauguucaaaaagaggaaucugacuaucauggaccuccacccaggguccggaaaaacccguaaguacuugcccgcaauugugcgcgaagccaucaagcggagacugaggacacucauacuggccccuacccgagucguggcugcggagauggaggaagcacuuaaaggccugccgauucgguaucaaacuacagccaccaagagcgagcauacgggucgcgaaaucguagauuugaugugccacgcuacuuuuacaaugagacuacugucucccgugaggguuccaaacuacaaucucaucauuauggacgaggcccauuucaccgauccugcaagcaucgccgcucggggguacauauccacccgagucggaaugggcgaagcggccgcaauuuuuaugacugcuacacccccaggcaccgccgacgcauucccucagucaaacgcccccauccaggacgaggagagagauauuccagaacgcaguuggaauagcgggaacgaguggaucacagacuuugcuggaaaaacugugugguucgugccgucuauaaaggccgguaaugauauugcgaacuguuuaaggaaaaacggcaagaaggucauccagcugucccguaaaacguuugacaccgaauaucaaaagacaaaacuuaaugauugggacuucguagugacuaccgauaucucagagaugggggcaaacuuuaaggccgaccggguuauugauccuagaaggugccugaaacccgugauccucacagacggaccagagcgcgucauuuuggcuggccccaugccugugaccgccgcuagugcagcccagcgaagaggucggguugggaggaauccacagaaggaaaacgaucaguacauauucacuggccaaccccugaauaacgacgaggaccacgcucauuggacggaagccaagaugcuccuggauaauaucaacaccccugagggaauuaucccggcacuuuucgaaccagagcgcgagaaaagcgcggccaucgacggcgaauaucgucuaaagggggaguccagaaaaacauuuguggaacugaugcggaggggagauuugcccgucugguuagcucacaagguggccucugaggguauuaaauacacugaccgcaaguggugcuucgauggccagcgaaauaaccagauacuggaagagaauauggacguagagaucuggaccaaagaaggggagaagaagaaacucagaccucgguggcuggaugcaaggacauauucggacccccuugcucugaaggaauuuaaagauuucgccgcaggacgcaagagcauugcccucgacuuggugaccgagaucggcagaguuccaucacaccuggcucauaggacucggaacgcgcuagauaaucuggucaugcuccacacauccgaacauggugggaaagccuaccgucacgcaguggaggagcuuccugaaacgauggagacccuguuauugcugggccucaugauucugcuuacuggaggcgcuaugcuguuucucaucagugggaagggaauagguaagacaucuaucggcuugauuugugugaucgccagcuccgggaugcuguggauugccgaaauccccuuacaguggauagcaucagcuauuguccuagaguucuuuaugaugguucugcucaucccagagccugaaaaacaacgcaccccgcaggacaaccagcuugccuaugugguaauuggaauccugaccuuggcggcuauaaucgccgcaaaugagaugggccugcucgaaacaacuaagcgagaucuggguaugucuaaagagcccgggguggucagcccaacgaguuaccuugacguggaccuccacccugccuccgcuuggacccuguacgcaguugccacaacugugauuacccccauguugagacauacaaucgaaaacagcaccgcgaaugucucucuggcugccauugcaaaccaagccguaguguuaaugggccuagauaagggauggccaaucucaaaaauggaccugggcguuccucuccuugcucuggggugcuauucccaggugaaccccuugacucugacggccgcaguccuccugcuuauaacacacuacgcuauuaucggaccgggcuuacaggccaaggcgaccagggaggcccagaagcggacugcagcugguaucaugaaaaauccaaccguggaugggauuaugacaaucgaccuggauccugucauauaugacaguaaguucgagaaacaacucggacaggugauguugcugguucuaugugccgugcagcugcuccuuaugcgcacuagcugggcacugugcgaagcuuugacccuggccacaggccccauuacgacccucugggaggguucgccaggcaaguuuuggaacacuacaaucgccguaucuauggcgaauauuuucagaggguccuaccuggcuggagcaggcuuagccuuuagcaucaugaaaucaguggggaccggaaagaggggcacugguagucagggggaaacacuuggagagaaguggaaacggaagcugaaccaacucucucgaaaagaauucgaucuauauaagaaauccggcauaaccgaggucgacagaacggaggcuaaggaaggucugaaacgcggcgagaucacccaucacgccguuagcagggggucagcaaaguugcagugguuuguggaacggaauauggucauucccgagggacgugugaucgaucugggcugugggagaggaggcuggaguuacuauugcgccggucucaagaaaguaacagaagugaggggguacacuaagggaggcccuggccaugaggagccgguucccaugagcaccuacggguggaacauugugaaacuuauguccggaaaggacgucuucuaucugccaccugaaaaaugugauacauugcugugcgacaucggugagucuagccccuccccuacuguggaagagucacgcaccauucggguccucaagaugguggagccaugguuaaagaauaaccaguucuguaucaaaguucugaaucccuacaugccuacaguaauagaacaccuugagcgacugcagagaaagcacggcgggaugcuagugaggaacccacucucucgcaauaguacccaugaaauguauuggauuucgaacggaacuggcaauaucgucgcuagcgugaacaugguuucccggcuguugcugaauagauuuacgaugacacaccguaggcccaccaucgagaaagauguggaccucggugcggggacucggcaugucaacgccgaaccggagaccccuaacauggacgugauuggagagcgcauaaagcgaaucaaagaagagcacaauucuacauggcacuacgaugacgaaaacccauauaagacgugggcauaccauggcucauaugagguaaaggcuaccggcagcgccuccaguaugauuaauggggugguuaaacuucugacuaagcccugggaugucgugccuauggugacacaaauggcaaugaccgacacuacaccauucggacagcagagagucuuuaaagaaaagguugauaccaggacaccccggucuaugccggguacucgcagagugaugggcaucaccgccgagugguuauggaggacgcuggggcgaaacaaaaagccucgguugugcacccgugaggaauucacaaagaaaguaagaacuaaugcugccaugggagcgguguuuaccgaggaaaaccaaugggacagcgcaaaggccgcugucgaggaugaagacuucuggaaacucguggaucgcgagagggagcugcacaagcuaggcaaaugugguucaugcguuuacaauaugauggggaagcgggaaaaaaagcuuggagaguuuggcaaggccaaaggcuccagagcaauuugguacauguggcugggggcucgcuaucucgaauucgaggcccugggauuuuugaacgaggaccauugguucaguagggaaaauagcuacucugguguggagggcgaagggcugcacaagcucggauauauccuucgagauauauccaaaauccccggcggugcuauguacgccgacgacacagcagggugggauacucggauuaccgaggacgaucugcauaacgaagagaagaucacgcagcagauggacccagagcacagacaguuagcgaaugccauuuuuaaacugacauaucaaaacaaggucgugaagguacagaggccuacccccacuggaacaguuauggauaucauaucacgcaaagaccagcguggcagcggccagguggggaccuacggauugaauacuuucaccaacauggaagcucaacucauucggcagauggagggugaaggcguccugucgaaggccgaucuagagaauccacaccuuucugaaaaaaagaucacacaguggcuggagacgaaagggguggagagacucaagaggauggcaaucaguggagacgauugcguggucaagcccauugacgaucgcuuugcuaacgcccuguuggcauuaaacgacaugggcaaaguucgaaaggauauaccucaguggcaaccauccaaagguuggcaugacuggcagcaggugccguucuguagccaccauuuccacgaacugaucaugaaggacgggcggaaacucguagugcccugcagaccucaggaugagcuuauuggaagggcccgcaucucacaaggcgcgggcuggucccugagagaaaccgcuugucuagggaaggccuaugcacagauguggucucugauguacuuucaccggagggaccuccguuuggccagcaaugcuauuugcagugccgucccagugcauuggguucccacuucccgaacaaccuggagcauccacgcacaucaccaguggaugacuacagaggauaugcugaccguguggaaccgcgucuggauagaagacaauccuuggauggaggauaagacgccagugacaaccugggagaacguacccuaccuuggaaaaagagaagaccaauggugugguucucugaucggccucacuucacgggcuaccugggcccagaauauuccuacagcgauccagcagguuaggaguuuaauugggaacgaggaauuccuggauuauaugccguccaugaagcgcuuuagaaaagaggaggaaagcgagggagcuaucugguga

SEQ ID NO: 15438 - RNA, 9873 nt, Artificial Sequence
  derived and/or modified CDS sequence (opt3) from DENV-3__FJ182008__SS-prME
accagccugugcaucaugaugauucuccccgccgcucuugcauuccaccugacauccagagacggcgagccuaggaugauaguggggaagaacgaacggggaaaaucuuuguuauuuaagacugccucagguaucaauauguguacgcugauugcgauggaucuaggcgagaugugcgacgauaccgucacauacaaauguccacauaucacugaaguugagccggaagacauugauugcugguguaaccucaccaguacaugggugaccuaugggacuugcaaucaggcuggagagcaccgccgagacaagcguagcguagcccuggcaccccaugugggcaugggucuugauacaagaacccaaacguggauguccgccgagggggcuuggaggcaggucgaaaaaguggagacuugggcacugcggcacccuggauucaccaucuuggcccucuuucuggcucauuacauaggcacaucucugacucagaagguugugaucuucauucucuuaaugcuggucaccccaucgaugacaaugcgcugugugggcguagggaacagagacuuuguugaaggacuuucaggugccaccuggguggaugucguguuggagcacggcgggugcgugacgacuauggcgaagaauaaacccacacuggacaucgagcuacagaagaccgaagcaacucaacucgccacacugaggaaacuuuguauugagggaaagaucaccaacauaacgaccgauagccggugcccuacacagggcgaagcuguccugccagaggaacaggaccagaauuauguuuguaaacacacuuacguggaucgcgguugggggaacggaugcggcuuguucggcaaggggagucucguaaccugcgccaaguuucaaugucuggagcccauugagggaaaagugguccaguaugaaaauuuaaaguacacagugaucauuacuguucauaccggugaccagcaccaggugggcaacgagacacaaggggucaccgcagaaaucacuccucaggcuuccacgacagaggccauccugccagaauauggaacccucggccuugagugcucuccgcgaacuggucuggacuucaaugagaugauuuugcuaaccaugaaaaacaaggcguggauggugcauagacagugguuuuucgaucugccccucccuuggacaagcggggccaccacugaaacaccaacguggaauaggaaagagcugcuuguaaccuuuaagaacgcacacgcuaaaaagcaagaaguugugguccugggcucccaggagggagccaugcacacugcuuugacaggcgccaccgaaauacagaauucagggggaacaaguaucuucgcaggucaucucaagugucggcugaaaauggacaaguuagagcugaaaggcaugagcuacgccaugugcacuaacaccuuugugcuaaagaaagaggucucugaaacgcagcacgggaccauucucaucaagguggaguacaagggagaagaugcucccuguaaaauaccuuucuccacagaggacggccaagguaaggcgcauaacgggcgucugauuacugcaaauccaguugugaccaaaaaggaggaacccguaaacaucgaggccgaaccgccuuucggcgagucaaauaucgucauuggaaucggcgauaacgcucuuaaaauuaauugguauaagaaggggagcaguauaggaaaaauguuugaagccacagcacgcggugccagaaggauggcuaucuugggcgacacugccugggauuucgggucugugggaggcguucugaacucccucgguaagauggugcaccagauuuuugggagcgcauacaccgcgcuguucucgggcgucucuugggugaugaaaaucggaaucggcguacuucugacguggauuggguugaauuccaagaacacaucaaugaguuuuagcugcauagcuaucggagugauuacccucuaucugggcgccguuguccaggcagacauggguugugugaucaauuggaaagggaaggaguuaaagugcggauccggcauuuucgugacuaacgagguccauacauggaccgaacaguacaaauuucaagccgauucucccaagcggcuggcuacugccaucgcaggugcuugggagaauggcguuugugggauacgaagcaccacacgcauggaaaaccuacucuggaaacagaucgccaaugagcugaacuauauucuuugggaaaauaacaucaaguugacgguggugguaggagacauuaucggcguccuggagcaggggaaaagaacccucacuccacagccuauggagcugaaguacucauggaaaacauggggaaaggcgaagauagugaccgccgaaacacaaaacaguuccuucauuaucgauggccccaauacuccagagugccccagcgcuucuagggcauggaacguuugggaaguggaggacuaugguuuuggggucuucaccacgaauauuugguuaaaacugcgggaaguguacacacagcuuugugaccaccgcuugaugucagccgcuguuaaggaugagagagccgugcacgcagacaugggauacuggaucgagagucagaaaaacggcagcuggaagcucgaaaaagcgucccugauagagguaaagaccugcacuuggccuaagucucauacccuauggucgaaugguguccuggaaagcgauaugaucauuccaaaaucccucgccggcccgaucucacagcacaacuauaggcccggguaccauacacaaacugcuggaccuuggcaccugggcaagcuugaguuggacuuuaauuauugcgaggggaccacaguggugauuacggaaaacuguggaacccguggcccaagucugcggacuacaaccgucucugguaaauuaauccacgaguggugcugucgaagcugcacucuccccccucugagauacaugggggaagauggauguugguauggcauggagauaaggccaauuuccgaaaaggaggagaauaugguuaaaucacuugugagcgccgguucuggcaagguagacaacuucacaaugggggugcugugcuuggcaauccucuuugaagaggucaugcgcggaaaguucggcaaaaagcauaugaucgcugggguguucuuuaccuucguucugcuacuguccggacagauuacguggcgggauauggcccacacucucaucaugauuggcaguaaugcaagcgacaaaauggguaugggggugaccuaccuggcccuuauagcuacauuuaagauccagcccuucuuggcgcugggauuuuucuuaagaaaacucaccucuagggaaaaccugcuucugggcgucggccuagccauggcaacuacacuccaacugccggaggauauugaacagauggcuaaugggaucgccuugggacugauggccuuaaagcucauuacccaguuugagacauaucagcuguggacugcucuuaucucccugaccuguucaaacacgauguucacauugaccguggcauggcgcacugccacccucauacuggcggguguuagucuacugccugugugccaaagcucguccaugcgaaagacagacuggcuuccaauggcugucgccgcaaugggcguacccccucucccccuguuuaucuucucuuugaaagauacucugaagcggcguagcuggccauuaaaugagggggugauggccguuggacucgugucaauucuggcuaguucccuucugagaaacgacgucccuauggcaggccccuugguggccggugggcuccugaucgcguguuacguaauuaccggaacgucugcugaucuaacaguggaaaaagccgcagacaucaccugggaggaagaggccgaacagacuggcgucagccauaaccugaugauaacaguugacgaugacggcaccaugaggauuaaggaugacgagacugagaauauccuuacagugcuccugaaaaccgcuuuguuaaucauuuccgggguguuuccauacucaauaccggccacgcugcucgucuggcacacuuggcagaagcagacccaacgcagcggagugcugugggauguuccuagucccccagaaacacagaaagcagagcuugaagaggguguauaucggaucaagcagcagggcauuuucgggaagacccaagugggagucggcgugcagaaagaggguguuuuucauacaauguggcacgugacuagaggggcuguccugaccuacaacggaaagagguuggaacccaauugggccucugugaaaaaggaccuaaucuccuauggcggcggguggcgacugagcgcgcaguggcaaaaaggagaggaaguacaggucauugccguggagccugguaagaacccaaagaauuuccagacgaugcccggcacauuccagacuaccacaggggaaaucggagcaauagcucucgauuuuaaaccuggcaccucggguucaccgaucauuaaccgcgaggggaagguugugggacuguacggcaauggcgucgugacuaaaaacgggggauauguuucugguaucgcccaaaccaaugcugagccagacggccccacaccugaacuugaggaagagauguucaagaaacggaacuuaacgauuauggaucugcacccagggaguggaaagacuagaaaguaccuccccgcaaucgugagggaagccauaaaacgucgcuugcggacccugauucucgccccuacaagagucguggcugcggagauggaggaagcacugaagggccuuccgaucagguaucagaccacugccacaaaauccgagcauaccggucgagaaaucguagaccugaugugccacgcuacguuuacuaugcgguugcuaagccccgugcgcguuccaaauuacaaccugauuaucauggaugaggcccauuucacagacccugcaucuauagccgcuagaggguacauuagcaccagggucggaaugggcgaagcggccgcaaucuuuaugaccgcuacucccccaggcacagccgaugcauucccucaguccaaugcccccauucaggacgaggagcgggacaucccagaacgaucauggaacagugggaaugaguggauaaccgauuuugcuggaaagacagugugguucgugccgagcauuaaagccgguaacgacaucgcgaacugucucagaaagaauggcaagaaagucauccaauuaucucgcaagacuuuugauacggaauaucagaaaaccaagcugaacgacugggauuucguagugacaacugacauuuccgagaugggggcaaauuuuaaagccgauaggguuaucgacccucgucggugccuuaagcccgugauucugaccgauggaccagagagagucauacucgcuggccccaugccugugacagccgcuucagcagcccagaggcgcggucgaguugggagaaacccacagaaggaaaaugaccaauacaucuucaccggccagcccuugaacaaugaugaggaccacgcucauuggacugaagccaaaaugcugcucgacaacauuaauacgccugagggaaucaucccggcacuguucgaaccagagcgggagaagagugcggccauugauggcgaauauaggcuuaaaggggagagccgcaagaccuuuguggaacuaaugcguagaggagaccugcccgucugguuggcucacaaaguggccuccgaggguauaaaguacacagaucggaaauggugcuucgacggccagaggaacaaucagaucuuagaagagaacauggauguagagauuuggacuaaggaaggggagaagaaaaagcugcgcccucgauggcucgacgcaagaaccuauucugauccccuggcucuuaaagaauuuaaggacuucgccgcaggacggaaaucgaucgcccuggaucucgugacagagauuggcaggguuccaagccacuuggcucaucgcaccagaaaugcgcuggacaaccuagucaugcugcacacuucagaacauggugggagggccuaccggcacgcaguggaggagcucccugaaacaauggagacgcuucuguuauugggccugaugauccuccugaccggaggcgcuaugcuuuuucugauauccgggaagggaaucgguaagacuaguauuggccucaucugugugauugccucuagcgggauguuguggauggccgaaaucccccugcaauggauagcauccgcuauugucuuagaguucuuuaugaugguucuacugaucccagagccugaaaaacagcguacaccgcaggauaaucaacucgccuaugugguaauuggaauccuuacccuggcggcuauaaucgccgcaaacgagaugggcuugcuggaaaccacaaagcgcgaccucgguaugucaaaagagcccgggguggucucuccaacuagcuaccuggauguggaccuucacccugccagugcuuggacgcucuacgcaguugccaccacagugauuacucccaugcugcgacauaccaucgaaaauuccacagcgaacgucagcuuggcugccauugcaaaccaggccguagugcugaugggcuuagacaagggauggccaaucucuaaaauggaucuaggcguuccucugcucgcucuugggugcuauucacaggugaauccccugaccuugacugccgcaguccugcuccugauaacgcacuacgcuauuaucggaccgggccuucaggccaaggcgacaagagaggcccaaaagaggaccgcagcugguaucaugaaaaacccaacuguggacgggauuaugaccaucgauuuagacccugucauauaugauuccaaguucgagaaacagcugggacaggugaugcucuugguucugugugccgugcagcuacugcucaugcggacaaguugggcacuuugcgaagcucugacuuuggccaccggccccauuacaacgcugugggaggguagcccaggcaaguuuuggaauaccacuaucgccguaucgauggcgaacauuuuccgcgggucuuaccucgcuggagcaggccuggccuuuuccaucaugaaaagcguggggacaggaaagagaggcaccgguucacaaggggaaacuuuaggagagaaguggaaaaagaaacuuaaucagcugaguaggaaggaauucgaccucuauaaaaagucuggcauaacagaggucgaucggaccgaggcuaaagaaggucuaaagcgaggcgagacgacccaucacgccguuuccagagggacagcaaagcugcagugguuuguggaacgcaacauggucauccccgagggaagggugauugacuugggcugugggcggggaggcuggagcuacuauugcgccggucugaaaaagguaacugaagugcguggguacaccaaaggaggcccuggccaugaggagccgguucccaugucaacauacggguggaauaucgugaagcucaugaguggaaaagaugucuucuaucuuccaccugaaaagugugacacucuguugugcgauauuggugagagcucccccucuccuaccguggaagagagcagaacaaucaggguccugaagaugguggagccauggcucaaaaacaaucaguucuguauuaagguuuuaaaccccuacaugccuaccguaaucgaacaccuggagcgccuucaacggaaacacggcgggaugcuggugcgaaauccacuauccagaaacucaacucaugaaauguauuggauaucuaauggaacgggcaacauugucgcuagugugaauaugguuucgaggcuccuguugaaccgcuuuacaaugacccaccggagacccacuaucgagaaggacguggaucugggugcggggacccgucaugucaacgccgaaccggagacaccuaauauggacgugaucggagagaggauuaaacggauaaaggaagagcacaacagcacguggcacuacgacgaugaaaauccauauaagaccugggcauaccauggcuccuaugagguaaaagcuacuggcucugccucaagcaugaucaacggggugguuaagcuccuuacaaaacccugggacgucgugccuauggugacccagauggcaaugacugauacaaccccauucggacagcaacgcgucuuuaaggaaaaaguugacacacgaacucccagauccaugccggguaccaggcgggugaugggcauuacggccgaguggcuguggcgcaccuuagggagaaauaagaagccuaggcugugcacacgagaggaauucacuaaaaagguacggaccaacgcugccaugggagcgguguuuacagaggaaaaucagugggauagugcaaaagccgcugucgaggacgaagauuucuggaaguugguggaccgugagagagagcuccacaaacugggcaagugugguucuugcguuuacaacaugauggggaaacgcgaaaagaagcuaggagaguuuggcaaagccaagggcagcagggcaaucugguacauguggcuuggggcucgguaucuggaauucgaggcccucggauuucugaaugaggaucauugguucucaagagaaaacuccuacagugguguggagggcgaaggguugcacaaacugggauauauucuccgcgacaucagcaagauacccggcggugcuauguacgccgaugacacugcagggugggacaccaggaucacggaggaugaccuucauaaugaagagaaaauuacacagcagauggauccagagcaccgacaacuggcgaacgccaucuuuaaguuaaccuaucagaauaaggucgugaaaguacagcggccuacucccacaggaaccguuauggacauuaucucuagaaaggaucagaggggcuccggccaaguggggacuuacggacugaacaccuucacaaauauggaagcucaguugauacgccagauggagggugaaggcguccucucaaaagccgaccuggagaacccacaccuacccgaaaagaaaauuacgcaguggcuugagaccaaggggguggagcgucugcggagaauggcaaucagcggagaugacugcguggucaagccuaucgaugacagguuugcuaacgcccuccuggcauugaaugauaugggcaaaguucgcaaggacauuccacaauggcagccgucgaaagguuggcaugauuggcagcaggugcccuucuguucucaccauuuccacgaauuaauaaugaaggacgggcgaaaacugguagugccuugccggccacaagacgagcucaucggaagagccaggauuagucagggcgcgggcuggucccuucgcgaaacugcuugucuggggaaggccuaugcacagauguggagccuaauguacuuucacagacgggaucugaggcucgccucaaacgcuaucugcuccgccguccccgugcauuggguuccuacaucucguaccacuuggagcauucacgcacaucaccaauggaugacaaccgaggacauguugacgguguggaaucgagucuggaucgaagauaacccauggauggaggacaagacacccgugaccacuugggagaauguaccuuaccugggaaaacgcgaagaucaguggugugguagucuuauaggccugaccuccagagcuacaugggcccagaacaucccgacugcgauucagcaaguucggagccucaucgggaaugaggaauucuuagacuauaugccaucuaugaagagguuucgcaaagaggaggaaucagagggagcuauuugguga

SEQ ID NO: 15439 - RNA, 9873 nt, Artificial Sequence
  derived and/or modified CDS sequence (opt3) from DENV-3__FJ182010__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauugcugaaguugagccggaagacaucgauugcugguguaaccugacuaguaccugggugacauaugggaccugcaaucaggccggagagcaccgccgagacaagcguagcguagcacuugccccccaugugggcaugggucuggauacuagaacacaaaccuggauguccgcugagggggcauggaggcaggucgaaaaaguggagacgugggccuugcggcacccuggauucacuauucucgcucuguuucuggcccauuacaucggcaccucucucacacagaagguugugauauucgucuuacugaugcuugugacuccaucgaugaccaugcgcuguguaggcguugggaacagagacuuuguggaaggauugucaggugcgacaugggucgauguggugcuggagcacggcgggugcgucaccacgauggcaaagaauaaacccacucuagacaucgagcuccagaagacagaagccacccaacuggcuacucuuaggaaacuguguauugagggaaagaucacaaacauuaccacggauagccggugcccuacccagggcgaagccguuuugccagaggaacaggaccagaauuauguguguaaacacacauacguagaucgcgguugggggaacggaugcggccucuucggcaaggggagucuggugacuugcgcaaaguuucaauguuuagagcccaucgagggaaaagucgugcaguaugaaaaucugaaguacaccguuauaauuacagugcauacuggugaccagcaccaggucggcaacgagacccaaggggugacagcugaaaucaccccucaggccuccacuacggaggcgauucucccagaauauggaacacuuggccuggagugcucuccgcgaaccgguuuggacuucaaugagaugauccuacugacuaugaaaaacaaggccuggaugguacauagacagugguuuuucgaucucccccugccuuggaccagcggggcaacaaccgaaacuccaacauggaauaggaaagagcuucugguuacguuuaagaacgcucacgccaaaaagcaagaaguggucguguugggcucccaggagggagcuaugcacaccgcccucacuggcgcaacagaaauccagaauucagggggaaccaguauuuucgccggucaucugaagugucgguuaaaaauggacaagcuggagcuaaaaggcaugagcuacgcuaugugcacaaacacuuuuguccucaagaaagaggugucugaaacccagcacgggacgauacugaucaagguugaguacaagggagaagaugcgcccuguaaaauuccuuucuccaccgaggacggccaagguaaggcacauaacgggcgucuuaucacagccaauccagugguaacuaaaaaggaggaacccgucaacauagaggcugaaccgccuuucggcgagucaaauauugugaucggaaucggcgauaacgccuugaaaauuaauugguauaagaaggggagcaguaucggaaaaauguuugaagcaaccgcccgcggugcuagaaggauggccauucugggcgacacagcaugggauuucgggucuguuggaggcgugcucaacucccuggguaagaugguccaccagauauuugggagcgcguacacugcucuuuucucgggcgugucuuggguaaugaaaaucggaauuggcgugcuguugaccuggaucgggcucaauuccaagaacacgucaaugaguuuuagcugcaucgccauuggaauaaucacacuguauuuaggcgcaguuguccaggccgacaccgguugugugauuaauuggaaagggaaggagcugaagugcggauccggcaucuucgugacuaacgagguccauacauggaccgaacaguacaaauuucaagcugauucucccaagcggcuagccacugcaauugcuggugccugggagaauggcguuugugggauccgaagcaccacacgcauggaaaaccuccuguggaaacagguggcgaaugagcuuaacuauauauugugggaaaauaacaucaagcugacggugguagucggagacauuaucggcgugcucgagcaggggaaaagaacccugacuccacagccuauggaguuaaaguacucauggaaaacauggggaaaggccaagauuguuaccgcugaaacacaaaacaguuccuucaucauagauggccccaauacuccagagugccccagcgcaucuagggccuggaacgugugggaagucgaggacuaugguuuugggguguucaccacgaauauuuggcugaaacuucgggaaguuuacacacaguugugugaccaccgccucaugucagcugccgugaaggaugagagagcaguacacgcggacaugggauacuggaucgagagucagaaaaacggcagcuggaagcuggaaaaagccucccuaauugaggucaagaccugcacuuggccuaagucucauacccuguggucgaauggugugcucgaaagcgauaugaucauaccaaaaucccuggcuggcccgaucucacagcacaacuauaggcccggguaccauacacaaacugccggaccuuggcaccuuggcaaguuggagcuggacuuuaauuauugcgaggggaccacaguggucauuacggaaaacuguggaacccguggcccaaguuuacggacuacaaccguuucugguaaacucauccacgaguggugcugucgaagcugcacucugcccccucuuagauacaugggggaagauggauguugguauggcauggagauuaggccaaucuccgaaaaggaggagaauauggugaaaucacugguaagcgcagguucuggcaagguggacaacuucacaaugggggucuugugccucgcuauacuguuugaagaggugaugcgcggaaaguucggcaaaaagcauaugauugccgggguuuucuuuaccuucgugcuacugcucuccggacagaucacguggcgggauauggcacacacucugaucaugauuggcaguaaugccagcgacagaauggguaugggggucaccuaccuugcuuugaucgcgacauuuaaaauucagcccuuccuggccuuaggauuuuuccucaggaagcugaccucucgcgaaaaccuucugcuaggcgugggccucgcaauggcuacuacacugcaauugccggaggauauagaacagauggccaaugggaucgcccugggauuaauggcucucaaacugauuacccaguuugagacauaucagcuuuggacugcacugaucuccuugaccuguucaaacacgauuuucacacucaccguugccuggcgaacugcgacccugauccuagcuggugugagucugcuuccugucugccaaagcucguccaugcggaagucugacuggcucccaaugacaguagccgcaaugggcgugcccccucugcccuuguuuauauucagccugaaggauacuuuaaaacguagaucauggccacucaaugaggggguuauggccgugggacuggucaguauccuugcuuccucucuguugaggaacgacgugccuauggcaggcccccucguagccggugggcugcuaauugcguguuacgugaucaccggaacgagcgcugaucugacagucgaaaaggccgcagacguuaccugggaggaagaggccgaacagacuggcgugucccauaaccuuaugauuacaguggacgaugacggcaccaugcgcaucaaagaugacgagacugagaauauacucacaguccuguugaagaccgcuuuacugauugugucagggaucuuuccauacagcaucccggccacgcuccugguuuggcacacuuggcagaaacagacccggagaaguggaguacuuugggaugugccuucucccccagaaacacaaaaggcagagcuggaagagggugucuauaggauuaaacagcagggcauauucgggaagacccaggugggaguuggcgugcaaaaggagggugucuuucauacaauguggcacgugacucgaggggcuguauugaccuacaacggaaaacgccuagaacccaauugggccuccgucaagaaagaccugaucagcuauggcggcggguggcggcucucggcgcaguggcagaagggagaggaagugcaaguuauugccguggagccugguaaaaacccaaagaauuuccagacgaugcccggcacauuccagacuaccacaggggaaaucggagcaauugcucuggauuuuaagccuggcaccucagguucuccgaucauaaacagagaggggaaagucgugggacuuuacggcaauggcguugugacuaagaacgggggauaugucagugguaucgcccagaccaaugcugagccagacggccccacaccugaauuagaggaagagauguucaaaaagaggaaccugacgauuauggaucuccacccaggguccggaaaaacucguaaguacuugcccgcaaucgugcgcgaagccauuaagcggagacugaggacccucauccuggccccuacacgaguaguggcugcggagauggaggaagcacuuaaaggccugccgauacgguaucaaaccacugccacaaagagcgagcauaccggucgcgaaauuguugacuugaugugccacgcuacguuuacuaugagacuacugucucccgucagggugccaaauuacaaccucaucaucauggaugaggcccauuucacagacccugcaagcauugccgcucggggguacaucuccacccgagugggaaugggcgaagcggccgcaauauuuaugaccgcuacucccccaggcacagccgaugcauucccucagucaaaugcccccauucaggacgaggagagagacaucccagaacgcaguuggaacagcgggaaugaguggauuaccgauuuugcuggaaaaacagucugguucguaccgucuaucaaggccgguaacgacauagcgaacuguuuaaggaaaaauggcaagaaggugauucagcugucccguaaaacuuuugauacggaauaucaaaagaccaaacuuaacgacugggauuucguugugacaacugacaucucagagaugggggcaaauuuuaaggccgaucgggucaucgacccuagaaggugccugaaacccgugauucucaccgauggaccagagcgcguuaucuuggcuggccccaugccugugacagccgcuagugcagcccagcgaagaggucgggucgggaggaacccacagaaggaaaaugaccaguacauuuucaccggccaaccccugaacaaugaugaggaccacgcucauuggacugaagccaagaugcuccuggacaacauaaauacgccugagggaaucauuccggcacuuuucgaaccagagcgcgagaaaagcgcggccaucgauggcgaauaucgucuaaagggggaguccagaaaaaccuuuguggaacugaugcggaggggagacuugcccguaugguuagcucacaagguggccucugaggguaucaaauacacagaucgcaaguggugcuucgacggccagcgaaacaaucagauucuggaagagaacauggauguugagauauggacuaaagaaggggagaagaagaaacucagaccucgguggcuggacgcaaggaccuauucggauccccuugcucugaaggaauuuaaagacuucgccgcaggacgcaagagcaucgcccucgauuuggucacagagauuggcagagugccaucacaccuggcucauaggacccggaaugcgcuagacaaccuggugaugcuccacacuuccgaacauggugggaaagccuaccgucacgcagucgaggagcuuccugaaacaauggagacgcuguuauugcugggccucaugauccugcuuaccggaggcgcuaugcuguuucucauuagugggaagggaaucgguaagacuucuauaggcuugaucuguguuauugccagcuccgggaugcuguggauggccgaaauccccuuacaguggauugcaucagcuaucgugcuagaguucuuuaugaugguacugcucauaccagagccugaaaaacaacgcacaccgcaggauaaucagcuugccuauguggucauuggaauccugaccuuggcggcuauuaucgccgcaaacgagaugggccugcucgaaaccacaaagcgagaccuggguaugucuaaagagcccggggugguuagcccaacuaguuaccuugauguggaccuccacccugccuccgcuuggacgcuguacgcagucgccaccacaguaauaacucccauguugagacauaccaucgaaaauagcacagcgaacgugucucuggcugccauugcaaaccaagccguuguguuaaugggccuagacaagggauggccaaucucaaaaauggaucugggcgucccucuccuugcucuggggugcuauucccaggugaaucccuugacccugacugccgcaguccuccugcuuauuacgcacuacgcuaucauaggaccgggcuuacaggccaaggcgacaagggaggcccagaagcggaccgcagcugguauuaugaaaaacccaacuguggacgggaucaugaccaucgaucuggacccuguuauuuaugauaguaaguucgagaaacaacucggacaggugauguugcugguacuaugugccgugcagcugcuccuuaugcgcacaagcugggcacugugcgaagcuuugacucuggccaccggccccaucacaacgcucugggaggguucgccaggcaaguuuuggaauaccacuauagccgucucuauggcgaacauuuucagaggguccuaccuggcuggagcaggcuuagccuuuagcaucaugaaaucaguugggacaggaaagaggggcaccgguagucagggggaaacucuuggagagaaguggaaaaagaaacugaaucaacucucucggaaggaauucgaccuauauaaaaaguccggcauuacagagguggaucgaaccgaggcuaaagaaggucugaagagaggcgagaucacgcaucacgccgucagccgcgggucagcaaaguugcagugguuuguggaaaggaacaugguaauacccgagggacgggugaucgaccugggcugugggcguggaggcuggaguuacuauugcgccggucucaaaaagguuaccgaagugagaggguacacaaaaggaggcccuggccaugaggagccgguccccaugagcacuuacggguggaauauugugaagcuuauguccggaaaagaugucuucuaucugccaccugaaaagugugacaccuugcugugcgauaucggugagucuagccccuccccuacaguggaagagucaaggacuauucgcguucucaagaugguagagccaugguuaaaaaacaaucaguucuguaucaaggugcugaaccccuacaugccuaccgucauugaacaccuugagcggcugcagcgaaaacacggcgggaugcuagugagaaauccacucucuaggaacaguacacaugaaauguauuggaucucgaauggaaccggcaacauaguugcuagcgugaauauggucucccgccuguugcugaaccgguuuacuaugacgcacagacgucccacaauugagaaggacguggaucucggugcggggaccaggcauguaaacgccgaaccggagacuccuaauauggacgugaucggagagcggaucaaacgcauuaaggaagagcacaacucuaccuggcacuacgacgaugaaaauccauauaagacaugggcauaccauggcucauaugagguuaaagcuacgggcagcgccuccaguaugauaaacggggucgugaagcuucugaccaaacccugggacguggucccuaugguuacucaaauggcaaugacagauaccacuccauucggacagcagcgaguguuuaaggaaaaaguagacacaagaacccccaggucuaugccggguacacggcgcgugaugggcaucacugccgagugguuauggagaacccuggggaggaauaagaagccucgauugugcacgcgggaggaauucaccaaaaagguccguacaaacgcugccaugggagcgguguuuacugaggaaaaucaaugggauagcgcaaaagccgcuguugaggacgaagauuucuggaagcucguggacagagagcgcgagcugcacaaacuaggcaagugugguucaugcgucuacaacaugauggggaaaagggaaaagaagcuuggagaguuuggcaaagccaagggcucccgggcaauuugguacauguggcugggggcuagauaucucgaauucgaggcccugggauuuuugaaugaggaucauugguucagucgcgaaaacagcuacucugguguggagggcgaagggcugcacaaacucggauauauccuuagggacauuuccaagauccccggcggugcuauguacgccgaugacaccgcagggugggacacacgaauaacugaggaugaccugcauaaugaagagaaaaucacccagcagauggauccagagcaccggcaguuagcggacgccauuuuuaagcugacguaucaaaacaagguaguuaaagugcagagaccuacacccaccggaacugucauggauaucauuucaaggaaggaccagcgcggcagcggccagguggggacauacggauugaauaccuucacuaacauggaagcucaacucauccgucagauggagggugaaggcgugcugaccaaagccgaucuagagaauccacaccuuucggaaaagaaaauaacacaguggcuggagacgaagggggucgagcggcucaagagaauggcaauuucuggagacgauugcguugugaaacccaucgacgauagguuugcuaacgcccuguuggcauuaaacgacaugggcaagguacgcaaagauaucccucaguggcaaccaaguaaggguuggcaugacuggcagcaggugccguucuguucccaccauuuccacgaacugauuaugaaagacgggcgaaagcucgucgugcccugccggccucaggaugagcuuauaggaagagccaggaucagccaaggcgcgggcuggucacugcgcgaaaccgcuugucuagggaaggccuaugcacagauguggucccugauguacuuucacagacgggaccucagguuggccucuaaugcuauuugcagcgccguuccagugcauuggguccccacuagucguacaaccugguccauccacgcacaucaccaguggaugacuacagaggauaugcugaccguguggaaccgaguauggauugaagacaauccuuggauggaggauaaaacgccaguuacaaccugggagaacgugcccuaccuuggaaagcgcgaagaccaauggugugguagccugaucggccucacuucuagagcuaccugggcccagaauauaccuacagcgauccagcagguccggucauuaauugggaacgaggaauuccuggauuauaugccgaguaugaaaagguuucgcaaggaggaggaauccgagggagcuaucugguga

SEQ ID NO: 15440 - RNA, 9873 nt, Artificial Sequence
  derived and/or modified CDS sequence (opt3) from DENV-3__FJ182011__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauugcugaaguugagccggaagacaucgauugcugguguaaccugacuaguaccugggugacauaugggaccugcaaucaggccggagagcaccgccgagacaagcguagcguagcacuugccccccaugugggcaugggucuggauacuagaacacaaaccuggauguccgcugagggggcauggaggcaggucgaaaaaguggagacgugggccuugcggcacccuggauucacuauucucgcucuguuucuggcccauuacaucggcaccucucucacacagaagguugugauauucaucuuacugaugcuugucacuccaucgaugaccaugcgcugugugggcguagggaacagagacuuuguugaaggauugucaggugcgacauggguggaugucgugcuggagcacggcgggugcgugaccacgauggcaaagaauaaacccacucuagacauugagcuccagaagacagaagccacccaacuggcuacucuuaggaaacuguguaucgagggaaagauuacaaacaucaccacggauagccggugcccuacccagggcgaagccgucuugccagaggaacaggaccagaauuauguuuguaaacacacauacguggaucgcgguugggggaacggaugcggccucuucggcaaggggagucugguaacuugcgcaaaguuucaauguuuagagcccauagagggaaaagugguccaguaugaaaaucugaaguacaccgugauuaucacaguucauacuggugaccagcaccaggugggcaacgagacccaaggggucacagcugaaauuaccccucaggccuccacuacggaggcgauccucccagaauauggaacacuuggccuggagugcucuccgcgaaccgguuuggacuucaaugagaugauccuacugacuaugaaaaacaaggccuggauggugcauagacagugguuuuucgaucucccccugccuuggaccagcggggcaacaaccgaaacuccaacauggaauaggaaagagcuucugguaacguuuaagaacgcucacgccaaaaagcaagaaguuguggucuugggcucccaggagggagcuaugcacaccgcccucacuggcgcaacagaaauucagaauucagggggaaccaguauauucgccggucaucugaagugucgguuaaaaauggacaagcuggagcuaaaaggcaugagcuacgcuaugugcacaaacacuuuugugcucaagaaagaggucucugaaacccagcacgggacgauccugauuaagguggaguacaagggagaagaugcgcccuguaaaaucccuuucuccaccgaggacggccaagguaaggcacauaacgggcgucuuauaacagccaauccaguugugacuaaaaaggaggaacccguaaacauugaggcugaaccgccuuucggcgagucaaauaucgucaucggaauuggcgauaacgccuugaaaaucaauugguauaagaaggggagcaguauuggaaaaauguuugaagcaaccgcccgcggugcuagaaggauggccauacugggcgacacagcaugggauuucgggucugugggaggcguucucaacucccuggguaagauggugcaccagaucuuugggagcgcguacacugcucuuuucucgggcgucucuugggugaugaaaauuggaaucggcguacuguugaccuggaucgggcucaauuccaagaacacgucaaugaguuuuagcugcauugccauaggaaucauuacacuguauuuaggcgcagugguucaggccgacaccgguugugucaucaauuggaaagggaaggagcugaagugcggauccggcauuuucgugacuaacgaggugcauacauggaccgaacaguacaaauuucaagcugauucucccaagcggcuagccacugcaaucgcuggugccugggagaauggcgucugugggauacgaagcaccacacgcauggaaaaccuccuguggaaacagaucgcgaaugagcuuaacuauauuuugugggaaaauaacaucaagcugacgguuguggugggagacauuaucggcguacucgagcaggggaaaagaacccugacuccacagccuauggaguuaaaguacucauggaaaacauggggaaaggccaagauagucaccgcugaaacacaaaacaguuccuucauuaucgauggccccaauacuccagagugccccagcgcaucuagggccuggaacgugugggaaguugaggacuaugguuuugggguguucaccacgaauauuuggcugaaacuucgggaagucuacacacaguugugugaccaccgccucaugucagcugccgugaaggaugagagagcaguucacgcggacaugggauacuggaucgagagucagaaaaacggcagcuggaagcuggaaaaagccucccuaauagaggugaagaccugcacuuggccuaagucucauacccuguggucgaaugguguacucgaaagcgauaugaucauuccaaaaucccuggcuggcccgaucucacagcacaacuauaggcccggguaccauacacaaacugccggaccuuggcaccuuggcaaguuggagcuggacuuuaauuauugcgaggggaccacagucgugauuacggauaacuguggaacccguggcccaaguuuacggacuacaaccgugucugguaaacucauccacgaauggugcugucgaagcugcacucugcccccucuuagauacaugggggaggacggauguugguauggcauggaaauaaggccaauuuccgagaaggaagagaauauggucaaaucacugguuagcgcagguucuggcaagguggauaacuucacaauggggguauugugccucgcuauccuguuugaggaagugaugcgcggaaaguucggcaaaaagcauaugaucgccggggucuucuuuaccuucgugcuacugcucuccggacagauuacguggcgggacauggcacacacucugaucaugauuggcaguaaugccagcgauagaauggguauggggguuaccuaccuugcuuugauagcgacauuuaaaauccagcccuuccuggccuuaggauuuuuccucaggaagcugaccucucgcgagaaccuucugcuaggcgugggccucgcaauggcuacuacacugcaauugccggaagacauugagcagauggccaaugggaucgcccugggauuaauggcucucaaacugauuacccaguuugaaacauaucagcuuuggacugcacugaucuccuugaccuguucaaacacgauauucacacucaccgucgccuggcgaacugcgacccugauccuagcuggugugagucugcuuccuguuugccaaagcucguccaugcggaagucugauuggcucccaaugacaguggccgcaaugggcguccccccucugcccuuguuuauuuucagccugaaggacacuuuaaaacguagaucauggccacucaaugaggggguaauggccgugggacugguuaguauccuugcuuccucucuguugaggaacgaugugccuauggcaggcccccucgucgccggugggcugcuaauugcguguuacgugaucaccggaacgagcgcugaccugacaguagagaaggccgcagacgugaccugggaagaggaagccgagcagacuggcgucucccauaaccuuaugauaacaguugaugacgauggcaccaugcgcauuaaagacgaugaaacugagaauauccucacagugcuguugaagaccgcuuuacugaucgugucagggauuuuuccauacagcauaccggccacgcuccuggucuggcacacuuggcagaaacagacccggagaaguggagugcuuugggacguuccuucucccccagagacacaaaaggcagaacuggaggaagguguauauaggaucaaacagcagggcauuuucgggaagacccaggugggagucggcgugcaaaaggaggguguuuuucauacaauguggcacgugacucgaggggcugucuugaccuacaacggaaaacgccuagagcccaauugggccuccgugaagaaagaucugaucagcuauggcggcggguggcggcucucggcgcaguggcagaagggagaagagguacaagucauugccguggaaccugguaaaaacccaaagaauuuccagacgaugcccggcacauuccagacuaccacaggggagaucggagcaauagcucuggacuuuaagccuggcaccucagguucuccgaucauuaacagagaagggaaaguugugggacuuuacggcaauggcgucgugacuaagaacgggggauauguuagugguaucgcccagaccaaugcugagccagauggccccacaccugaguuagaagaggaaauguucaaaaagaggaaccugacgauuauggaccuccacccaggguccggaaaaacucguaaguacuugcccgcaaucgugcgcgaggccauaaagcggagacugaggacccucauucuggccccuacacgagucguggcugcggaaauggaggaggcacuuaaaggccugccgauccgguaucaaaccacugccacaaagagcgaacauaccggucgcgagaucguagauuugaugugccacgcuacguuuacuaugagacuacugucucccgugaggguuccaaauuacaaccucauuaucauggacgaagcccauuucacagauccugcaagcauagccgcucggggguacauuuccacccgagucggaaugggcgaggcggccgcaaucuuuaugaccgcuacucccccaggcacagccgacgcauucccucagucaaaugcccccauucaggacgaagagagagauaucccagagcgcaguuggaacagcgggaaugaauggauaaccgacuuugcuggaaaaacagugugguucgugccgucuauuaaggccgguaacgauaucgcgaacuguuuaaggaaaaauggcaagaaggucauccagcugucccguaaaacuuuugacacggaguaucaaaagaccaaacuuaacgauugggacuucguagugacaacugauauuucagaaaugggggcaaauuuuaaggccgaccggguuaucgauccuagaaggugccugaaacccgugauucucaccgacggaccagagcgcgucauauuggcuggccccaugccugugacagccgcuagugcagcccagcgaagaggucggguugggaggaacccacagaaggagaaugaucaguacaucuucaccggccaaccccugaacaaugacgaagaccacgcucauuggacugaggccaagaugcuccuggauaacauuaauacgccugaaggaaucaucccggcacuuuucgagccagaacgcgagaaaagcgcggccauugacggcgaguaucgucuaaagggggaauccagaaaaaccuuuguggagcugaugcggaggggagauuugcccgucugguuagcucacaagguggccucugaagguauaaaauacacagaccgcaaguggugcuucgauggccagcgaaacaaucagauccuggaggaaaacauggacguagagauuuggacuaaagagggggaaaagaagaaacucagaccucgguggcuggaugcaaggaccuauucggacccccuugcucugaaggaguuuaaagauuucgccgcaggacgcaagagcaucgcccucgacuuggugacagaaauuggcagaguuccaucacaccuggcucauaggacccggaaugcgcuagauaaccuggucaugcuccacacuuccgagcauggugggaaagccuaccgucacgcaguggaagagcuuccugagacaauggaaacgcuguuauugcugggccucaugauccugcuuaccggaggcgcuaugcuguuucucauaagugggaagggaaucgguaagacuucuauuggcuugaucugugugauugccagcuccgggaugcuguggauggccgagauccccuuacaguggauagcaucagcuauuguccuagaauucuuuaugaugguucugcucaucccagagccugagaaacaacgcacaccgcaggacaaucagcuugccuaugugguaauuggaauccugaccuuggcggcuauaaucgccgcaaacgaaaugggccugcucgagaccacaaagcgagaucuggguaugucuaaagaacccgggguggucagcccaacuaguuaccuugacguggaccuccacccugccuccgcuuggacgcuguacgcaguugccaccacagugauuacucccauguugagacauaccaucgagaauagcacagcgaacgucucucuggcugccauugcaaaccaagccguaguguuaaugggccuagauaagggauggccaaucucaaaaauggaccugggcguuccucuccuugcucuggggugcuauucccaggugaaucccuugacccugacugccgcaguccuccugcuuauaacgcacuacgcuauuaucggaccgggcuuacaggccaaggcgacaagggaagcccagaagcggaccgcagcugguaucaugaaaaacccaacuguggaugggauuaugaccaucgaccuggauccugucauauaugacaguaaguucgagaaacaacucggacaggugauguugcugguucuaugugccgugcagcugcuccuuaugcgcacaagcugggcacugugcgaggcuuugacucuggccaccggccccauuacaacgcucugggaagguucgccaggcaaguuuuggaauaccacuaucgccguaucuauggcgaacauuuucagaggguccuaccuggcuggagcaggcuuagccuuuagcaucaugaaaucaguggggacaggaaagaggggcaccgguagucagggggagacucuuggagaaaaguggaaaaagaaacugaaucaacucucucggaaggaguucgaucuauauaaaaaguccggcauaacagaagucgaccgaaccgaggcuaaagagggucugaagagaggcgaaaucacgcaucacgccguuagccgcgggucagcaaaguugcagugguuuguggagaggaacauggucauucccgaaggacgggugaucgaucugggcugugggcguggaggcuggaguuacuauugcgccggucucaaaaagguaaccgaggugagaggguacacaaaaggaggcccuggccaugaagagccgguucccaugagcacuuacggguggaauauugugaagcuuauguccggaaaagacgucuucuaucugccaccugagaagugugauaccuugcugugcgacaucggugaaucuagccccuccccuacaguggaggaaucaaggacuauucgcguccucaagaugguggagccaugguuaaaaaacaaucaguucuguaucaagguucugaaccccuacaugccuaccguaauagagcaccuugaacggcugcagcgaaaacacggcgggaugcuagugagaaauccacucucuaggaacaguacacaugagauguauuggauuucgaauggaaccggcaacaucgucgcuagcgugaauaugguuucccgccuguugcugaaccgguuuacuaugacgcacagacgucccacaaucgaaaaggauguggaccucggugcggggaccaggcaugucaacgccgagccggaaacuccuaauauggacgugauuggagagcggauaaaacgcaucaaggaggaacacaacucuaccuggcacuacgaugacgagaauccauauaagacaugggcauaccauggcucauaugaaguaaaagcuacgggcagcgccuccaguaugauuaacggggugguuaagcuucugaccaaacccugggaugucgugccuauggugacucaaauggcaaugacagacaccacuccauucggacagcagcgagucuuuaaggagaaaguugauacaagaacccccaggucuaugccggguacacggcgcgugaugggcaucacugccgaaugguuauggagaacccuggggaggaauaagaagccucgauugugcacgcgggaggaguucaccaaaaagguacguacaaacgcugccaugggagcgguguuuacugaagagaaucaaugggacagcgcaaaagccgcugucgaagaugaggacuucuggaagcucguggauagagaacgcgagcugcacaaacuaggcaagugugguucaugcguuuacaacaugauggggaaaagggagaagaagcuuggagaauuuggcaaagccaagggcucccgggcaauuugguacauguggcugggggcuagauaucucgaguucgaagcccugggauuuuugaaugaggaccauugguucagucgcgagaacagcuacucugguguggaaggcgaggggcugcacaaacucggauauauccuuagggauauauccaagauccccggcggugcuauguacgccgacgacaccgcagggugggauacacgaauuacugaagacgaucugcauaaugaggaaaaaaucacccaccagauggacccagagcaccggcaguuagcgaacgccauuuuuaagcugacguaucagaauaaggucgugaaaguacaaagaccuacacccaccggaacuguuauggauaucauaucaaggaaggaccagcgcggcagcggccagguggggacauacggauugaacaccuucacuaauauggaggcucagcucauucgucaaauggaaggugagggcguccugucgaaagccgaucuagaaaacccacaucuuucugagaagaaaaucacccaguggcuggaaacaaaggggguggagcggcucaagagaauggcaaucaguggagacgauugcguggucaaacccauugacgauagguuugcuaacgcccuguuggcauuaaaugacaugggcaagguucgcaaagauauaccucaguggcagccauccaaggguuggcacgacuggcaacaggugccguucuguagccaucacuuccacgagcugaucaugaaagacgggcgaaagcucguagugcccugccggccucaggaugaacuuauuggaagagccaggaucucacagggcgcgggcuggucccugcgcgagacggcuugucuagggaaggccuaugcacaaauguggucucugauguacuuucauagacgggaccucagguuggccagcaacgcuauuugcagugccgucccagugcacuggguucccaccucccguacuacauggagcauccaugcacaccaucaguggaugaccacugaagauaugcugacaguguggaaucgagucuggauagaggacaacccuuggauggaagauaaaaccccagugacgacaugggagaauguacccuaccuuggaaagcgcgaggaccaguggugugguucucugaucggccucaccucaagagcuacuugggcccaaaacauuccuaccgcgauccagcagguucggaguuuaauugggaaugaagaguuccuggauuauaugccguccaugaaaagguuucgcaaggaagaggagagcgaaggagcuaucugguga

SEQ ID NO: 15441 - RNA, 9873 nt, Artificial Sequence
  derived and/or modified CDS sequence (opt3) from DENV-3__FJ182038__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccacgcuuuucucgggcgucucuugggugaugaaaauuggaaucggcguacuguugacauggaucgggcucaauuccaagaacaccucaaugaguuuuagcugcauugcgauaggagugaucacucuguauuuaggcgcuguuguccaggccgacauggguugugugauuaauuggaaagggaaggagcugaagugcggauccggcaucuucgugacaaacgagguccauaccuggacugaacaguacaaauuucaagcagauucucccaagcggcuagccaccgcuauugccggugcaugggagaauggcguuugugggauccgaagcacaacgcgcauggaaaaccuccuguggaaacagauagcuaaugagcuuaacuauaucuugugggaaaauaacauuaagcugaccguggugguaggagacaucauuggcguccucgagcaggggaaaagaacucugacaccacagccuauggaguuaaaguacucauggaaaaccuggggaaaggccaagaucgugacagcggaaacucaaaacaguuccuucauaauugauggccccaauaccccagagugccccagcgccucuagggcuuggaacguuugggaaguggaggacuaugguuuuggggucuucacgacaaauaucuggcugaaacuucgggaaguguacacccaguugugugaccaccgccucaugucagcagccguuaaggaugagagagcugugcacgccgacaugggauacuggauugagagucagaaaaacggcagcuggaagcuggaaaaagcaucccuaaucgagguaaagacuugcaccuggccuaagucucauacacuguggucgaaugguguccucgaaagcgauaugauaaucccaaaaucccuggcgggcccgauuucacagcacaacuauaggcccggguaccauacucaaaccgccggaccuuggcaccuuggcaaguuggagcuggacuuuaauuauugcgaggggacaacgguggugaucaccgaaaacuguggaacucguggcccaaguuuacggacaaccacugucucugguaaacucauucacgaguggugcugucgaagcugcacacugcccccucuuagauacaugggggaagauggauguugguauggcauggagaucaggccaauauccgaaaaggaggagaauaugguuaaaucacuggugagcgcugguucuggcaagguagacaacuucaccauggggguguugugccucgccauucuguuugaagaggucaugcgcggaaaguucggcaaaaagcauaugaucgcagggguguucuuuacguucguucuacugcucuccggacagaucacuuggcgggauauggcucacacccugauuaugaucggcaguaaugccagcgacaaaauggguaugggggugacauaccuugcauugauugccaccuuuaagauacagcccuuccuggcuuuaggauuuuuccucagaaaacugacuucuagggaaaaccuucugcuaggcgucggccucgcgauggccacaacccugcaauugccggaggauaucgaacagauggcaaaugggauugcucugggauuaauggcccucaagcugaucacacaguuugagacuuaucagcuuuggaccgcccugauuuccuugacguguucaaacacaauguucacccucacuguggcuuggcgcaccgcaacacugauccuagccgguguuagucugcuuccugugugccaaagcucguccaugcgaaagacugacuggcucccaauggcggucgcugccaugggcguacccccucugcccuuguuuauauucucucugaaagauaccuuaaagcggcguagcuggccacucaaugagggggugauggcaguuggacuggugucaauccuugccaguucccuguugagaaacgacgucccuauggcuggcccccucguggcaggugggcugcuaauugccuguuacguaaucacgggaacaucugcggaucugaccguggaaaaagcugccgacauuacuugggaggaagaggcagaacagacaggcgucagccauaaccuuaugaucaccguugacgaugacggcacuaugaggauaaaggaugacgagacagagaauauucucaccgugcuguugaaaacggccuuacugaucguguccggggucuuuccauacucaaucccggcuacucuccugguguggcacaccuggcagaagcagacacaacgcagcggaguucuuugggauguaccuagucccccagaaacccagaaagccgagcuggaagaggguguguaucggauuaagcagcagggcauauucgggaagacacaagucggagugggcguucagaaagaggguguguuucauacuauguggcacgucaccagaggggcaguguugacguacaacggaaagaggcuagaacccaauugggcuucuguaaaaaaggaccugaucuccuauggcggcggguggcgacucagcgcccaguggcaaaaaggagaggaaguccaggugauugcgguugagccugguaagaacccaaagaauuuccagacaaugcccggcacuuuccagaccacaaccggggaaaucggagccauugcacuggauuuuaaaccuggcacuucggguucaccgaucauaaaccgcgaggggaagguggucggacuuuacggcaauggcgugguuaccaaaaacgggggauaugugucugguaucgcucaaacaaaugccgagccagacggccccacgccugaauuagaggaagagauguucaagaaacggaaccugacuauuauggaucuccacccagggaguggaaagaccagaaaguacuugcccgcuaucgucagggaagcaauuaaacgucgccugcggacacucauccuggccccuaccagagugguagccgcugagauggaggaagcgcuuaagggccugccgauaagguaucagacuacagcaaccaaauccgagcauacgggucgagaaauuguggacuugaugugccacgccacuuuuacaaugcggcuacugagccccguucgcgucccaaauuacaaccucaucaucauggaugaggcucauuucaccgacccugccucuauugcagccagaggguacaucagcaccagggugggaaugggcgaagcugcggccauauuuaugacugcaacacccccaggcaccgcugaugccuucccucaguccaaugcacccauucaggacgaggagcgggacaucccagaacgaucauggaacagugggaaugaguggauuacagauuuugccggaaagacugugugguucgucccgagcaucaaagcugguaacgacauagccaacuguuuaagaaagaauggcaagaaaguaauucaacugucucgcaagacguuugauaccgaauaucagaaaacaaagcuuaacgacugggauuucgugguuacuaccgacaucuccgagaugggggcgaauuuuaaagcagauagggugaucgacccucgucggugccugaagcccgucauucucacagauggaccagagagagugaucuuggccggccccaugccuguuaccgcugccucagcugcacagaggcgcggucgaguggggagaaacccacagaaggaaaaugaccaauacauuuucaugggccagccccugaacaaugaugaggaccacgcccauuggacugaagcuaaaaugcuccuggacaacauaaauacgccugagggaaucauuccggcccuuuucgaaccagagcgggagaagagugcagcgaucgauggcgaauauaggcuaaaaggggagagccgcaagaccuuugucgaacugaugcguagaggagacuugcccgugugguuagcccacaaaguagcuuccgaggguaucaaguacacagaucggaaauggugcuucgacggccagaggaacaaucagauucuggaagagaacauggauguggagauauggacuaaggaaggggagaagaaaaagcuccgcccucgauggcuggacgccagaaccuauucugauccccuugcacugaaagaauuuaaggacuucgcugccggacggaaaucgaucgcacucgauuugguuacagagauuggcagggucccaagccaccuggcccaucgcaccagaaaugcucuagacaaccuggugaugcuccacacuucagaacauggugggagggcguaccggcacgccguggaggagcuuccugaaacaauggagacgcuguuauugcugggccucaugauccugcuuaccggaggcgcaaugcuguuucucauuuccgggaagggaaucgguaagacuaguauaggcuugaucugugucauugcuucuagcgggaugcuguggauggccgaaauccccuuacaauggauugccuccgcaaucguucuagaguucuuuaugauggugcugcucauaccagagccugaaaaacagcguacaccgcaggauaaucaacuugcuuauguagugauuggaauccugaccuuggccgcgaccauugcugccaacgagaugggccugcucgaaacaacuaagcgcgaccuggguaugucaaaagagcccggggucgugucuccaacgagcuaccuugauguugaccuccacccugcaagugccuggacccuguacgcuguggcaacaacugucaucacccccauguugcgacauacaauagaaaauuccaccgccaacguaagccuggcggcuaucgccaaccaggcagugguuuuaaugggccuagacaagggauggccaauuucuaaaauggaucugggcgugccucuccuugcccuggggugcuauucacaggucaaucccuugacucugacggcugccgugcuccugcuuaucacacacuacgcaauuaucggaccgggcuuacaggcuaaggccaccagagaggcgcaaaagaggacugccgcagguauaaugaaaaacccaaccgucgacgggauuaugacaaucgaucuggacccugugaucuaugauuccaaguucgagaaacagcucggacagguuauguugcuggugcuaugugcuguacagcugcuccuuaugcggacuaguugggcccugugcgaagcauugacccuggcuacaggccccauuacgacccucugggaggguagcccaggcaaguuuuggaauacuacaaucgccgugucgauggccaacauauuccgcgggucuuaccuggcgggagcuggcuuagcauuuuccauuaugaaaagcgucgggaccggaaagagaggcacugguucacaaggggaaacacuuggagagaaguggaaaaagaaacugaaucagcucaguaggaaggaauucgaccuauauaaaaagucuggcaucaccgagguugaucggacggaggccaaagaaggucugaagcgaggcgagaccacacaucacgcuguguccagagggacugccaaguugcagugguuugucgaacgcaacauggugauucccgagggaaggguaaucgaccugggcugugggcggggaggcuggagcuacuauugcgcaggucucaaaaaggugaccgaaguucguggguacacaaaaggaggcccuggccaugaggagccggugcccaugucaacuuacggguggaauauagucaagcuuaugaguggaaaagauguguucuaucugccaccugaaaagugugacaccuugcugugcgauaucggugagagcucccccucuccuacagucgaagagagcagaaccauuagggugcucaagaugguugagccaugguuaaaaaacaaucaguucuguaucaagguacugaaccccuacaugccuacugugauugaacaccuugagcgccugcaacggaaacacggcgggaugcuaguccgaaauccacucuccagaaacucaacgcaugaaauguauuggaucucuaauggaacaggcaacauuguggccaguguuaauauggugucgaggcuguugcugaaccgcuuuaccaugacucaccggagacccaccaucgagaaggacgucgaucucggugcugggacacgucaugugaacgcggaaccggagacgccuaauauggacguaauaggagagaggauuaaacggaucaaggaagagcacaacagcaccuggcacuacgacgaugaaaauccauauaagacuugggccuaccauggcuccuaugaggugaaagcaacaggcucugcuucaagcaugaucaacgggguugucaagcuucugaccaaacccugggacguggugccuauggucacucagauggccaugacagauaccacaccauucggacagcaacgcguuuuuaaggaaaaaguggacacucgaacccccagauccaugccggguacgaggcggguaaugggcauuaccgcagagugguuauggcgcacacuggggagaaauaagaagccuagguugugcacucgagaggaauucaccaaaaaggugcggacaaacgccgcuaugggagccgucuuuacugaggaaaaucagugggauagugcgaaagcagccguggaggacgaagauuucuggaagcucguugaccgugagagagagcugcacaaacuaggcaagugugguucuugcguguacaacaugauggggaaacgcgaaaagaagcuuggagaguuuggcaaagcuaagggcagcagggccauaugguacauguggcugggggcacgguaucucgaauucgaggcucugggauuuuugaaugaggaucauugguucucaagagaaaacuccuacaguggugucgagggcgaagggcugcacaaacucggauauauccuucgcgacauuagcaagauccccggcggugccauguacgcugaugacaccgccgggugggacacgaggauuacagaggaugaccugcauaaugaagagaaaaucacccagcagauggauccagagcaccgacaauuagcaaacgcgauauuuaagcugacuuaucagaauaaggugguaaaaguucagcggccuacacccaccggaacugugauggacaucauuucuagaaaggaucagaggggcuccggccaagucgggaccuacggauugaacacauucacgaauauggaagcccagcucauccgccagauggagggugaaggcgugcugucaaaagcugaccuagagaacccacaccuucccgaaaagaaaauuacccaguggcuggagacuaaggggguggagcgucuccggagaauggccaucagcggagaugacugcgucguuaagccuauagaugacagguuugcaaacgcucuguuggccuuaaaugauaugggcaaagugcgcaaggacauuccacaauggcagccgucgaaagguuggcaugauuggcagcagguacccuucuguucucaccauuuccacgaacugaucaugaaggacgggcgaaaacucguggucccuugccggccacaagacgagcuuaucggaagagcaaggauuagucagggcgccggcuggucccugcgcgaaacagcgugucuagggaaggcuuaugcccagauguggagccugauguacuuucacagacgggaucucagguuggcaucaaacgccauaugcuccgcugugcccguucauugggugccuaccucucguacuacauggagcauccacgcccaucaccaauggaugaccacggaggacaugcugacagucuggaaucgaguguggauugaagauaacccauggauggaggacaagacccccguaacuaccugggagaauguuccuuaccuuggaaaacgcgaagaucaguggugugguagucugaucggccucacauccagagcaacuugggcucagaacauuccgaccgccauccagcaagugcggagcuuaauagggaaugaggaauuccuggacuauaugccaucuaugaagagguuucgcaaagaggaggaaucagagggagcgaucugguga

SEQ ID NO: 15442 - RNA, 9873 nt, Artificial Sequence
  derived and/or modified CDS sequence (opt3) from DENV-3__FJ182041__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauugcugaaguugagccggaagacaucgauugcugguguaaccugacuaguaccugggugacauaugggaccugcaaucaggccggagagcaccgccgagacaagcguagcguagcacuugccccccaugugggcaugggucuggauacuagaacacaaaccuggauguccgcugagggggcauggaggcaggucgaaaaaguggagacgugggccuugcggcacccuggauucacuauucucgcucuguuucuggcccauuacaucggcaccucucucacacagaagguugugauauucaucuuacugaugcuugucacuccaucgaugaccaugcgcugugugggcguagggaacagagacuuuguugaaggauugucaggugcgacauggguggaugucgugcuggagcacggcgggugcgugaccacgauggcaaagaauaaacccacucuagacauugagcuccagaagacagaagccacccaacuggcuacucuuaggaaacuguguaucgagggaaagauuacaaacaucaccacggauagccggugcccuacccagggcgaagccgucuugccagaggaacaggaccagaauuauguuuguaaacacacauacguggaucgcgguugggggaacggaugcggccucuucggcaaggggagucugguaacuugcgcaaaguuucaauguuuagagcccauagagggaaaagugguccaguaugaaaaucugaaguacaccgugauuaucacaguucauacuggugaccagcaccaggugggcaacgagacccaaggggucacagcugaaauuaccccucaggccuccacuacggaggcgauccucccagaauauggaacacuuggccuggagugcucuccgcgaaccgguuuggacuucaaugagaugauccuacugacuaugaaaaacaaggccuggauggugcauagacagugguuuuucgaucucccccugccuuggaccagcggggcaacaaccgaaacuccaacauggaauaggaaagagcuucugguaacguuuaagaacgcucacgccaaaaagcaagaaguuguggucuugggcucccaggagggagcuaugcacaccgcccucacuggcgcaacagaaauucagaauucagggggaaccaguauauucgccggucaucugaagugucgguuaaaaauggacaagcuggagcuaaaaggcaugagcuacgcuaugugcacaaacacuuuugugcucaagaaagaggucucugaaacccagcacgggacgauccugauuaagguggaguacaagggagaagauguucccuguaaaaucccuuucuccaccgaggacggccaagguaaggcgcauaacgggcgucuuauaacagcaaauccagugguaacuaaaaaggaggaacccgucaacauugaggccgaaccgccuuucggcgagucaaauaucgugaucggaauuggcgauaacgcuuugaaaaucaauugguauaagaaggggagcaguauuggaaaaauguuugaagccaccgcacgcggugccagaaggauggcuauacugggcgacacagccugggauuucgggucuguuggaggcgugcucaacucccuggguaagaugguccaccagaucuuugggagcgcauacacugcgcuuuucucgggcgugucuuggguaaugaaaauuggaaucggcgugcuguugaccuggaucgggcucaauuccaagaacacgucaaugaguuuuagcugcauugcuauaggaaucauuacacuguauuuaggcgccguuguccaggcagacaccgguugugugaucaauuggaaagggaaggagcugaagugcggauccggcauuuucgugacuaacgagguccauacauggaccgaacaguacaaauuucaagccgauucucccaagcggcuagcuacugccaucgcaggugcuugggagaauggcguuugugggauacgaagcaccacacgcauggaaaaccuccuguggaaacagaucgccaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggcgaagauagugaccgccgaaacacaaaacaguuccuucauuaucgauggccccaauacuccagagugccccagcgcuucuagggcauggaacguuugggaaguggaggacuaugguuuuggggucuucaccacgaauauuuggcugaaacuucgggaaguguacacacaguugugugaccaccgccucaugucagccgcuguuaaggaugagagagccgugcacgcagacaugggauacuggaucgagagucagaaaaacggcagcuggaagcuggaaaaagcgucccuaauagagguaaagaccugcacuuggccuaagucucauacccuguggucgaaugguguccucgaaagcgauaugaucauuccaaaaucccuggccggcccgaucucacagcacaacuauaggcccggguaccauacacaaacugcuggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgccgguucuggcaagguagacaacuucacaauggggguguugugccucgcaauccuguuugaagaggucaugcgcggaaaguucggcaaaaagcauaugaucgcugggguguucuuuaccuucguucuacugcucuccggacagauuacguggcgggauauggcccacacucugaucaugauuggcaguaaugcaagcgacagaauggguaugggggugaccuaccuugccuugauagcuacauuuaaaauccagcccuuccuggcguuaggauuuuuccucaggaagcugaccucucgcgaaaaccuucugcuaggcgucggccucgccauggcaacuacacugcaauugccggaggauauugaacagauggcuaaugggaucgcccugggauuaauggcccucaaacugauuacccaguuugagacauaucagcuuuggacugcucugaucuccuugaccuguucaaacacgauauucacacucaccguggcauggcgaacugccacccugauccuagcggguguuagucugcuuccugugugccaaagcucguccaugcggaagucugacuggcucccaaugacagucgcugccaugggcguacccccucugcccuuguuuauuuucagccugaaggauacuuuaaaacguagaucauggccacucaaugagggggugauggcaguuggacuggugaguauccuugccuccucucuguugaggaacgacgucccuauggcuggcccccucguggcaggugggcugcuaauugccuguuacguaaucaccggaacgagcgcggaucugacaguggaaaaggcugccgacgucaccugggaggaagaggcagaacagacuggcguuucccauaaccuuaugauaacaguggacgaugacggcaccaugcgcauuaaagaugacgagacugagaauauccucacagugcuguugaagaccgccuuacugaucgucucagggauuuuuccauacagcauaccggcuacgcuccugguguggcacacuuggcagaaacagacccaacggaguggaguucuuugggauguaccuucucccccagaaacacagaaggccgagcuggaagaggguguguauagaaucaaacagcagggcauuuucgggaagacccaagucggagugggcguucagaaggaggguguguuucauacaauguggcacgucacuaggggggcaguguugaccuacaacggaaaacgacuagaacccaauugggcuuccguaaagaaagaccugaucagcuauggcggcggguggcgccucucggcccaguggcaaaagggagaggaaguccaggugauugcgguugagccugguaaaaacccaaagaauuuccagacgaugcccggcacauuccagacuaccacaggggaaaucggagccauagcacuggauuuuaagccuggcaccucagguucuccgaucauuaaccgggaggggaaaguggucggacuuuacggcaauggcgugguuacuaagaacgggggauaugugagugguaucgcucaaaccaaugccgagccagacggccccacaccugaauuagaggaagagauguucaaaaagagaaaccugacgauuauggaucuccacccaggguccggaaaaacuaggaaguacuugcccgcuaucguccgugaagcaauaaagcgccggcugagaacccucauucuggccccuacaagggugguagccgcugagauggaggaagcgcuuaaaggccugccgauccgauaucagaccacugcaacaaagagcgagcauaccggucgggaaaucguggacuugaugugccacgccacguuuacuaugcgccuacugucucccguuagagucccaaauuacaaccucauuaucauggaugaggcucauuucacagacccugccagcauagcagccaggggguacauuuccacccgggugggaaugggcgaagcugcggccaucuuuaugaccgcaacucccccaggcacagcugaugccuucccucagucaaaugcacccauucaggacgaggagcgagacaucccagaaagaaguuggaacagcgggaaugaguggauaaccgauuuugccggaaaaacagugugguucgucccgucuauuaaggcugguaacgacaucgccaacuguuuacgcaaaaauggcaagaagguaauccaacuguccaggaaaacuuuugauacggaauaucagaagaccaaacuuaacgacugggauuucgugguuacaacugacauuucagagaugggggcgaauuuuaaggcagaucgugugaucgacccucggagaugccugaaacccgucauucucaccgauggaccagagagggugauauuggccggccccaugccuguuacagcugccagugcugcacagcgccgagguagaguggggcggaacccacagaaggaaaaugaccaauacaucuucaccggccagccccugaacaaugaugaggaccacgcccauuggacugaagcuaagaugcuccuggacaacauuaauacgccugagggaaucaucccggcccuuuucgaaccagagagggagaaaagcgcagcgauugauggcgaauaucgccuaaagggggagucccguaaaaccuuugucgaacugaugagacggggagacuugcccgugugguuagcccacaagguagcuucugaggguauaaaauacacagauaggaaguggugcuucgacggccagcgcaacaaucagauccuggaagagaacauggauguggagauuuggacuaaagaaggggagaagaagaaacuccgaccuagauggcuggacgcccggaccuauucggauccccuugcacugaaggaauuuaaagacuucgcugccggaaggaagagcaucgcacucgauuugguuacagagauuggccgcgucccaucacaccuggcccauagaaccaggaaugcucuagacaaccuggugaugcuccacacuuccgaacauggugggaaagcguaccggcacgccguggaggagcuuccugaaacaauggagacgcuguuauugcugggccucaugauccugcuuaccggaggcgcaaugcuguuucucauaagugggaagggaaucgguaagacuucuauuggcuugaucugugucauugcuagcuccgggaugcuguggauggccgaaauccccuuacaauggauagccucagcaauuguucuagaguucuuuaugauggugcugcucaucccagagccugaaaaacagcguacaccgcaggauaaucaacuugcuuauguagugauuggaauccugaccuuggccgcgauaaucgcugccaacgagaugggccugcucgaaaccacaaagcgcgaccuggguaugucuaaagagcccggggucgugagcccaacuaguuaccuugauguugaccuccacccugcauccgccuggacgcuguacgcuguggcaaccacagucauuacucccauguugcgacauaccaucgaaaauagcacagccaacguaucucuggcggcuauugccaaccaggcagugguuuuaaugggccuagacaagggauggccaaucucaaaaauggaucugggcgugccucuccuugcccuggggugcuauucccaggucaaucccuugacccugacugcugccgugcuccugcuuauaacgcacuacgcaauuaucggaccgggcuuacaggcuaaggccacaagagaggcgcaaaagaggaccgccgcagguaucaugaaaaacccaacugucgacgggauuaugaccaucgaucuggacccugugauauaugauaguaaguucgagaaacagcucggacagguuauguugcuggugcuaugugcuguacagcugcuccuuaugcggacaagcugggcccugugcgaagcauugacucuggcuaccggccccauuacaacgcucugggaggguucgccaggcaaguuuuggaauaccacuaucgccgugucuauggccaacauuuuccgcggguccuaccuggcgggagcuggcuuagcauuuagcaucaugaaaucagucgggacaggaaagagaggcaccgguacucaaggggaaacacuuggagagaaguggaaaaagaaacugaaucagcucaguaggaaggaauucgaccuauauaaaaagucuggcauaaccgagguugaucggacggaggccaaagaaggucugaagcgaggcgagaucacccaucacgcuguguccagagggagcgccaaguugcagugguuugucgaacgcaacauggugauucccgagggaaggguaaucgaccugggcugugggcggggaggcuggucauacuauugcgcaggucucaaaaaggugacagaaguucguggguacacuaaaggaggcccuggccaugaggagccggugcccaugaguaccuacggguggaauauugucaagcuuaugagcggaaaagauguguucuaucugccaccugaaaagugugacacauugcugugcgauaucggugaguccucucccagcccuacugucgaagaguccagaaccauuagggugcucaagaugguugagccaugguuaaaaaacaaucaguucuguaucaagguacugaaccccuacaugccuacagugauagaacaccuugagcgccugcaacggaaacacggcgggaugcuaguccgaaauccacucucaagaaacucuacccaugaaauguauuggauuaguaauggaacuggcaacaucguggccucgguuaauauggugagcaggcuguugcugaaccgcuuuacgaugacacaccggagacccaccaucgagaaggacgucgaucucggugcugggacucgucaugugaacgcggaaccggagaccccuaauauggacguaauuggagagaggauaaaacggaucaaggaagagcacaacuccacauggcacuacgacgaugaaaauccauauaagacgugggccuaccauggcucuuaugaggugaaagcaaccggcucagcuagcuccaugauuaacgggguugucaagcuucugacuaaacccugggacguggugccuauggucacacagauggccaugaccgauacuacaccauucggacagcaacgcguuuuuaaggaaaaaguggacacccgaacacccagaaguaugccggguacuaggcggguaaugggcaucaccgcagagugguuauggcgcacgcuggggagaaauaagaagccuagguugugcacccgagaggaauucacaaaaaaggugcggacuaacgccgcuaugggagccgucuuuaccgaggaaaaucagugggauucugcgaaagcagccguggaggacgaagauuucuggaagcucguugaccgugagagagagcugcacaaacuaggcaagugugguagcugcguguacaacaugauggggaaacgcgaaaagaagcuuggagaguuuggcaaagcuaagggcucaagggccauuugguacauguggcugggggcacgguaucucgaauucgaggcucugggauuuuugaaugaggaucauugguucuccagagaaaacaguuacagcggugucgagggcgaagggcugcacaaacucggauauauccuucgcgacauaucuaagauccccggcggugccauguacgcugaugacacagccgggugggacacuaggauuaccgaggaugaccugcauaaugaagagaaaaucacgcagcagauggauccagagcaccgacaauuagcaaacgcgauuuuuaagcugacauaucagaauaaggugguaaaaguucagcggccuacccccacuggaacagugauggacaucauauccagaaaggaucagaggggcucaggccaagucgggaccuacggauugaacacuuucaccaauauggaagcccagcucauucgccagauggagggugaaggcgugcugagcaaagcugaccuagagaacccacaccuuucggaaaagaaaaucacacaguggcuggagacgaaggggguggagcgucucaagcggauggccaucucuggagaugacugcgucguuaaacccauugaugacagauuugcaaacgcucuguuggccuuaaaugauaugggcaaggugaggaaagacauaccucaauggcagccaaguaaggguuggcaugauuggcagcagguaccguucuguucccaccauuuccacgaacugaucaugaaagacgggcgcaagcucgugguccccugccgaccucaagacgagcuuauuggacgggcaagaaucagccagggcgccggcuggucacugagggaaaccgcgugucuagggaaggcuuaugcccagauguggucccugauguacuuucaccgcagagaucuccgguuggcaucuaacgccauuugcagcgcugugccaguucauugggugcccacuaguaggacaaccugguccauccacgcccaucaccaauggaugacuacagaggacaugcugaccgucuggaaucguguguggauagaagauaacccuuggauggaggacaaaacgccaguaacaaccugggagaauguucccuaccuuggaaagcgagaagaucaguggugugguagccugaucggccucacuucucgcgcaaccugggcucagaacauuccuacagccauccagcaagugagaucauuaauugggaaugaggaauuccuggacuauaugccgaguaugaaacgguuuaggaaggaggaggaauccgagggagcgaucugguga

SEQ ID NO: 15443 - RNA, 9873 nt, Artificial Sequence
  derived and/or modified CDS sequence (opt3) from DENV-3__FJ390371__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauugcugaaguugagccggaagacaucgauugcugguguaaccugacuaguaccugggugacauaugggaccugcaaucaggccggagagcaccgccgagacaagcguagcguagcacuugccccccaugugggcaugggucuggauacuagaacacaaaccuggauguccgcugagggggcauggaggcaggucgaaaaaguggagacgugggccuugcggcacccuggauucacuauucucgcucuguuucuggcccauuacaucggcaccucucucacacagaagguugugauauucaucuuacugaugcuugucacuccaucgaugaccaugcgcugugugggcguagggaacagagacuuuguugaaggauugucaggugcgacauggguggaugucgugcuggagcacggcgggugcgugaccacgauggcaaagaauaaacccacucuagacauugagcuccagaagacagaagccacccaacuggcuacucuuaggaaacuguguaucgagggaaagauuacaaacaucaccacggauagccggugcccuacccagggcgaagccgucuugccagaggaacaggaccagaauuauguuuguaaacacacauacguggaucgcgguugggggaacggaugcggccucuucggcaaggggagucugguaacuugcgcaaaguuucaauguuuagagcccauagagggaaaagugguccaguaugaaaaucugaaguacaccgugauuaucacaguucauacuggugaccagcaccaggugggcaacgagacccaaggggucacagcugaaauuaccccucaggccuccacuacggaggcgauccucccagaauauggaacacuuggccuggagugcucuccgcgaaccgguuuggacuucaaugagaugauccuacugacuaugaaaaacaaggccuggauggugcauagacagugguuuuucgaucucccccugccuuggaccagcggggcaacaaccgaaacuccaacauggaauaggaaagagcuucugguaacguuuaagaacgcucacgccaaaaagcaagaaguuguggucuugggcucccaggagggagcuaugcacaccgcccucacuggcgcaacagaaauucagaauucagggggaaccaguauauucgccggucaucugaagugucgguuaaaaauggacaagcuggagcuaaaaggcaugagcuacgcuaugugcacaaacacuuuugugcucaagaaagaggucucugaaacccagcacgggacgauccugauuaagguggaguacaagggagaagaugcgcccuguaaaaucccuuucuccaccgaggacggccaagguaaggcacauaacgggcgucuuauaacagccaauccaguugugacuaaaaaggaggaacccguaaacauugaggcugaaccgccuuucggcgagucaaauaucgucaucggaauuggcgauaacgccuugaaaaucaauugguauaagaaggggagcaguauuggaaaaauguuugaagcaaccgcccgcggugcuagaaggauggccauacugggcgacacagcaugggauuucgggucugugggaggcguucucaacucccuggguaagauggugcaccagaucuuugggagcgcguacacugcucuuuucucgggcgucucuugggugaugaaaauuggaaucggcguacuguugaccuggaucgggcucaauuccaagaacacgucaaugaguuuuagcugcauugccauaggaaucauuacacuguauuuaggcgcagugguucaggccgacaccgguugugucaucaauuggaaagggaaggagcugaagugcggauccggcauuuucgugacuaacgaggugcauacauggaccgaacaguacaaauuucaagcugauucucccaagcggcuagccacugcaaucgcuggugccugggagaauggcgucugugggauacgaagcaccacacgcauggaaaaccuccuguggaaacagaucgcgaaugagcuuaacuauauuuugugggaaaauaacaucaagcugacgguuguggugggagacauuaucggcguacucgagcaggggaaaagaacccugacuccacagccuauggaguuaaaguacucauggaaaacauggggaaaggccaagauagucaccgcugaaacacaaaacaguuccuucauuaucgauggccccaauacuccagagugccccagcgcaucuagggccuggaacgugugggaaguugaggacuaugguuuugggguguucaccacgaauauuuggcugaaacuucgggaagucuacacacaguugugugaccaccgccucaugucagcugccgugaaggaugagagagcaguucacgcggacaugggauacuggaucgagagucagaaaaacggcagcuggaagcuggaaaaagccucccuaauagaggugaagaccugcacuuggccuaagucucauacccuguggucgaaugguguacucgaaagcgauaugaucauuccaaaaucccuggcuggcccgaucucacagcacaacuauaggcccggguaccauacacaaacugccggaccuuggcaccuuggcaaguuggagcuggacuuuaauuauugcgaggggaccacagucgugauuacggaaaacuguggaacccguggcccaaguuuacggacuacaaccgugucugguaaacucauccacgaguggugcugucgaagcugcacucugcccccucuuagauacaugggggaagauggauguugguauggcauggagauaaggccaauuuccgaaaaggaggagaauauggucaaaucacugguuagcgcagguucuggcaagguggacaacuucacaauggggguauugugccucgcuauccuguuugaagaggugaugcgcggaaaguucggcaaaaagcauaugaucgccggggucuucuuuaccuucgugcuacugcucuccggacagauuacguggcgggauauggcacacacucugaucaugauuggcaguaaugccagcgacagaauggguauggggguuaccuaccuugcuuugauagcgacauuuaaaauccagcccuuccuggccuuaggauuuuuccucaggaagcugaccucucgcgaaaaccuucugcuaggcgugggccucgcaauggcuacuacacugcaauugccggaggauauugaacagauggccaaugggaucgcccugggauuaauggcucucaaacugauuacccaguuugagacauaucagcuuuggacugcacugaucuccuugaccuguucaaacacgauauucacacucaccgucgccuggcgaacugcgacccugauccuagcuggugugagucugcuuccuguuugccaaagcucguccaugcggaagucugacuggcucccaaugacaguggccgcaaugggcguccccccucugcccuuguuuauuuucagccugaaggauacuuuaaaacguagaucauggccacucaaugaggggguaauggccgugggacugguuaguauccuugcuuccucucuguugaggaacgacgugccuauggcaggcccccucgucgccggugggcugcuaauugcguguuacgugaucaccggaacgagcgcugaucugacaguagaaaaggccgcagacgugaccugggaggaagaggccgaacagacuggcgucucccauaaccuuaugauaacaguugacgaugacggcaccaugcgcauuaaagaugacgagacugagaauauccucacagugcuguugaagaccgcuuuacugaucgugucagggauuuuuccauacagcauaccggccacgcuccuggucuggcacacuuggcagaaacagacccggagaaguggagugcuuugggauguuccuucucccccagaaacacaaaaggcagagcuggaagaggguguauauaggaucaaacagcagggcauuuucgggaagacccaggugggagucggcgugcaaaaggaggguguuuuucauacaauguggcacgugacucgaggggcugucuugaccuacaacggaaaacgccuagaacccaauugggccuccgugaagaaagaccugaucagcuauggcggcggguggcggcucucggcgcaguggcagaagggagaggaaguacaagucauugccguggagccugguaaaaacccaaagaauuuccagacgaugcccggcacauuccagacuaccacaggggaaaucggagcaauagcucuggauuuuaagccuggcaccucagguucuccgaucauuaacagagaggggaaaguugugggacuuuacggcaauggcgucgugacuaagaacgggggauauguuagugguaucgcccagaccaaugcugagccagacggccccacaccugaauuagaggaagagauguucaaaaagaggaaccugacgauuauggaucuccacccaggguccggaaaaacucguaaguacuugcccgcaaucgugcgcgaagccauaaagcggagacugaggacccucauucuggccccuacacgagucguggcugcggagauggaggaagcacuuaaaggccugccgauccgguaucaaaccacugccacaaagagcgagcauaccggucgcgaaaucguagacuugaugugccacgcuacguuuacuaugagacuacugucucccgugaggguuccaaauuacaaccucauuaucauggaugaggcccauuucacagacccugcaagcauagccgcucggggguacauuuccacccgagucggaaugggcgaagcggccgcaaucuuuaugaccgcuacucccccaggcacagccgaugcauucccucagucaaaugcccccauucaggacgaggagagagacaucccagaacgcaguuggaacagcgggaaugaguggauaaccgauuuugcuggaaaaacagugugguucgugccgucuauuaaggccgguaacgacaucgcgaacuguuuaaggaaaaauggcaagaaggucauccagcugucccguaaaacuuuugauacggaauaucaaaagaccaaacuuaacgacugggauuucguagugacaacugacauuucagagaugggggcaaauuuuaaggccgaucggguuaucgacccuagaaggugccugaaacccgugauucucaccgauggaccagagcgcgucauauuggcuggccccaugccugugacagccgcuagugcagcccagcgaagaggucggguugggaggaacccacagaaggaaaaugaccaguacaucuucaccggccaaccccugaacaaugaugaggaccacgcucauuggacugaagccaagaugcuccuggacaacauuaauacgccugagggaaucaucccggcacuuuucgaaccagagcgcgagaaaagcgcggccauugauggcgaauaucgucuaaagggggaguccagaaaaaccuuuguggaacugaugcggaggggagacuugcccgucugguuagcucacaagguggccucugaggguauaaaauacacagaucgcaaguggugcuucgacggccagcgaaacaaucagauccuggaagagaacauggauguagagauuuggacuaaagaaggggagaagaagaaacucagaccucgguggcuggacgcaaggaccuauucggauccccuugcucugaaggaauuuaaagacuucgccgcaggacgcaagagcaucgcccucgauuuggugacagagauuggcagaguuccaucacaccuggcucauaggacccggaaugcgcuagacaaccuggucaugcuccacacuuccgaacauggugggaaagccuaccgucacgcaguggaggagcuuccugaaacaauggagacgcuguuauugcugggccucaugauccugcuuaccggaggcgcuaugcuguuucucauaagugggaagggaaucgguaagacuucuauuggcuugaucugugugauugccagcuccgggaugcuguggauggccgaaauccccuuacaguggauagcaucagcuauuguccuagaguucuuuaugaugguucugcucaucccagagccugaaaaacaacgcacaccgcaggauaaucagcuugccuaugugguaauuggaauccugaccuuggcggcuauaaucgccgcaaacgagaugggccugcucgaaaccacaaagcgagaccuggguaugucuaaagagcccgggguggucagcccaacuaguuaccuugauguggaccuccacccugccuccgcuuggacgcuguacgcaguugccaccacagugauuacucccauguugagacauaccaucgaaaauagcacagcgaacgucucucuggcugccauugcaaaccaagccguaguguuaaugggccuagacaagggauggccaaucucaaaaauggaucugggcguuccucuccuugcucuggggugcuauucccaggugaaucccuugacccugacugccgcaguccuccugcuuauaacgcacuacgcuauuaucggaccgggcuuacaggccaaggcgacaagggaggcccagaagcggaccgcagcugguaucaugaaaaacccaacuguggacgggauuaugaccaucgaucuggacccugucauauaugauaguaaguucgagaaacaacucggacaggugauguugcugguucuaugugccgugcagcugcuccuuaugcgcacaagcugggcacugugcgaagcuuugacucuggccaccggccccauuacaacgcucugggaggguucgccaggcaaguuuuggaauaccacuaucgccguaucuauggcgaacauuuucagaggguccuaccuggcuggagcaggcuuagccuuuagcaucaugaaaucaguggggacaggaaagaggggcaccgguagucagggggaaacucuuggagagaaguggaaaaagaaacugaaucaacucucucggaaggaauucgaccuauauaaaaaguccggcauaacagaggucgaucgaaccgaggcuaaagaaggucugaagagaggcgagaucacgcaucacgccguuagccgcgggucagcaaaguugcagugguuuguggaaaggaacauggucauucccgagggacgggugaucgaccugggcugugggcguggaggcuggaguuacuauugcgccggucucaaaaagguaaccgaagugagaggguacacaaaaggaggcccuggccaugaggagccgguucccaugagcacuuacggguggaauauugugaagcuuauguccggaaaagaugucuucuaucugccaccugaaaagugugacaccuugcugugcgauaucggugagucuagccccuccccuacaguggaagagucaaggacuauucgcguccucaagaugguggagccaugguuaaaaaacaaucaguucuguaucaagguucugaaccccuacaugccuaccguaauagaacaccuugagcggcugcagcgaaaacacggcgggaugcuagugagaaauccacucucuaggaacaguacacaugaaauguauuggauuucgaauggaaccggcaacaucgucgcuagcgugaauaugguuucccgccuguugcugaaccgguuuacuaugacgcacagacgucccacaaucgagaaggacguggaucucggugcggggaccaggcaugucaacgccgaaccggagacuccuaauauggacgugauuggagagcggauaaaacgcaucaaggaagagcacaacucuaccuggcacuacgacgaugaaaauccauauaagacaugggcauaccauggcucauaugagguaaaagcuacgggcagcgccuccaguaugauuaacggggugguuaagcuucugaccaaacccugggacgucgugccuauggugacucaaauggcaaugacagauaccacuccauucggacagcagcgagucuuuaaggaaaaaguugacacaagaacccccaggucuaugccggguacacggcgcgugaugggcaucacugccgagugguuauggagaacccuggggaggaauaagaagccucgauugugcacgcgggaggaauucaccaaaaagguacguacaaacgcugccaugggagcgguguuuacugaggaaaaucaaugggauagcgcaaaagccgcugucgaggacgaagauuucuggaagcucguggacagagagcgcgagcugcacaaacuaggcaagugugguucaugcguuuacaacaugauggggaaaagggaaaagaagcuuggagaguuuggcaaagccaagggcucccgggcaauuugguacauguggcugggggcuagauaucucgaauucgaggcccugggauuuuugaaugaggaucauugguucagucgcgaaaacagcuacucugguguggagggcgaagggcugcacaaacucggauauauccuuagggacauauccaagauccccggcggugcuauguacgccgaugacaccgcagggugggacacacgaauuacugaggaugaccugcauaaugaagagaaaaucacccagcagauggauccagagcaccggcaguuagcgaacgccauuuuuaagcugacguaucaaaauaaggucgugaaaguacagagaccuacacccaccggaacuguuauggacaucauaucaaggaaggaucagcgcggcagcggccagguggggacauacggauugaacaccuucacuaauauggaagcucaacucauucgucagauggagggugaaggcguccugaccaaagccgaccuagagaacccacaccuuucggaaaagaaaaucacacaguggcuggagacgaaggggguggagcggcucaagagaauggcaaucucuggagaugacugcguggucaaacccauugaugacagguuugcuaacgcccuguuggcauuaaaugauaugggcaagguucgcaaagacauaccucaguggcaaccaaguaaggguuggcaugauuggcagcaggugccguucuguucccaccauuuccacgaacugaucaugaaagacgggcgaaagcucguagugcccugccggccucaggacgagcuuauuggaagagccaggaucagccaaggcgcgggcuggucacugcgcgaaaccgcuugucuagggaaggccuaugcacagauguggucccugauguacuuucacagacgggaucucagguuggccucuaacgcuauuugcagcgccgucccagugcauuggguucccacuagucguacaaccugguccauccacgcacaucaccaguggaugacuacagaggacaugcugaccguguggaaucgagucuggauagaagauaacccuuggauggaggacaaaacgccagugacaaccugggagaauguacccuaccuuggaaagcgcgaagaucaauggugugguagccugaucggccucacuucuagagcuaccugggcccagaacauuccuacagcgauccagcagguucggucauuaauugggaaugaggaauuccuggacuauaugccgaguaugaaaagguuucgcaaggaggaggaauccgagggagcuaucugguga

SEQ ID NO: 15444 - RNA, 9873 nt, Artificial Sequence
  derived and/or modified CDS sequence (opt3) from DENV-3__FJ390372__SS-prME
accagccugugccucaugauggugcuucccgccgcucuggcauuccacuugacauccagagacggcgagccuaggaugaucgucgggaagaacgaacggggaaaaucuuuacuguuuaagacugccucagguauuaauauguguacgcuaauagcgauggaucucggcgagaugugcgacgauaccguuacauacaaauguccacauaucacugaaguggagccggaagacauugauugcugguguaaccugaccaguacauggguaaccuaugggacuugcaaucaggcuggagagcaccgccgagacaagcguagcguggcccuugcaccccaugucggcaugggucuggauacaagaacccaaacguggauguccgccgagggggcuuggaggcagguggaaaaaguugagacuugggcauugcggcacccuggauucaccauccucgcccuguuucuggcucauuacauuggcacaucucucacucagaagguggucaucuucauauuacugaugcuugugaccccaucgaugacaaugcgcuguguaggcguugggaacagagacuuuguggaaggauugucaggugccaccugggucgauguggugcuggagcacggcgggugcgucacgacuauggcgaagaauaaacccacacuagacaucgagcuccagaagaccgaagcaacucaacuggccacacuuaggaaacuguguauugagggaaagaucaccaacauuacgaccgauagccggugcccuacacagggcgaagcuguuuugccagaggaacaggaccagaauuauguguguaaacacacuuacguagaucgcgguugggggaacggaugcggccucuucggcaaggggagucuggugaccugcgccaaguuucaauguuuagagcccaucgagggaaaagucgugcaguaugaaaaucugaaguacacaguuauaauuacugugcauaccggugaccagcaccaggucggcaacgagacacaaggggugaccgcagaaaucacuccucaggcuuccacgacagaggccauucucccagaauauggaacccuuggccuggagugcucuccgcgaacugguuuggacuucaaugagaugauccuacugaccaugaaaaacaaggcguggaugguacauagacagugguuuuucgaucucccccugccuuggacaagcggggccaccacugaaacaccaacguggaauaggaaagagcuucugguuaccuuuaagaacgcacacgcuaaaaagcaagaaguggucguguugggcucccaggagggagccaugcacacugcucucacaggcgccaccgaaauccagaauucagggggaacaaguauuuucgcaggucaucugaagugucgguuaaaaauggacaagcuggagcuaaaaggcaugagcuacgccaugugcacuaacaccuuuguccucaagaaagaggugucugaaacgcagcacgggaccauacugaucaagguugaguacaagggagaagaugcucccuguaaaauuccuuucuccacagaggacggccaagguaaggcgcauaacgggcgucuuaucacugcaaauccagugguaaccaaaaaggaggaacccgucaacauagaggccgaaccgccuuucggcgagucaaauauugugaucggaaucggcgauaacgcuuugaaaauuaauugguauaagaaggggagcaguaucggaaaaauguuugaagccacagcacgcggugccagaaggauggcuauucugggcgacacugccugggauuucgggucuguuggaggcgugcucaacucccuggguaagaugguccaccagauauuugggagcgcauacaccgcgcuuuucucgggcgugucuuggguaaugaaaaucggaauuggcgugcuguugacguggaucgggcucaauuccaagaacacaucaaugaguuuuagcugcaucgcuauuggaguuauaacccuguauuuaggcgccgucgugcaggcagacauggguugugugaucaauuggaaagggaaggagcugaagugcggauccggcauuuucgucacuaacgagguucauacauggaccgaacaguacaaauuucaagccgauucucccaagcggcuagcuacugccaucgcaggugcuugggagaauggcgugugugggauucgaagcaccacacgcauggaaaaccuccuguggaaacagaucgccaaugagcuuaacuauauauugugggaaaauaacaucaagcugacggugguagucggagacauuaucggcgugcucgagcaggggaaaagaacccugacuccacagccuauggaguuaaaguacucauggaaaacauggggaaaggcgaagauuguuaccgccgaaacacaaaacaguuccuucaucauagauggccccaauacuccagagugccccagcgcuucuagggcauggaacgugugggaagucgaggacuaugguuuugggguguucaccacgaauauuuggcugaaacuucgggaaguuuacacacaguugugugaccaccgccucaugucagccgcugugaaggaugagagagccguacacgcagacaugggauacuggaucgagagucagaaaaacggcagcuggaagcuggaaaaagcgucccuaauugaggucaagaccugcacuuggccuaagucucauacccuguggucgaauggugugcucgaaagcgauaugaucauaccaaaaucccuggccggcccgaucucacagcacaaccauaggcccggguaucacacacaaacugcuggaccuuggcaccuuggcaaguuggagcuggacuuuaauuacugcgaggggaccacaguggucauuacggaaaacuguggaacccguggcccaaguuuacggacuacaaccguuucugguaaacucauccaugaguggugcugucgaagcugcacucugcccccucuuagauauaugggggaagauggauguugguacggcauggagauuaggccaaucuccgaaaaggaggagaauauggugaaaucacugguaagcgccgguucuggcaagguggacaacuucacaaugggggucuugugccucgcaauacuguuugaagaggugaugcgcggaaaguucggcaaaaagcacaugauugcugggguuuucuuuaccuucgugcuacugcucuccggacagaucacguggcgggauauggcccauacucugaucaugauuggcaguaaugcaagcgacagaauggguaugggggucaccuaucuugccuugaucgcuacauuuaaaauucagcccuuccuggcguuaggauuuuuccucaggaagcugaccucucgcgaaaaccuucugcuaggcgugggccucgccauggcaacuacacugcaauugccggaggauauagaacagauggcuaaugggaucgcccugggauuaauggcccucaaacugauuacccaguuugagacauaccagcuuuggacugcucugaucuccuugaccuguucaaacacgauguucacacucaccguugcauggcgaacugccacccugauucuagcgggugugagucugcuuccugucugccaaagcucguccaugcggaagacagacuggcucccaauggcuguagccgcaaugggcgugcccccucugcccuuguuuaucuucucucugaaggauacuuuaaaacguagaagcuggccacucaaugaggggguuauggccgugggacuggucucaauacuugcuaguucccuguugaggaacgacgugccuauggcaggcccccucguagccggugggcugcuaaucgcguguuaugugauuaccggaacgucugcugaucugacagucgaaaaggccgcagacaucaccugggaggaagaggccgaacagacuggcguuagccacaaccuuaugauuacaguggacgaugacggcaccaugcgcaucaaagaugacgagacugagaauauacucacagugcuguugaagaccgcuuuacugauugucuccgggguguuuccauacucaaucccggccacgcuccugguuuggcauacuuggcagaaacagacccaacggagcggaguacuuugggaugugccuagucccccagaaacacagaaggcagagcuggaagagggugucuacagaaucaaacagcagggcauuuucgggaagacccaagugggaguuggcgugcagaaggagggugucuuucacacaauguggcacgugacuaggggggcuguauugaccuauaacggaaaacgacuagaacccaauugggccucugucaagaaagaccugauauccuacggcggcggguggcgccucagcgcgcaguggcaaaagggagaggaagugcagguuaucgccguggagccugguaaaaacccaaagaauuuccagacgaugcccggcacauuccagacuaccacaggggaaauuggagcaaucgcucuggauuuuaagccuggcaccucggguucaccgauuaucaaccgggaggggaaagucgugggacuuuauggcaauggcguugugacuaagaacgggggauacgucucugguauagcccaaaccaaugcugagccagacggccccacaccugaauuagaggaagagauguucaaaaagagaaaccugacgaucauggaucuccauccagggaguggaaaaacuaggaaguauuugcccgcaauugugcgugaagccaucaagcgccggcugagaacccucauucuggccccuacaaggguaguggcugcggagauggaggaagcacuuaaaggccugccgauccgauaccagaccacugccacaaaguccgagcacaccggucgggaaauaguugacuugaugugccaugcuacguuuacuaugcgccuacugagccccgucagagugccaaauuauaaccucauuaucauggaugaggcccacuucacagacccugcaucuaucgccgcuaggggguacauuagcacccgggugggaaugggcgaagcggccgcaaucuuuaugaccgcuacucccccaggcacagccgaugcauucccucaguccaaugcccccauacaggacgaggagaaagacauuccagaacgaucauggaacagugggaaugaguggaucaccgauuuugcuggaaagacagucugguucguaccgagcauuaaagccgguaacgacaucgcgaacuguuuaagaaagaauggcaagaaagugauacaacugucucgcaagacuuuugauacggaauaccagaaaaccaagcuuaacgacugggauuucguugugacaacugacauuuccgagaugggggcaaauuuuaaagccgauagggucaucgacccucgucggugccugaagcccgugauccucaccgauggaccagagagaguuauuuuggcuggccccaugccugugacagccgcuucagcagcccagaggcgcggucgagucgggagaaacccacagaaggaaaaugaccaauauaucuucaccggccagccccugaacaaugaugaggaccaugcucacuggacugaagccaaaaugcuccuggacaacauuaauacgccugagggaauaaucccggcacuuuucgaaccagagcgggagaagagugcggccauugauggcgaauacaggcuaaaaggggagagccgcaagaccuuuguggaacugaugcguagaggagacuugcccguaugguuagcucacaaaguggccuccgaggguaucaaguauacagaucggaaauggugcuucgacggccagaggaacaaucagauccuggaagagaacauggauguugagauuuggacuaaggaaggggagaagaaaaagcuccgcccucgauggcuggacgcaagaaccuacucugauccccuugcucugaaagaauuuaaggacuucgccgcaggacggaaaucgauagcccucgauuuggucacagagaucggcagggugccaagccaucuggcucaccgcaccagaaaugcgcuagacaaccuggugaugcuccauacuucagaacacggugggagggccuaucggcacgcagucgaggagcuuccugaaacaauggagacgcuguuauugcugggccucaugauucugcuuaccggaggcgcuaugcuguuucucaucuccgggaagggaauugguaagacuaguaucggcuugauauguguuaucgccucuagcgggaugcuguggauggccgaaauucccuuacaauggaucgcauccgcuauugugcuagaguucuuuaugaugguacugcucaucccagagccugaaaaacagcguacaccgcaggauaaucaacuugccuacguggucauaggaauucugaccuuggcggcuaucauugccgcaaacgagaugggccugcucgaaaccacaaagcgcgaccuggguaugucaaaagagcccggggugguuucuccaacuagcuaucuugauguggaccuccauccugccagugcuuggacgcuguacgcagucgccaccacaguaaucacucccauguugcgacacaccauagaaaauuccacagcgaacgugagccuggcugccaucgcaaaccaggccguuguguuaaugggccuagacaagggauggccaauuucuaaaauggaucugggcgucccucuccuugcucuggggugcuacucacaggugaaucccuugacccugacugccgcaguccuccugcuuaucacgcauuaugcuauuaucggaccgggcuuacaggccaaggcgacaagagaggcccaaaagaggaccgcagcugguauaaugaaaaacccaacuguggacgggauuaugaccaucgaucuggacccuguuaucuacgauuccaaguucgagaaacagcucggacaggugauguugcugguacuaugugccgugcagcugcuccuuaugcggacaaguugggcacugugcgaagcuuugacucuggccaccggccccauuacaacgcucugggaggguagcccaggcaaguuuuggaauaccacuaucgccgucucgauggcgaacauauuccgcgggucuuaucuggcuggagcaggcuuagccuuuuccauuaugaaaagcguugggacaggaaagagaggcaccgguucacaaggggaaacucuuggagagaaguggaaaaagaaacugaaucagcucaguaggaaggaauucgaccuauacaaaaagucuggcaucacagagguggaucggaccgaggcuaaagaaggucugaagcgaggcgagacgacccaccaugccgucuccagagggacagcaaaguugcagugguuuguggaacgcaacaugguaauucccgagggaagggugaucgaccugggcugugggcggggaggcuggagcuauuacugcgccggucucaaaaagguuacugaagugcguggguauaccaaaggaggcccuggccacgaggagccgguccccaugucaacauacggguggaauauagugaagcuuaugaguggaaaagaugucuucuaccugccaccugaaaagugugacacuuugcugugcgauaucggugagagcucccccucuccuaccguggaagagagcagaacaauuaggguucucaagaugguagagccaugguuaaaaaacaaucaguucuguaucaaggugcugaaccccuauaugccuaccgucauugaacaccuugagcgccugcaacggaaacauggcgggaugcuagugcgaaauccacucuccagaaacucaacucacgaaauguacuggaucucuaauggaacgggcaacauuguugcuagugugaauauggucucgaggcuguugcugaaccgcuuuacaaugacccaucggagacccacuaucgagaaggacguggaucucggugcggggacccgucacguaaacgccgaaccggagacaccuaauauggacgugauaggagagaggauuaaacggaucaaggaagagcacaacagcacguggcauuaugacgaugaaaauccauacaagaccugggcauaucacggcuccuacgagguuaaagcuacuggcucugccucaagcaugaucaacggggucgugaagcuucugacaaaacccugggacguggucccuaugguuacccagauggcaaugacugauacaaccccauucggacaucagcgcguguuuaaggaaaaaguagacacacgaacucccagauccaugccggguccuaggcgggccaugggcauuaccgcugagugguuauggcgcacgcuggggagaaauaagaagcccagguugugcacccgagaggaauucacaaaaaagggacggacuaacgccgcgaugggcgcaguguuuaccgaggaaaaucaaugggauagugccaaagcugccgucgaggacgaagauuucuggaagcucguggaccgugagagagagcugcacaaacuagguaagugugggucuugcguuuauaacaugaugggaaaacgcgaaaagaagcuuggcgaguuuggcaaagcaaaggggagcagggcuauaugguacauguggcugggagcccgguaccucgaauucgaggcucuggguuuuuugaaugaggaucauugguucucaagagaaaacuccuauaguggcguggagggggaaggacugcacaaacucggcuacauccuucgcgacauuagcaagaucccagguggggccauguaugcagaugcgacagccggaugggacacuaggauuaccgaggacgaucugcacaaugaagagaaaaucacgcagcagauggacccugaucaucgacaguuagcuacagccauauuuaagcugaccuaccaaaacaaggucgugaaaguacagcggcccacuccaacaggcaccguuauggacaucauuucuagaaaggaucagaggggcuccgggcaggugggaacuuaugguuugaauaccuucacaaacauggaggcacaacucauccgccagauggaaggcgaggggguccugucaaaagcugaccuagaaaauccccaccuuccugagaagaaaauuacgcaguggcuggaaaccaagggaguggagcgucuccggagaauggccaucagcggcgaugacugcguggucaagccaauagaugacagguuugcaaacgcccuguuggcguuaaacgauauggguaaaguucgcaaggacauuccgcaguggcaacccucgaaaggguggcaugauuggcagcaggugccuuucuguucucaccacuuccaugagcugaucaugaaggacggacgaaaacucguagugccaugccggccccaggacgaacuuaucggcagagcuaggauuagucaaggcgccggguggucccugcgcgagacugcaugucuaggaaaggccuacgcucagauguggagccugauguauuuucacagacgggaucucagguuggccucaaaugcaauaugcuccgcugucccugugcauuggguuccaacaucucguaccacuuggagcauccacgcccaucaccaguggaugacaaccgaagacaugcugacgguguggaaccgagucuggauugaggauaaucccuggauggaagacaagacaccugugaccacuugggagaacguaccguaccuugguaaacgcgaggaucaaugguguggcagucugaucgggcucaccuccagagcgacaugggcucagaauauuccaacugccauccagcagguucggagcuuaauaggaaacgaagaguuccuggacuacaugcccucuaugaagagguuucgcaaagaagaggagucagaaggcgcaaucugguga

SEQ ID NO: 15445 - RNA, 9873 nt, Artificial Sequence
  derived and/or modified CDS sequence (opt3) from DENV-3__FJ205870__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauugcugaaguugagccggaagacaucgauugcugguguaaccugacuaguaccugggugacauaugggaccugcaaucaggccggagagcaccgccgagacaagcguagcguagcacuugccccccaugugggcaugggucuggauacuagaacacaaaccuggauguccgcugagggggcauggaggcaggucgaaaaaguggagacgugggccuugcggcacccuggauucacuauucucgcucuguuucuggcccauuacaucggcaccucucucacacagaagguugugauauucaucuuacugaugcuugucacuccaucgaugaccaugcgcugugugggcguagggaacagagacuuuguugaaggauugucaggugcgacauggguggaugucgugcuggagcacggcgggugcgugaccacgauggcaaagaauaaacccacucuagacauugagcuccagaagacagaagccacccaacuggcuacucuuaggaaacuguguaucgagggaaagauuacaaacaucaccacggauagccggugcccuacccagggcgaagccgucuugccagaggaacaggaccagaauuauguuuguaaacacacauacguggaucgcgguugggggaacggaugcggccucuucggcaaggggagucugguaacuugcgcaaaguuucaauguuuagagcccauagagggaaaagugguccaguaugaaaaucugaaguacaccgugauuaucacaguucauacuggugaccagcaccaggugggcaacgagacccaaggggucacagcugaaauuaccccucaggccuccacuacggaggcgauccucccagaauauggaacacuuggccuggagugcucuccgcgaaccgguuuggacuucaaugagaugauccuacugacuaugaaaaacaaggccuggauggugcauagacagugguuuuucgaucucccccugccuuggaccagcggggcaacaaccgaaacuccaacauggaauaggaaagagcuucugguaacguuuaagaacgcucacgccaaaaagcaagaaguuguggucuugggcucccaggagggagcuaugcacaccgcccucacuggcgcaacagaaauucagaauucagggggaaccaguauauucgccggucaucugaagugucgguuaaaaauggacaagcuggagcuaaaaggcaugagcuacgcuaugugcacaaacacuuuugugcucaagaaagaggucucugaaacccagcacgggacgauccugauuaagguggaguacaagggagaagauguucccuguaaaaucccuuucuccaccgaggacggccaagguaaggcgcauaacgggcgucuuauaacagcaaauccagugguaacuaaaaaggaggaacccgucaacauugaggccgaaccgccuuucggcgagucaaauaucgugaucggaauuggcgauaacgcuuugaaaaucaauugguauaagaaggggagcaguauuggaaaaauguuugaagccaccgcacgcggugccagaaggauggcuauacugggcgacacagccugggauuucgggucuguuggaggcgugcucaacucccuggguaagaugguccaccagaucuuugggagcgcauacacugcgcuuuucucgggcgugucuuggguaaugaaaauuggaaucggcgugcuguugaccuggaucgggcucaauuccaagaacacgucaaugaguuuuagcugcauugcuauaggaaucauuacacuguauuuaggcgccguuguccaggcagacaccgguugugugaucaauuggaaagggaaggagcugaagugcggauccggcauuuucgugacuaacgagguccauacauggaccgaacaguacaaauuucaagccgauucucccaagcggcuagcuacugccaucgcaggugcuugggagaauggcguuugugggauacgaagcaccacacgcauggaaaaccuccuguggaaacagaucgccaaugagcuuaacuauauuuugugggaaaauaacaucaagcugacgguggugguaggagacauuaucggcauacucgagcaggggaaaagaacccugacuccacagccuauggaguuaaaguacucauggaaaacauggggaaaggcgaagauugucaccgccgaaacacaaaacaguuccuucaucauugauggccccaauacuccagagugccccagcgcuucuagggcauggaacgugugggaaguugaggacuaugguuuugggguguucaccacgaauaucuggcugaaacuucgggaagucuacacacaguugugugaccaccgccucaugucagccgcugugaaggaugagagagccguucacgcagacaugggauacuggauagagagucagaaaaacggcagcuggaagcuggaaaaagcgucccuaaucgaggugaagaccugcacuuggccuaagucucauacccuguggucgaaugguguacucgaaagcgauaugauuaucccaaaaucccuggccggcccgauuucacagcacaacuauaggcccggguaccauacacaaacugcuggaccuuggcaccuuggcaaguuggagcuggacuuuaauuauugcgaggggaccacagucgugaucacggaaaacuguggaacccguggcccaaguuuacggacuacaaccgugucugguaaacucauacacgaguggugcugucgaagcugcacucugcccccucuuagauacaugggggaagauggauguugguauggcauggagauuaggccaaucuccgaaaaggaggagaauauggucaaaucacugguuagcgccgguucuggcaagguggacaacuucacaauggggguauugugccucgcaauccuguuugaagaggugaugcgcggaaaguucggcaaaaagcauaugauugcuggggucuucuuuaccuucgugcuacugcucuccggacagaucacguggcgggauauggcccacacucugauuaugauaggcaguaaugcaagcgacagaauggguauggggguuaccuaccuugccuugaucgcuacauuuaaaauucagcccuuccuggcguuaggauuuuuccucaggaagcugaccucucgcgaaaaccuucugcuaggcgugggccucgccauggcaacuacacugcaauugccggaggauaucgaacagauggcuaaugggauugcccugggauuaauggcccucaaacugaucacccaguuugagacauaucagcuuuggacugcucugauauccuugaccuguucaaacacgaucuucacacucaccgucgcauggcgaacugccacccugauucuagcgggugugaguauccugccuguuugccaaagcucguccaugcggaagucugacuggcuuccaaugacaguggcugccaugggcguccccccucucccccuguuuauuuucagcuugaaggauacucugaaacguagaucauggccauuaaaugaggggguaauggcagugggacucguuaguauccuggccuccucucuucugaggaacgacgugccuauggcuggccccuuggucgcaggugggcuccugauagccuguuacgugauuaccggaacgagcgcggaucuaacaguagaaaaggcugccgacgugaccugggaggaagaggcagaacagacuggcgucucccauaaccugaugaucacaguugacgaugacggcaccaugcgcaucaaagaugacgagacugagaauauucuuacagugcuccugaagaccgccuuguuaauagugucagggaucuuuccauacagcauuccggcuacgcugcucgucuggcacacuuggcagaaacagacccggagaaguggagugcugugggauguuccuucucccccagaaacacaaaaggccgagcuugaagaggguguauauaggaucaaacagcagggcauuuucgggaagacccaggugggagucggcgugcaaaaggaggguguuuuucauacaauguggcacgugacucgaggggcaguccugaccuacaacggaaaacgcuuggaacccaauugggcuuccgugaagaaagaccuaaucagcuauggcggcggguggcggcugucggcccaguggcagaagggagaggaaguacaagucauagcgguggagccugguaaaaacccaaagaauuuccagacgaugcccggcacauuccagacuaccacaggggaaaucggagccauugcacucgauuuuaagccuggcaccucagguucuccgaucauuaacagagaggggaaaguugugggacuguacggcaauggcgucgugacuaagaacgggggauauguuagugguaucgcucagaccaaugccgagccagacggccccacaccugaacuugaggaagagauguucaaaaagaggaacuuaacgauaauggaucugcacccaggguccggaaaaacucguaaguaccuccccgcuauugugcgcgaagcaaucaagcggagauugaggacccugauccucgccccuacacgagucguggccgcugagauggaggaagcgcugaaaggccuuccgauucgguaucaaaccacugcaacaaagagcgagcauaccggucgcgaaaucguagaccugaugugccacgccacguuuacuaugagauugcuaucucccgugaggguuccaaauuacaaccugauaauuauggaugaggcucauuucacagacccugccagcaucgcagcccggggguacauuuccacccgagucggaaugggcgaagcugcggccaucuuuaugaccgcaacucccccaggcacagcugaugccuucccucagucaaaugcacccauacaggacgaggagagagacauuccagaacgcaguuggaacagcgggaaugaguggaucaccgauuuugccggaaaaacagugugguucgugccgucuaucaaggcugguaacgacauugccaacugucucaggaaaaauggcaagaaggucauccaguuaucccguaaaacuuuugauacggaauaucaaaagaccaaacugaacgacugggauuucguagugacaacugacauuucagagaugggggcgaauuuuaaggcagaucggguuauagacccuagaaggugccuuaaacccgugauccugaccgauggaccagagcgcgucauucucgccggccccaugccugugacagcugccagugcugcacagcgaagaggucggguugggaggaacccacagaaggaaaaugaccaguacaucuucaccggccaacccuugaacaaugaugaggaccacgcccauuggacugaagcuaagaugcugcucgacaacaucaauacgccugagggaauuauaccggcccuguucgaaccagagcgcgagaaaagcgcagcgaucgauggcgaauaucgucuuaagggggaguccagaaaaaccuuuguggaacuaaugcggaggggagaccugcccgucugguuggcccacaagguggcuucugaggguauuaaauacacagaucgcaaguggugcuucgacggccagcgaaacaaucagaucuuagaagagaacauggauguagagauuuggacuaaagaaggggagaagaagaaacugagaccucgguggcucgacgccaggaccuauucggauccccuggcacuuaaggaauuuaaagacuucgcugccggacgcaagagcaucgcacuggaucucgugacagagauaggcagaguuccaucacacuuggcccauaggacccggaaugcucuggacaaccuagucaugcugcacacuuccgaacauggugggaaagcguaccgucacgccguggaggagcucccugaaacaauggagacgcuucuguuauugggccugaugauccuccugaccggaggcgcaaugcuuuuucugauuagugggaagggaaucgguaagacuucuauuggccucaucugugugauagcuagcuccgggauguuguggauggccgaaauuccccugcaguggaucgccucagcaauugucuuagaguucuuuaugaugguucuacugaucccagagccugaaaaacaacgcacaccgcaggauaaucagcucgcuuaugugguaauaggaauccuuacccuggccgcgauuaucgcugccaacgagaugggcuugcuggaaaccacaaagcgagaccucgguaugucuaaagagcccgggguggucagcccaacuaguuaccuggauguggaccuucacccugcauccgccuggacgcucuacgcuguugcaaccacagugauuacucccaugcugagacauaccaucgaaaauagcacagccaacgucucuuuggcggcuauagccaaccaagcaguagugcugaugggcuuagacaagggauggccaauuucaaaaauggaucuaggcguuccucugcucgcccuugggugcuauucccaggugaauccccugaccuugacugcugccguccugcuccugaucacgcacuacgcaaucauuggaccgggccuucaggcuaaggccacaagggaggcgcagaagcggaccgccgcagguaucaugaaaaacccaacuguggacgggauaaugaccauugauuuagacccugucaucuaugauaguaaguucgagaaacaacugggacaggugaugcucuugguucugugugcugugcagcuacugcucaugcgcacaagcugggcccuuugcgaagcacugacuuuggcuaccggccccauuacaacgcugugggaggguucgccaggcaaguuuuggaauaccacuaucgccguaucuauggccaacauauucagaggguccuaccucgcgggagcuggccuggcauuuagcaucaugaaaucaguggggacaggaaagaggggcaccgguagucagggggaaacuuuaggagagaaguggaaaaagaaacuuaaucaacugucucggaaggaauucgaccucuauaaaaaguccggcauuacagaggucgaucgaaccgaggccaaagaaggucuaaagagaggcgagaucacgcaucacgcuguuagccgcgggucagccaagcugcagugguuuguggaaaggaacauggucauucccgagggacgggugaucgacuugggcugugggcguggaggcuggaguuacuauugcgcaggucugaaaaagguaaccgaagugagaggguacacaaaaggaggcccuggccaugaggagccgguucccaugagcacuuacggguggaauauugugaagcucauguccggaaaagaugucuucuaucuuccaccugaaaagugugacacccuguugugcgauaucggugagucuagccccuccccuacaguggaagagucaaggacuauacgcguccugaagaugguggagccauggcucaaaaacaaucaguucuguauuaagguuuuaaaccccuacaugccuaccguaaucgaacaccuggagcggcuucagcgaaaacacggcgggaugcuggugagaaauccacuaucuaggaacaguacacaugaaauguauuggaucucgaauggaaccggcaacauugucgccagcgugaauaugguuucccgccuccuguugaaccgguuuacuaugacgcacagacgucccacaauagagaaggacguggaucugggugcugggaccaggcaugucaacgcggaaccggagacuccuaauauggacgugaucggagagcggauuaaacgcaucaaggaagagcacaacucuaccuggcacuacgacgaugaaaauccauauaagacaugggccuaccauggcucauaugagguaaaagcaacgggcagcgcuuccaguaugauuaacggggugguuaagcuccuuaccaaacccugggacgucgugccuauggugacucaaauggccaugacagauaccacuccauucggacagcagcgagucuuuaaggaaaaaguugacacaagaacccccaggucuaugccggguacacggcgcgugaugggcaucacugcagaguggcuguggagaaccuuagggaggaauaagaagccucgacugugcacgcgggaggaauucaccaaaaagguacguacaaacgccgcuaugggagccguguuuacugaggaaaaucaaugggauagcgcgaaagcagccgucgaggacgaagauuucuggaaguugguggacagagagcgcgagcuccacaaacugggcaagugugguucaugcguuuacaacaugauggggaaaagggaaaagaagcuaggagaguuuggcaaagcuaagggcucccgggccauaugguacauguggcuuggggcaagauaucuggaauucgaggcucucggauuucugaaugaggaucauugguucagucgcgaaaacagcuacucugguguggagggcgaaggguugcccaaacugggauauauccucagggacauuuccaagaucccaggcggugccauguacgcugaugacaccgccgggugggacacacgaauuacugaggaugaccuucacaaugaagagaaaaucacccagcagauggauccugagcaucggcagcuggcaaacgcgauauuuaaguuaacguaucaaaauaaggucgugaaaguacagagacccacaccaaccggaacuguuauggacauuaucucaaggaaggaucagcgcggcagcggccagguggggacauacggacugaacaccuucacuaauauggaagcccaauugauccgucagauggagggugaaggcguccucucgaaagcugaccuggagaacccccaccuaucugaaaagaaaauuacccaguggcuugagacaaaggggguggagcggcugaagagaauggccauaaguggagaugacugcguggucaaaccuaucgaugacagguuugcaaacgcucuccuggccuugaaugauaugggcaagguucgcaaagacauuccacaguggcaaccguccaaggguuggcacgauuggcagcaggugcccuucuguagccaucacuuccaugaauuaaucaugaaagacgggcgaaagcugguagugccuugccggccacaggacgagcucauuggaagagcaaggaucucacaaggcgccggcuggucccuucgcgaaacggcgugucuggggaaggcuuaugcccagauguggucucuaauguacuuucacagacgggaucugaggcucgcaagcaacgccauaugcagugcuguccccgugcacuggguuccuaccucccguacuacauggagcauccaugcccaccaucaguggaugaccacugaggacauguugacaguguggaaucgagucuggauugaagauaacccauggauggaggacaaaacccccgugacgacaugggagaauguaccuuaccugggaaagcgcgaagaucaauggugugguucucuuaucggccugaccucaagagcaacuugggcucagaacauuccgaccgccauccagcagguucggagucucauugggaaugaggaauucuuagacuauaugccauccaugaaaagguuucgcaaggaggaggaaagcgagggagcgauaugguga

SEQ ID NO: 15446 - RNA, 9873 nt, Artificial Sequence
  derived and/or modified CDS sequence (opt3) from DENV-3__FJ390373__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccgugguaaggcucauaacgggcgccuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagccagaggugcaaggcggauggccauacugggcgacacugcuugggauuucgggucuguuggaggcgugcucaacucccuggguaagaugguccaccaaaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaggcagauucucccaagcgacuagccacugcuaucgccggugcaugggagaauggcguuugugggauacgcagcaccacaagaauggaaaaccuccuguggaaacaaaucgcuaaugagcuuaacuauauuuugugggaaaauaacaucaagcugacgguggugguaggagacaccauuggcguccucgagcaggggaaaaggacucugacaccacagccuauggaguuaaaguacucauggaaaaccuggggaaaggccaagaucgugacagcggaaacucagaacaguuccuucauaauugauggccccaauaccccagagugccccagcgccucucgggcuuggaacguuugggaaguggaggacuaugguuuuggggucuucacgacaaauaucuggcugaaacuucgcgaaguguacacccaauugugugaccacagacucaugucagcagccguuaaggaugagagggcugugcacgccgacaugggauacuggauugagagucagaaaaacggcagcuggaagcuggaaaaagcaucccuaaucgagguaaagacuugcaccuggccuaagucucauacacuguggucgaaugguguccucgaaagcgauaugauaaucccaaaaucccuggcgggcccgauuucacagcacaacuaucgucccggguaccauacucagaccgccggaccuuggcaccuuggcaaguuggagcuggacuuuaauuauugcgaggggacaacgguggugaucaccgaaaacuguggaacucggggcccaaguuuacgaacaaccacugucucugguaaacucauucacgaguggugcuguagaagcugcacacugcccccucuuagguacaugggggaagauggauguugguauggcauggagauccgcccaauauccgaaaaggaggagaauaugguuaaaucacuggugagcgcugguucuggcaagguagacaacuucaccauggggguguugugccucgccauucuguuugaagaggucaugcggggaaaguucggcaaaaagcauaugaucgcagggguguucuuuacguucguucuacugcucuccggacaaaucacuuggagagauauggcucacacccugauuaugaucggcaguaaugccagcgacaggauggguaugggggugacauaccuugcauugauugccaccuuuaaaauacagcccuuccuggcuuuaggauuuuuccuccgcaagcugacuucucgagaaaaccuucugcuaggcgucggccucgcgauggccacaacccugcaguugccggaggauaucgaacaaauggcaaaugggauugcucugggauuaauggcccucaaacugacaacucaguuugagaccuaucagcuuuggacggcccugaucuccuugacauguucaaacaccauuuucacucucaccguggcuuggcggacagcaacucugauccuagccgguguuagucugcuuccugugugccagagcucguccaugcguaagaccgacuggcucccaaugacggucgcggcuaugggcguacccccucugcccuuguuuauauucucucugaaggauacauuaaaaagaaggagcuggccacucaaugagggggugauggccguuggacuggugucaauccuugcaaguucccuguugcgcaacgacgucccuauggccggcccccucguggcuggugggcugcuaauugcauguuacguaaucaccggaacuucugccgaucugacaguggaaaaggcggcugacgucaccugggaggaagaggccgaacaaacuggcguuagccauaaccuuaugauuacaguggacgaugacggcaccaugcggaucaaagaugacgagacggagaauauacucacugugcuguugaagaccgcauuacugauugucuccgggaucuuuccauacucaaucccggccacacuccugguguggcacaccuggcagaaacagacacagagaagcggaguucuuugggauguaccuagucccccagaaacucaaaaggcugagcuggaagaggguguguauaggauuaaacagcagggcauauucgggaagacccaggucggagugggcguucaaaaggaggguguguuucauacgauguggcacgucacacgaggggccguguugacuuacaacggaaaacgccuagaacccaauugggcaucuguaaagaaagaccugaucuccuauggcggcggguggcggcucagcgcucaguggcagaagggagaggaaguccaagugauugccguugagccugguaaaaacccaaagaauuuccagaccaugcccggcacauuccagaccacuaccggggaaaucggagcgauugcccuggauuuuaagccuggcacaucggguucaccgaucauaaacagagaggggaaaguggucggacuuuacggcaauggcgugguuacgaagaacgggggauaugugucugguaucgcacagacuaaugcugagccagacggccccaccccugaauuagaggaagagauguucaaaaagaggaaccugacaauuauggaucuccacccagggaguggaaaaacccguaaguacuugcccgccaucguccgcgaagcuauuaagcggagacugaggacucucauccuggcaccuacacgagugguagccgccgagauggaggaagcucuuaaaggccugccgauacgguaucaaaccacggcgacuaaguccgagcauacaggucgcgaaauuguggacuugaugugccacgcaaccuuuaccaugagacuacugagccccguuagggucccaaauuacaaccucaucaucauggaugaggcccauuucacugacccugcuucuauugccgcacggggguacaucagcacacgagugggaaugggcgaagccgcugcgauauuuaugaccgccacacccccaggcacugcagaugcuuucccucaguccaaugcccccauucaggacgaggagagagacaucccagaacgcucauggaacagugggaaugaguggauuacggauuuugcaggaaaaaccgugugguucgucccgagcaucaaggccgguaacgacauagcuaacuguuuaaggaaaaauggcaagaagguaauucagcugucucguaaaacauuugauacugaauaucaaaagaccaaacuuaacgacugggauuucgugguuacaaccgacaucuccgagaugggggccaauuuuaaggcggaucgggugaucgacccuagaaggugccugaaacccgucauucucacugauggaccagagcgcgugaucuuggcaggccccaugccuguuacggccgcuucagccgcucagcgaagaggucggguggggaggaacccacagaaggaaaaugaccaguacauuuucaccggccaaccccugaacaaugaugaggaccacgcacauuggacagaagccaagaugcuccuggacaacauaaauacuccugagggaaucauuccggcucuuuucgaaccagagcgcgagaaaagugccgcaaucgauggcgaauaucgucuaaagggggagagcagaaaaaccuuugucgaacugaugcggaggggagcguugcccgugugguuagcccacaagguagcuuccgaggguaucaaauacacagaccgcaaguggugcuucgauggccagcgaaacaaucagauucuggaagagaacauggacguggagauauggaccaaagaaggggagaagaagaaacucagaccucgguggcuggaugccaggacuuauucugacccccuugcacugaaggaauuuaaagauuucgcugccggacgcaagucgaucgcacucgacuugguuacagagauuggcagagucccaagccaccuggcccauaggacgcggaaugcucuagauaaccuggugaugcuccacaccucagaacauggugggaaagcguaccgucacgccguggaggagcuuccugaaacuauggagacacuguuauugcugggccucaugauccugcuuaccggaggcgcaaugcuguuucucauuuccgggaagggaaucgguaagaccaguauaggcuugaucugugucauugcuucuagcgggaugcuguggauggccgaaauccccuuacaguggauugccuccgcaaucguucuagaguucuuuaugauggugcugcucauaccagagccugaaaaacaacgcacaccgcaggacaaucagcuugcuuauguagugauuggaauccugacuuuggccgcgauuaucgcugccaacgagaugggccugcucgaaacgaccaagcgagaucuggguaugucaaaagagcccggggucgugucuccaacaagcuaccuugacguugaucuccacccugcaagugccuggacucuguacgcuguggcaaccacagucauaacccccauguugagacauacuaucgaaaauuccacggccaacguaagccuggcggcuauugccaaccaagcagugguuuuaaugggccuagacaagggauggccaaucucuaaaauggaccugggcgugccucuccuugcccuggggugcuauucacaggucaaucccuugacacugaccgcugccgugcuccugcuuauuacucacuacgcaaucauaggaccgggcuuacaggcuaaggccaccagggaggcgcagaagcggacagccgcagguauuaugaaaaacccaacugucgaugggaucaugaccaucgaccuggauccugugauuuaugacuccaaguucgagaaacaacucggacagguuauguugcuggugcuaugugcuguacagcugcuccuuaugcgcacaaguugggcccugugcgaagcauugacgcuggcuaccggccccaucacuacacucugggaggguagcccaggcaaguuuuggaauaccacuauagccgugucgauggccaacauuuucagagggucuuaccuggcgggagcuggcuuagcauuuuccaucaugaaaagcgucgggacaggaaagaggggcaccgguucacagggggaaacgcuuggagagaaguggaaaaagaaacugaaucaacucagucggaaggaauucgaucuauauaaaaagucuggcauuaccgagguugaccgaacagaggccaaagaaggucugaagagaggcgagaucacucaucacgcugugucccgcgggagcgccaaguugcagugguuugucgaaaggaacauggugauacccgagggacggguaaucgaucugggcugugggcguggaggcuggucauacuauugcgcaggucucaaaaaggugaccgaaguuagaggguacacaaaaggaggcccuggccaugaggagccggugcccaugaguacuuacggguggaauauugucaagcuuaugagcggaaaagacguguucuaucugccaccugaaaagugugauaccuugcugugcgacaucggugaguccucucccagcccuacagucgaagaguccaggaccauucgcgugcucaagaugguugagccaugguuaaaaaacaaucaguucuguaucaagguacugaaccccuacaugccuacugugauugaacaccuugagcggcugcagcgaaaacacggcgggaugcuagucagaaauccacucucaaggaacucuacgcaugaaauguauuggaucaguaauggaacaggcaacauaguggccucgguuaauauggugagccgccuguugcugaaccgguuuaccaugacucacagacgucccaccauugagaaggaugucgaccucggugcugggacaaggcaugugaacgcggaaccggagacgccuaauauggauguaaucggagagcggaucaaacgcauuaaggaagagcacaacuccaccuggcacuacgacgacgaaaauccauauaagacuugggccuaccauggcucuuaugaggugaaagcaacaggcucagcuagcuccaugauaaacgggguugucaagcuucugaccaaacccugggauguggugccuauggucacucaaauggccaugacagacaccacaccauucggacagcagcgaguuuuuaaggaaaaaguggauacuagaacccccaggaguaugccggguacgcggcgcguaaugggcaucaccgcagagugguuauggagaacacuggggaggaauaagaagccucgauugugcacucgggaggaauucaccaaaaaggugcguacaaacgccgcuaugggagccgucuuuacugaggaaaaucaaugggacucugcgaaagcagccguggaggaugaagacuucuggaagcucguugauagagagcgcgagcugcacaaacuaggcaagugugguagcugcguguacaacaugauggggaaaagggaaaagaagcuuggagaguuuggcaaagcuaagggcucacgggccauuugguacauguggcugggggcaagauaucucgaauucgaggcucugggauuuuugaaugaggaccauugguucucccgcgaaaacaguuacagcggugucgagggcgaagggcugcacaaacucggauauauccuuagggauauuucuaagauccccggcggugccauguacgcugacgauaccgccgggugggacacgcgaauaacagaggacgaucugcauaaugaagagaaaaucacccagcagauggacccagagcaccggcaguuagcaaacgcgauuuuuaagcugacuuaucaaaauaaggugguaaaaguucagagaccuacacccaccggaacugugauggauaucauuuccaggaaggaccagcgcggcucaggccaggucgggaccuacggauugaacacauucacgaauauggaagcccaacucauccgucagauggagggugaaggcgugcugagcaaagcugaucuagagaacccacaccuucccgaaaagaaaauaacccaguggcuggagacuaaggggguggagcggcucaagagaauggccauuucgggagacgauugcgucguuaaaccuaucgacgauagguuugcaaacgcucuguuggccuuaaaugacaugggcaaggugcgcaaagauaucccacaguggcaaccgucuaaggguuggcaugacuggcagcagguacccuucuguagucaccauuuccacgaacugauuaugaaagaugggcgaaagcucguggucccuugccggccacaggacgagcuuauaggaagagcaaggaucucccaaggcgccggcuggagccugcgcgaaacagcgugucuagggaaggcuuaugcccagauguggucacugauguacuuucacagacgggaccucagguuggcauccaacgccauuugcucugcugugcccguucauugggugccuaccagccguacuacauggaguauccacgcccaucaccaguggaugaccacggaggauaugcugacagucuggaaucgaguguggauugaagacaacccauggauggaggauaaaacccccguaacuaccugggagaauguuccuuaccuuggaaagcgcgaagaccaauggugugguucccugaucggccucacaagcagagcaacuugggcucagaacauaccgaccgccauccagcaggugcggucuuuaauugggaaugaggaauuccuggauuauaugccaucaaugaaaagguuucgcaaggaggaggaaagugagggagcgaucugguga

SEQ ID NO: 15447 - RNA, 9873 nt, Artificial Sequence
  derived and/or modified CDS sequence (opt3) from DENV-3__FJ205871__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacaccauuggcguccucgagcaggggaaaagaacucugacaccacagccuauggaguuaaaguacucauggaaaaccuggggaaaggccaagaucgugacagcggaaacucaaaacaguuccuucauaauugauggccccaauaccccagagugccccagcgccucuagggcuuggaacguuugggaaguggaggacuaugguuuuggggucuucacgacaaauaucuggcugaaacuucgggaagcauacacccaguugugugaccaccgccucaugucagccgcugugaaggaugagagagccguucacgcagacaugggauacuggauugagagucagaaaaacggcagcuggaagcuggaaaaagcgucccuaaucgaggugaagacuugcaccuggccuaagucucauacacuguggucgaaugguguacucgaaagcgauaugauaaucccaaaaucccuggccggcccgauuucacagcacaacuauaggcccggguaccauacucaaaccgcuggaccuuggcaccuuggcaaguuggagcuggacuuuaauuauugcgaggggacaacggucgugaucaccgaaaacuguggaacucguggcccaaguuuacggacaaccacugugucugguaaacucauucacgaguggugcugucgaagcugcacacugcccccucuuagauacaugggggaagauggauguugguauggcauggagaucaggccaauauccgaaaaggaggagaauauggucaaaucacugguuagcgccgguucuggcaagguggacaacuucaccauggggguauugugccucgcaauucuguuugaagaggugaugcgcggaaaguucggcaaaaagcauaugaucgcuggggucuucuuuacguucgugcuacugcucuccggacagaucacuuggcgggauauggcccacacccugauuaugaucggcaguaaugcaagcgacagaauggguauggggguuacauaccuugccuugauugcuaccuuuaaaauacagcccuuccuggcguuaggauuuuuccucaggaagcugacuucucgcgaaaaccuucugcuaggcgugggccucgccauggcaacaacccugcaauugccggaggauaucgaacagauggcuaaugggauugcccugggauuaauggcccucaaacugacaacucaguuugagaccuaucagcuuuggacggcucugaucuccuugacauguucaaacaccauuuucacucucaccgucgcauggcgaacagccacucugauccuagcgggugugagucugcuuccuguuugccaaagcucguccaugcggaagaccgacuggcucccaaugacgguggcugccaugggcguccccccucugcccuuguuuauauucucucugaaggauacauuaaaacguagaagcuggccacucaaugaggggguaauggcagugggacugguuucaauccuugccaguucccuguugaggaacgacgugccuauggcuggcccccucgucgcaggugggcugcuaauugccuguuacgugaucaccggaacuucugcggaucugacaguagaaaaggcugccgacgugaccugggaggaagaggcagaacagacuggcgucagccauaaccuuaugauuacaguugacgaugacggcaccaugcgcaucaaagaugacgagacggagaauauacucacugugcuguugaagaccgccuuacugauuguguccgggaucuuuccauacucaaucccggcuacacuccuggucuggcacaccuggcagaaacagacacaacggagcggagugcuuugggauguuccuagucccccagaaacucagaaggccgagcuggaagaggguguauauagaauuaaacagcagggcauauucgggaagacccaagugggagucggcgugcagaaggaggguguuuuucauacgauguggcacgugacaaggggggcagucuugacuuacaacggaaaacgacuagaacccaauugggcuucugugaagaaagaccugaucuccuauggcggcggguggcgccucagcgcccaguggcaaaagggagaggaaguacaggucauugcgguggagccugguaaaaacccaaagaauuuccagaccaugcccggcacauuccagaccacuaccggggaaaucggagccauugcacuggauuuuaagccuggcacaucggguucaccgaucauaaaccgggaggggaaaguugugggacuuuacggcaauggcgucgugacgaagaacgggggauauguuucugguaucgcucaaacuaaugccgagccagacggccccaccccugaauuagaggaagagauguucaaaaagagaaaccugacaauuauggaucuccacccagggaguggaaaaaccaggaaguacuugcccgcuaucgugcgugaagcaauuaagcgccggcugagaacucucauccuggccccuacaagggucguggccgcugagauggaggaagcgcuuaaaggccugccgauacgauaucagaccacggcaacuaaguccgagcauacaggucgggaaauuguagacuugaugugccacgccaccuuuaccaugcgccuacugagccccgugagaguuccaaauuacaaccucaucaucauggaugaggcucauuucacugacccugccucuauugcagccaggggguacaucagcacacgggucggaaugggcgaagcugcggccauauuuaugaccgcaacacccccaggcacugcugaugccuucccucaguccaaugcacccauucaggacgaggagcgagacaucccagaaagaucauggaacagugggaaugaguggauuacggauuuugccggaaaaaccgugugguucgugccgagcaucaaggcugguaacgacauagccaacuguuuacgcaaaaauggcaagaaggucauucaacugucuaggaaaacauuugauacugaauaucagaagaccaaacuuaacgacugggauuucguagugacaaccgacaucuccgagaugggggcgaauuuuaaggcagaucguguuaucgacccucggagaugccugaaacccgugauucucacugauggaccagagagggucaucuuggccggccccaugccugugacggcugccucagcugcacagcgccgagguagaguugggcggaacccacagaaggaaaaugaccaauacauuuucaccggccagccccugaacaaugaugaggaccacgcccauuggacagaagcuaagaugcuccuggacaacauaaauacuccugagggaaucauuccggcccuuuucgaaccagagagggagaaaagugcagcgaucgauggcgaauaucgccuaaagggggagagccguaaaaccuuuguggaacugaugagacggggagacuugcccgucugguuagcccacaagguggcuuccgaggguaucaaauacacagauaggaaguggugcuucgacggccagcgcaacaaucagauucuggaagagaacauggauguagagauauggaccaaagaaggggagaagaagaaacuccgaccuagauggcuggacgcccggacuuauucugauccccuugcacugaaggaauuuaaagacuucgcugccggaaggaagucgaucgcacucgauuuggugacagagauuggccgcguuccaagccaccuggcccauagaacgaggaaugcucuagacaaccuggucaugcuccacaccucagaacauggugggaaagcguaccggcacgccguggaggagcuuccugaaacuauggagacacuguuauugcugggccucaugauccugcuuaccggaggcgcaaugcuguuucucauuuccgggaagggaaucgguaagaccaguauaggcuugaucugugugauugcuucuagcgggaugcuguggauggccgaaauccccuuacaauggauugccuccgcaaucguccuagaguucuuuaugaugguucugcucauaccagagccugaaaaacagcguacaccgcaggauaaucaacuugcuuaugugguaauuggaauccugacuuuggccgcgauuaucgcugccaacgagaugggccugcucgaaacgaccaagcgcgaccuggguaugucaaaagagcccgggguggucucuccaacaagcuaccuugauguggaccuccacccugcaagugccuggacucuguacgcuguugcaaccacagugauaacccccauguugcgacauacuaucgaaaauuccacggccaacgucagccuggcggcuauugccaaccaggcaguaguguuaaugggccuagacaagggauggccaaucucuaaaauggaucugggcguuccucuccuugcccuggggugcuauucacaggugaaucccuugacacugaccgcugccguccuccugcuuauuacucacuacgcaaucauaggaccgggcuuacaggcuaaggccaccagagaggcgcaaaagaggacagccgcagguauuaugaaaaacccaacuguggacgggaucaugaccaucgaucuggacccugucauuuaugauuccaaguucgagaaacagcucggacaggugauguugcugguucuaugugcugugcagcugcuccuuaugcggacaaguugggcccugugcgaagcauugacgcuggcuaccggccccaucacuacacucugggaggguagcccaggcaaguuuuggaauaccacuauagccguaucgauggccaacauuuuccgcgggucuuaccuggcgggagcuggcuuagcauuuuccaucaugaaaagcguggggacaggaaagagaggcaccgguucacaaggggaaacgcuuggagagaaguggaaaaagaaacugaaucagcucaguaggaaggaauucgaccuauauaaaaagucuggcauuaccgaggucgaucggacagaggccaaagaaggucugaagcgaggcgagaucacucaucacgcuguuuccagagggagcgccaaguugcagugguuuguggaacgcaacauggucauacccgagggaagggugaucgaccugggcugugggcggggaggcuggucauacuauugcgcaggucucaaaaagguaaccgaagugcguggguacacaaaaggaggcccuggccaugaggagccgguucccaugaguacuuacggguggaauauugugaagcuuaugagcggaaaagaugucuucuaucugccaccugaaaagugugacaccuugcugugcgauaucggugaguccucucccagcccuacaguggaagaguccagaaccauuaggguccucaagaugguggagccaugguuaaaaaacaaucaguucuguaucaagguucugaaccccuacaugccuacuguaauugaacaccuugagcgccugcaacggaaacacggcgggaugcuagugcgaaauccacucucaagaaacucuacgcaugaaauguauuggaucaguaauggaacaggcaacauagucgccucggugaauaugguuagcaggcuguugcugaaccgcuuuaccaugacucaccggagacccaccauugagaaggacguggaucucggugcugggacacgucaugucaacgcggaaccggagacgccuaauauggacgugaucggagagaggaucaaacggauuaaggaagagcacaacuccaccuggcacuacgacgaugaaaauccauauaagacuugggccuaccauggcucuuaugagguaaaagcaacaggcucagcuagcuccaugauaaacggggugguuaagcuucugaccaaacccugggacgucgugccuauggugacucagauggccaugacagauaccacaccauucggacagcaacgcgucuuuaaggaaaaaguugacacucgaacccccagaaguaugccggguacgaggcgggugaugggcaucaccgcagagugguuauggcgcacacuggggagaaauaagaagccuagguugugcacucgagaggaauucaccaaaaagguacggacaaacgccgcuaugggagccguguuuacugaggaaaaucagugggauucugcgaaagcagccgucgaggacgaagauuucuggaagcucguggaccgugagagagagcugcacaaacuaggcaagugugguagcugcguuuacaacaugauggggaaacgcgaaaagaagcuuggagaguuuggcaaagcuaagggcucaagggccauuugguacauguggcugggggcacgguaucucgaauucgaggcucugggauuuuugaaugaggaucauugguucuccagagaaaacaguuacagcgguguggagggcgaagggcugcacaaacucggauauauccuucgcgacauuucuaagauccccggcggugccauguacgcugaugacaccgccgggugggacacgaggauaacagaggaugaccugcauaaugaagagaaaaucacccagcagauggauccagagcaccgacaauuagcaaacgcgauuuuuaagcugacuuaucagaauaaggucgugaaaguacagcggccuacacccaccggaacuguuauggacaucauuuccagaaaggaucagaggggcucaggccaaguggggaccuacggauugaacacauucacgaauauggaagcccagcucauccgccagauggagggugaaggcguccugagcaaagcugaccuagagaacccacaccuucccgaaaagaaaauaacccaguggcuggagacuaaggggguggagcgucucaagcggauggccauuucgggagaugacugcguggucaaaccuaucgaugacagauuugcaaacgcucuguuggccuuaaaugauaugggcaagguuaggaaagacaucccacaauggcagccgucuaaggguuggcaugauuggcagcaggugcccuucuguagucaccauuuccacgaacugauuaugaaagacgggcgcaagcucguagugccuugccgaccacaagacgagcuuauaggacgggcaagaaucucccagggcgccggcuggagccugagggaaacagcgugucuagggaaggcuuaugcccagauguggucacugauguacuuucaccgcagagaucuccgguuggcauccaacgccauuugcucugcuguccccgugcauuggguuccuaccagcaggacuacauggaguauccacgcccaucaccaauggaugaccacggaggacaugcugacaguguggaaucgugucuggauugaagauaacccauggauggaggacaaaacccccgugacuaccugggagaauguaccuuaccuuggaaagcgagaagaucaguggugugguucccugaucggccucacaagccgcgcaacuugggcucagaacauaccgaccgccauccagcaaguuagaucuuuaauugggaaugaggaauuccuggacuauaugccaucaaugaaacgguuuaggaaggaggaggaaagugagggagcgaucugguga

SEQ ID NO: 15448 - RNA, 9873 nt, Artificial Sequence
  derived and/or modified CDS sequence (opt3) from DENV-3__FJ390375__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacaccauuggcguccucgagcaggggaaaagaacucugacaccacagccuauggaguuaaaguacucauggaaaaccuggggaaaggccaagaucgugacagcggaaacucaaaacaguuccuucauaauugauggccccaauaccccagagugccccagcgccucuagggcuuggaacguuugggaaguggaggacuaugguuuuggggucuucacgacaaauaucuggcugaaacuucgggaaguguacacccaguugugugaccaccgccucaugucagcagccguuaaggaugagagagcugugcacgccgacaugggauacuggauugagagucagaaaaacggcagcuggaagcuggaaaaagcaucccuaaucgagguaaagacuugcaccuggccuaagucucauacacuguggucgaaugguguccucgaaagcgauaugauaaucccaaaaucccuggcgggcccgauuucacagcacaacuauaggcccggguaccauacucaaaccgccggaccuuggcaccuuggcaaguuggagcuggacuuuaauuauugcgaggggacaacgguggugaucaccgaaaacuguggaacucguggcccaaguuuacggacaaccacugucucugguaaacucauucacgaguggugcugucgaagcugcacacugcccccucuuagauacaugggggaagauggauguugguauggcauggagaucaggccaauauccgaaaaggaggagaauaugguuaaaucacuggugagcgcugguucuggcaagguagacaacuucaccauggggguguugugccucgccauucuguuugaagaggucaugcgcggaaaguucggcaaaaagcauaugaucgcagggguguucuuuacguucguucuacugcucuccggacagaucacuuggcgggauauggcucacacccugauuaugaucggcaguaaugccagcgacagaauggguaugggggugacauaccuugcauugauugccaccuuuaaaauacagcccuuccuggcuuuaggauuuuuccucaggaagcugacuucucgcgaaaaccuucugcuaggcgucggccucgcgauggccacaacccugcaauugccggaggauaucgaacagauggcaaaugggauugcucugggauuaauggcccucaaacugacaacucaguuugagaccuaucagcuuuggacggcccugaucuccuugacauguucaaacaccauuuucacucucaccguggcuuggcgaacagcaacucugauccuagccgguguuagucugcuuccugugugccaaagcucguccaugcggaagaccgacuggcucccaaugacggucgcggcuaugggcguacccccucugcccuuguuuauauucucucugaaggauacauuaaaacguagaagcuggccacucaaugagggggugauggccguuggacuggugucaauccuugcaaguucccuguugaggaacgacgucccuauggccggcccccucguggcuggugggcugcuaauugcauguuacguaaucaccggaacuucugccgaucugacaguggaaaaggcggcugacgucaccugggaggaagaggccgaacagacuggcguuagccauaaccuuaugauuacaguggacgaugacggcaccaugcgcaucaaagaugacgagacggagaauauacucacugugcuguugaagaccgcauuacugauugucuccgggaucuuuccauacucaaucccggccacacuccugguguggcacaccuggcagaaacagacacaacggagcggaguucuuugggauguaccuagucccccagaaacucagaaggcugagcuggaagaggguguguauagaauuaaacagcagggcauauucgggaagacccaagucggagugggcguucagaaggaggguguguuucauacgauguggcacgucacaaggggggccguguugacuuacaacggaaaacgacuagaacccaauugggcaucuguaaagaaagaccugaucuccuauggcggcggguggcgccucagcgcucaguggcaaaagggagaggaaguccaggugauugccguugagccugguaaaaacccaaagaauuuccagaccaugcccggcacauuccagaccacuaccggggaaaucggagcgauugcccuggauuuuaagccuggcacaucggguucaccgaucauaaaccgggaggggaaaguggucggacuuuacggcaauggcgugguuacgaagaacgggggauaugugucugguaucgcacaaacuaaugcugagccagacggccccaccccugaauuagaggaagagauguucaaaaagagaaaccugacaauuauggaucuccacccagggaguggaaaaaccaggaaguacuugcccgccaucguccgugaagcuauuaagcgccggcugagaacucucauccuggcaccuacaagggugguagccgccgagauggaggaagcucuuaaaggccugccgauacgauaucagaccacggcgacuaaguccgagcauacaggucgggaaauuguggacuugaugugccacgcaaccuuuaccaugcgccuacugagccccguuagagucccaaauuacaaccucaucaucauggaugaggcccauuucacugacccugcuucuauugccgcaaggggguacaucagcacacgggugggaaugggcgaagccgcugcgauauuuaugaccgccacacccccaggcacugcagaugcuuucccucaguccaaugcccccauucaggacgaggagcgagacaucccagaaagaucauggaacagugggaaugaguggauuacggauuuugcaggaaaaaccgugugguucgucccgagcaucaaggccgguaacgacauagcuaacuguuuacgcaaaaauggcaagaagguaauucaacugucuaggaaaacauuugauacugaauaucagaagaccaaacuuaacgacugggauuucgugguuacaaccgacaucuccgagaugggggccaauuuuaaggcggaucgugugaucgacccucggagaugccugaaacccgucauucucacugauggaccagagagggugaucuuggcaggccccaugccuguuacggccgcuucagccgcucagcgccgagguagaguggggcggaacccacagaaggaaaaugaccaauacauuuucaccggccagccccugaacaaugaugaggaccacgcacauuggacagaagccaagaugcuccuggacaacauaaauacuccugagggaaucauuccggcucuuuucgaaccagagagggagaaaagugccgcaaucgauggcgaauaucgccuaaagggggagagccguaaaaccuuugucgaacugaugagacggggagacuugcccgugugguuagcgcacaagguagccuccgaggguaucaaauacacagauaggaaguggugcuucgacggccagcgcaacaaucagauucuggaagagaacauggauguggagauauggaccaaagaaggggagaagaagaaacuccgaccuagauggcuggacgcucggacuuauucugauccccuugcccugaaggaauuuaaagacuucgcagcuggaaggaagucgaucgcccucgauuugguuacagagauuggccgcgucccaagccaccuggcacauagaacgaggaaugcccuagacaaccuggugaugcuccacaccucagaacauggugggaaagcuuaccggcacgcgguggaggagcuuccugaaacuauggagacacuguuauugcugggccucaugauccugcuuaccggaggcgccaugcuguuucucauuuccgggaagggaaucgguaagaccaguauaggcuugaucugugucauugcaucuagcgggaugcuguggauggcugaaauccccuuacaauggauugccuccgccaucguucuagaguucuuuaugauggugcugcucauaccagagccugaaaaacagcguacaccgcaggauaaucaacuugcauauguagugauuggaauccugacuuuggcugccauuaucgcggcuaacgagaugggccugcucgaaacgaccaagcgcgaccuggguaugucaaaagagcccggggucgugucuccaacaagcuaccuugauguugaccuccacccugccagugcauggacucuguacgccguggcuaccacagucauaacccccauguugcgacauacuaucgaaaauuccacggcaaacguaagccuggccgcgauugcuaaccaggccgugguuuuaaugggccuagacaagggauggccaaucucuaaaauggaucugggcgugccucuccuugcacuggggugcuauucacaggucaaucccuugacacugaccgccgcugugcuccugcuuauuacucacuacgccaucauaggaccgggcuuacaggcaaaggcuaccagagaggcccaaaagaggacagcggccgguauuaugaaaaacccaacugucgacgggaucaugaccaucgaucuggacccugugauuuaugauuccaaguucgagaaacagcucggacagguuauguugcuggugcuaugugcaguacagcugcuccuuaugcggacaaguugggcucugugcgaagccuugacgcuggcaaccggccccaucacuacacucugggaggguagcccaggcaaguuuuggaauaccacuauagcugugucgauggccaacauuuuccgcgggucuuaccuggccggagcgggcuuagcuuuuuccaucaugaaaagcgucgggacaggaaagagaggcaccgguucacaaggggaaacgcuuggagagaaguggaaaaagaaacugaaucagcucaguaggaaggaauucgaccuauauaaaaagucuggcauuaccgagguugaucggacagaggcaaaagaaggucugaagcgaggcgagaucacucaucacgccguguccagagggagcgcuaaguugcagugguuugucgaacgcaacauggugauacccgagggaaggguaaucgaccugggcugugggcggggaggcuggucauacuauugcgccggucucaaaaaggugaccgaaguucguggguacacaaaaggaggcccuggccaugaggagccggugcccaugaguacuuacggguggaauauugucaagcuuaugagcggaaaagauguguucuaucugccaccugaaaagugugacaccuugcugugcgauaucggugaguccucucccagcccuacagucgaagaguccagaaccauuagggugcucaagaugguugagccaugguuaaaaaacaaucaguucuguaucaagguacugaaccccuacaugccuacugugauugaacaccuugagcgccugcaacggaaacacggcgggaugcuaguccgaaauccacucucaagaaacucuacgcaugaaauguauuggaucaguaauggaacaggcaacauaguggcaucgguuaauauggugagcaggcuguugcugaaccgcuuuaccaugacucaccggagacccaccauugagaaggacgucgaucucggugccgggacacgucaugugaacgcugaaccggagacgccuaauauggacguaaucggagagaggaucaaacggauuaaggaagagcacaacuccaccuggcacuacgacgaugaaaauccauauaagacuugggcguaccauggcucuuaugaggugaaagccacaggcucagcaagcuccaugauaaacgggguugucaagcuucugaccaaacccugggacguggugccuauggucacucagauggcuaugacagauaccacaccauucggacagcaacgcguuuuuaaggaaaaaguggacacucgaacccccagaaguaugccggguacgaggcggguaaugggcaucaccgccgagugguuauggcgcacacuggggagaaauaagaagccuagguugugcacucgagaggaauucaccaaaaaggugcggacaaacgcagccaugggagcugucuuuacugaggaaaaucagugggauucugccaaagcggcaguggaggacgaagauuucuggaagcucguugaccgugagagagagcugcacaaacuaggcaagugugguagcugcguguacaacaugauggggaaacgcgaaaagaagcuuggagaguuuggcaaagccaagggcucaagggcuauuugguacauguggcugggggcccgguaucucgaauucgaggcacugggauuuuugaaugaggaucauugguucuccagagaaaacaguuacagcggugucgagggcgaagggcugcacaaacucggauauauccuucgcgacauuucuaagauccccggcggugcuauguacgccgaugacaccgcugggugggacacgaggauaacagaggaugaccugcauaaugaagagaaaaucacccagcagauggauccagagcaccgacaauuagccaacgcaauuuuuaagcugacuuaucagaauaaggugguaaaaguucagcggccuacacccaccggaacugugauggacaucauuuccagaaaggaucagaggggcucaggccaagucgggaccuacggauugaacacauucacgaauauggaagcgcagcucauccgccagauggagggugaaggcgugcugagcaaagccgaccuagagaacccacaccuucccgaaaagaaaauaacccaguggcuggagacuaaggggguggagcgucucaagcggauggcuauuucgggagaugacugcgucguuaaaccuaucgaugacagauuugccaacgcacuguuggcuuuaaaugauaugggcaaggugaggaaagacaucccacaauggcagccgucuaaggguuggcaugauuggcagcagguacccuucuguagucaccauuuccacgaacugauuaugaaagacgggcgcaagcucguggucccuugccgaccacaagacgagcuuauaggacgggccagaaucucccagggcgcaggcuggagccugagggaaacagccugucuagggaaggcguaugcucagauguggucacugauguacuuucaccgcagagaucuccgguuggccuccaacgcaauuugcucugccgugcccguucauugggugccuaccagcaggacuacauggaguauccacgcucaucaccaauggaugaccacggaggacaugcugacagucuggaaucguguguggauugaagauaacccauggauggaggacaaaacccccguaacuaccugggagaauguuccuuaccuuggaaagcgagaagaucaguggugugguucccugaucggccucacaagccgcgccacuugggcacagaacauaccgaccgcuauccagcaagugagaucuuuaauugggaaugaggaauuccuggacuauaugccaucaaugaaacgguuuaggaaggaggaggaaagugagggagccaucugguga

SEQ ID NO: 15449 - RNA, 9873 nt, Artificial Sequence
  derived and/or modified CDS sequence (opt3) from DENV-3__FJ390376__SS-prME
accagccugugccucaugaugauccuuccagccgcucuggcauuccacuugacuuccagagacggagaaccuaggaugauuguggggaagaacgaacggggaaaaucuuuacuguuuaagacugccucagguauaaauauguguacgcuaaucgcgauggaucucggcgaaaugugcgacgauaccguaacauacaaauguccacauauuacugaaguugaaccggaagacaucgauugcugguguaaccugaccaguacaugggugaccuaugggacuugcaaucaggcuggagaacaccgccgagacaagcguagcguagcccuugcaccccaugugggcaugggucuggauacaagaacccagacguggauguccgccgaaggggcuuggaggcaggucgaaaaaguggagacuugggcauugcggcacccuggauucaccauucucgcccuguuucuggcucauuacaucggcacaucucucacucagaagguugugauauucaccuuacugaugcuugucacaccaucgaugaccaugcgcugugugggcguagggaacagagacuuuguugaaggauugucaggugccacguggguggaugucgugcuggagcacggcgggugcgugacuacaauggcgaagaauaaacccacccuagacaucgagcuccagaagacugaagcaacacaacuggccacccuuaggaaacuguguauugagggaaagaucacgaacauuaccacagauagccggugcccuacucagggcgaagcugucuugccagaggaacaggaccagaauuauguuuguaaacacaccuacguggaucgcgguugggggaacggaugcggccucuucggcaaggggagucugguaacaugcgccaaguuucaauguuuagagcccaucgagggaaaagugguccaguaugaaaaucugaaguacacugugauaauuaccguucauacaggugaccagcaccaggugggcaacgagacccaaggggucacugcagaaaucacgccucaggcuuccacaaccgaggccauucucccagaauauggaacucuuggccuggagugcucuccgcgaaccgguuuggacuucaaugagaugauccuacugacaaugaaaaacaaggcguggauggugcauagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcacacagcucucaccggcgccacagaaauccaaaauucagggggaacaaguauuuucgcaggucaucugaagugucgguuaaaaauggacaagcuggagcuaaaaggcaugagcuacgccaugugcaccaacacguuugugcucaagaaagaggucucugaaacccagcacgggacaauacugaucaagguggaguacaagggagaagauguucccuguaaaauuccuuucuccacugaggacggccaagguaaggcucauaacgggcgucuuaucaccgcgaauccagugguaacuaagaaggaggaacccgucaacauagaggcagaaccgccuuucggcgagucaaauauugugaucggaaucggcgauaacgccuugaaaauuaauugguauaagaaggggagcaguaucggaaaaauguuugaagcuacugcccgcggugcaagaaggauggccauucugggcgacaccgcuugggauuucgggucuguuggaggcgugcucaacucccuggguaagaugguccaccagauauuugggagcgccuacacggcacuuuucucgggcgugucuuggguaaugaaaaucggaauuggcgugcuguugacauggaucgggcucaauuccaagaacaccucaaugaguuuuagcugcaucgcgauuggaauaaucacucuguauuuaggcgcuguuguccaggccgacauggguugugugauuaauuggaaagggaaggagcugaagugcggauccggcaucuucgugacaaacgagguccauaccuggacugaacaguacaaauuucaagcagauucucccaagcggcuagccaccgcuauugccggugcaugggagaauggcguuugugggauccgaagcacaacgcgcauggaaaaccuccuguggaaacagauagcuaaugagcuuaacuauaucuugugggaaaauaacauuaagcugaccguggugguaggagacaucauuggcguccucgagcaggggaaaagaacucugacaccacagccuauggaguuaaaguacucauggaaaaccuggggaaaggccaagaucgugacagcggaaacucaaaacaguuccuucauaauugauggccccaauaccccagagugccccagcgccucuagggcuuggaacguuugggaaguggaggacuaugguuuuggggucuucacgacaaauaucuggcugaaacuucgggaaguguacacccaguugugugaccaccgccucaugucagcagccguuaaggaugagagagcugugcacgccgacaugggauacuggauugagagucagaaaaacggcagcuggaagcuggaaaaagcaucccuaaucgagguaaagacuugcaccuggccuaagucucauacacuguggucgaaugguguccucgaaagcgauaugauaaucccaaaaucccuggcgggcccgauuucacagcacaacuauaggcccggguaccauacucaaaccgccggaccuuggcaccuuggcaaguuggagcuggacuuuaauuauugcgaggggacaacgguggugaucaccgaaaacuguggaacucguggcccaaguuuacggacaaccacugucucugguaaacucauucacgaguggugcugucgaagcugcacacugcccccucuuagauacaugggggaagauggauguugguauggcauggagaucaggccaauauccgaacgcgaggagaauaugguuaagucacuggugagcgcugguucuggcaaaguagacaacuucaccauggggguguugugccucgccauucuguuugaagaggucaugcggggaaaguucggcaagaaacauaugaucgcagggguguucuuuacguucguucuacugcucuccggacagaucauuuggagagauauggcucacacucugaucaugauuggcaguaaugccagcgacaggauggguaugggggugaccuaccuugcauugauagccacauuuaagauccagcccuuccuggcuuuaggauuuuuccuccgcaaacugaccucucgagaaaaccuucugcuaggcgucggccucgcgauggccacuacacugcaauugccggaggauauugaacagauggcaaaugggaucgcucugggauuaauggcccucaagcugauuacccaguuugagacauaucagcuuuggacugcccugaucuccuugaccuguucaaacacgauauucacacucaccguggcuuggcggacugcaacccugauccuagccgguguuagucugcuuccugugugccaaagcucguccaugcguaaaacagacuggcucccaaugacugucgcggcuaugggcguacccccucugcccuuguuuauuuucucucugaaggauaccuuaaagagaaggagcuggccacucaaugagggggugauggccguuggacuggugucaauccuugcaaguucccuguugcgcaacgacgucccuauggccggcccccucguggcuggugggcugcuaauugcauguuacguaaucacgggaacaucugccgaucugaccguggaaaaagcggcugacgucacuugggaggaagaggccgaacagacaggcguuagccauaaccuuaugauaaccguggacgaugacggcacuaugcggauuaaggaugacgagacagagaauauccucaccgugcuguugaaaacggcauuacugaucgucuccgggauuuuuccauacucaauaccggccacucuccugguguggcacaccuggcagaagcagacacaaagaagcggaguucuuugggauguaccuagucccccagaaacccagaaagcugagcuggaagaggguguguauaggaucaagcagcagggcauuuucgggaaaacacaagucggagugggcguucagaaggaggguguguuucauacuauguggcacgucacccgaggggccguguugacguacaacggaaagcgccuagaacccaauugggcaucugucaagaaggaccugaucuccuauggcggcggguggcggcucagcgcucaguggcaaaaaggagaggaaguccaggugauugccguugagccugguaagaaccccaagaauuuccagacaaugcccggcacuuuccagaccacaaccggggaaaucggagcgauagcccuggauuuuaagccuggcacuucggguucaccgaucauuaacagagaggggaagguggucggacuuuacggcaauggcgugguuaccaaaaacgggggauaugugucugguaucgcacaaacaaaugcugagccagacggccccacgccugaauuagaggaagagauguucaagaaaaggaaccugacuauuauggaucuccacccagggaguggaaagacccguaaauacuugcccgccaucguccgcgaagcuauaaagcggagacugaggacacucauucuggcaccuacccgagugguagccgccgagauggaggaagcucuuaagggccugccgauccgguaucagacuacagcgaccaaauccgagcauacgggucgcgaaaucguggacuugaugugccacgcaacuuuuacaaugagacuacugagccccguuagggucccaaauuacaaccucauuaucauggaugaggcccauuucaccgacccugcuucuauagccgcacggggguacauuagcacccgagugggaaugggcgaagccgcugcgaucuuuaugacugccacacccccaggcaccgcagaugcuuucccucaguccaaugcccccauucaggacgaggagagagacaucccagaacgcucauggaacagugggaaugaguggauaacagauuuugcaggaaagacugugugguucgucccgagcauuaaagccgguaacgacaucgcuaacuguuuaaggaagaauggcaaaaagguaauccaacugucucguaagacguuugauaccgaauaucagaaaacaaaacuuaacgacugggauuucgugguuacuaccgacauuuccgagaugggggccaauuuuaaagcggaucgggugaucgacccuagaaggugccugaagcccgucauucucacagauggaccagagcgcgugauauuggcaggccccaugccuguuaccgccgcuucagccgcucagcgaagaggucggguggggaggaacccacagaaagaaaaugaccaauacaucuucacuggccagccccugaacaaugaugaggaccacgcacauuggacggaagccaagaugcuccuggacaacauuaauaccccugagggaaucaucccggcucuuuucgaaccagagcgcgagaagagugccgcaauugauggcgaauaucgucuaaaaggggagagcagaaagacauuugucgaacugaugcggaggggagacuugcccgugugguuagcgcacaaaguagccuccgaggguauaaaguacacugaucgcaaauggugcuucgacggccagcgaaacaaucagauccuggaagagaacauggauguggagauuuggaccaaggaaggggagaaaaagaagcucagaccucgguggcuggacgcuaggacauauucugauccccuugcccugaaagaauuuaaggacuucgcagcuggacgcaaaucgaucgcccucgauuugguuaccgagauuggcagagucccaagccaccuggcacauaggacucggaaugcccuagacaaccuggugaugcuccacacaucagaacauggugggaaggcuuaccgucacgcgguggaggagcuuccugaaacgauggagacccuguuauugcugggccucaugauccugcuuacuggaggcgccaugcuguuucucauauccgggaaaggaaucgguaagacaaguauuggcuugaucugugucauugcaucuagcgggaugcuguggauggcugaaauccccuuacaauggauagccuccgccauuguucuagaguucuuuaugauggugcugcucaucccagagccugaaaagcagcgcaccccgcaggauaaucaacuugcauauguagugauuggaauccugaccuuggcugccauaaucgcggcuaacgagaugggccugcucgaaacaacuaaacgagaccuggguaugucaaaggagcccggggucgugucuccaacgagcuaccuugauguugaccuccacccugccagugcauggacccuguacgccguggcuacaacugucauuacccccauguugagacauacaaucgaaaauuccaccgcaaacguaagccuggccgcgauugcuaaccaggccgugguuuuaaugggccuagacaaaggauggccaaucucuaagauggaucugggcgugccucuccuugcacuggggugcuauucacaggucaaucccuugacucugacggccgcugugcuccugcuuauaacacacuacgccauuaucggaccgggcuuacaggcaaaagcuaccagggaggcccaaaagcggacugcggccgguaucaugaagaacccaaccgucgacgggauuaugacaaucgaucuggacccugugauauaugauuccaaauucgagaagcagcucggacagguuauguugcuggugcuaugugcaguacagcugcuccuuaugcgcacaaguugggcucugugcgaagccuugacccuggcaacaggccccauuacgacccucugggaggguagcccaggcaaauuuuggaauacuacaaucgcugugucgauggccaacauuuucagagggucuuaccuggccggagcgggcuuagcuuuuuccaucaugaaaagcgucgggaccggaaaaaggggcacugguucacaaggggaaacacuuggagagaaguggaagaaaaagcugaaucagcucagucggaaagaguucgaccuauauaagaaaucuggcauaaccgagguugaucgaacggaggcaaaggaaggucugaaaagaggcgagaucacccaucacgccgugucccgcgggagcgcuaaguugcagugguuugucgaaaggaacauggugauucccgagggacggguaaucgaccugggcugugggcguggaggcuggucauacuauugcgccggucucaagaaagugacagaaguuagaggguacacuaagggaggcccuggccaugaggagccggugcccaugaguaccuacggguggaauauugucaaacuuaugagcggaaaggauguguucuaucugccaccugaaaaaugugacacauugcugugcgauaucggugaguccucucccagcccuacugucgaagaguccaggaccauucgcgugcucaagaugguugagccaugguuaaagaacaaucaguucuguaucaaaguacugaaccccuacaugccuacagugauagaacaccuugagcggcugcaacgaaagcacggcgggaugcuagucagaaauccacucucaaggaacucuacccaugaaauguauuggauuaguaauggaacuggcaacaucguggcaucgguuaauauggugagccgccuguugcugaaccgguuuacgaugacacacagacgucccaccaucgagaaagacgucgaucucggugccgggacuaggcaugugaacgcugaaccggagaccccuaauauggacguaauuggagagcggauaaagcgcaucaaagaagaacacaacuccacauggcacuacgacgaugaaaauccauauaagacgugggcguaccauggcucuuaugaggugaaggccaccggcucagcaagcuccaugauuaacgggguugucaaacuucugacuaagcccugggacguggugccuauggucacacagauggcuaugaccgauacuacaccauucggacagcaacgaguuuuuaaagaaaagguggacaccagaacacccaggaguaugccggguacucggcgcguaaugggcaucaccgccgagugguuauggagaacgcuggggaggaauaaaaagccucgauugugcacccgggaggaguucacaaagaaagugcguacuaacgcagccaugggagcugucuuuaccgaggaaaaucagugggauucugccaaggcggcaguggaggacgaagauuucuggaaacucguugacagagagcgcgagcugcacaagcuaggcaaaugugguagcugcguguacaacaugauggggaagagggagaagaaacuuggagaguuuggcaaagccaaaggcucacgggcuauuugguacauguggcugggggccagauaucucgaguucgaggcacugggauuuuugaaugaggaucauugguucucccgcgaaaacaguuacagcggugucgagggcgaagggcugcacaagcucggauauauccuuagggacauaucuaaaauccccggcggugcuauguacgccgaugacacagcugggugggacacucgaauuaccgaggaugaccugcauaaugaagagaagaucacgcagcagauggauccagagcaccggcaauuagccaacgcaauuuuuaaacugacauaucagaauaaggugguaaagguucagagaccuacccccacuggaacagugauggacaucauauccaggaaagaucagcgcggcucaggccaagucgggaccuacggauugaacacuuucaccaauauggaagcgcagcucauucgucagauggagggugaaggcgugcugagcaaggccgaccuagagaacccacaccuucccgagaaaaagaucacacaguggcuggagacgaaagggguggagcggcucaagagaauggcuaucucgggagaugacugcgucguuaagccuauugaugacagguuugccaacgcacuguuggcuuuaaaugauaugggcaaagugcgcaaggacauaccacaauggcagccgucuaaagguuggcaugauuggcagcagguacccuucuguagucaccauuuccacgaacugaucaugaaggacgggcgaaaacucguggucccuugccggccacaagacgagcuuauuggcagagccaggaucucccagggcgcaggcuggagccugcgcgaaaccgccugucuagggaaggcguaugcucagauguggucacugauguacuuucacagacgggaucucagguuggccuccaacgcaauuugcucugccgugcccguucauugggugccuacuagccguacaaccuggaguauccacgcucaucaccaauggaugacuacagaggacaugcugaccgucuggaaucgaguguggauagaagauaacccauggauggaggacaagacgcccguaacaaccugggagaauguuccuuaccuuggaaaacgcgaagaucaguggugugguucccugaucggccucacuagcagagccaccugggcacagaacauuccgacagcuauccagcaagugcggucuuuaauugggaaugaggaguuccuggacuauaugccaucaaugaagagguuucgcaaagaggaggaaagugagggagccaucugguga

SEQ ID NO: 15450 - RNA, 9873 nt, Artificial Sequence
  derived and/or modified CDS sequence (opt3) from DENV-3__FJ390377__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaccuuacugaugcuugucacaccaucgaugaccaugcgcugugugggcguagggaacagagacuuuguugaaggauugucaggugccacguggguggaugucgugcuggagcacggcgggugcgugacuacaauggcgaagaauaaacccacccuagacaucgagcuccagaagacugaagcaacacaacuggccacccuuaggaaacuguguauugagggaaagaucacgaacauuaccacagauagccggugcccuacucagggcgaagcugucuugccagaggaacaggaccagaauuauguuuguaaacacaccuacguggaucgcgguugggggaacggaugcggccucuucggcaaggggagucugguaacaugcgccaaguuucaauguuuagagcccaucgagggaaaagugguccaguaugaaaaucugaaguacacugugauaauuaccguucauacaggugaccagcaccaggugggcaacgagacccaaggggucacugcagaaaucacgccucaggcuuccacaaccgaggccauucucccagaauauggaacucuuggccuggagugcucuccgcgaaccgguuuggacuucaaugagaugauccuacugacaaugaaaaacaaggcguggauggugcauagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcacacagcucucaccggcgccacagaaauccagaauucagggggaacuaguauuuucgcaggucaucugaagugucgguuaaaaauggacaagcuggagcuaaaaggcaugagcuacgccaugugcaccaacacguuugugcucaagaaagaggucucugaaacccagcacgggacaauacugaucaagguggaguacaagggagaagauguucccuguaaaauuccuuucuccacugaggacggccaagguaaggcucauaacgggcgucuuaucaccgcgaauccagugguaacaaaaaaggaggaacccgucaacauagaggcagaaccgccuuucggcgagucaaauauugugaucggaaucggcgauaacgccuugaaaauuaauugguauaagaaggggagcaguaucggaaaaauguuugaagcuacugcccgcggugcaagaaggauggccauucugggcgacaccgcuugggauuucgggucuguuggaggcgugcucaacucccuggguaagaugguccaccagauauuugggagcgccuacacggcacuuuucucgggcgugucuuggguaaugaaaaucggaauuggcgugcuguugacauggaucgggcucaauuccaagaacaccucaaugaguuuuagcugcaucgcgauuggaauaaucacucuguauuuaggcgcuguuguccaggccgacauggguugugugauuaauuggaaagggaaggagcugaagugcggauccggcaucuucgugacaaacgagguccauaccuggacugaacaguacaaauuucaagcagauucucccaagcggcuagccaccgcuauugccggugcaugggagaauggcguuugugggauccgaagcacaacgcgcauggaaaaccuccuguggaaacagauagcuaaugagcuuaacuauaucuugugggaaaauaacauuaagcugaccguggugguaggagacaucauuggcguccucgagcaggggaaaagaacucugacaccacagccuauggaguuaaaguacucauggaaaaccuggggaaaggccaagaucgugacagcggaaacucaaaacaguuccuucauaauugauggccccaauaccccagagugccccagcgccucuagggcuuggaacguuugggaaguggaggacuaugguuuuggggucuucacgacaaauaucuggcugaaacuucgggaaguguacacccaguugugugaccaccgccucaugucagcagccguuaaggaugagagagcugugcacgccgacaugggauacuggauugagagucagaaaaacggcagcuggaagcuggaaaaagcaucccuaaucgagguaaagacuugcaccuggccuaagucucauacacuguggucgaaugguguccucgaaagcgauaugauaaucccaaaaucccuggcgggcccgauuucacagcacaacuauaggcccggguaccauacucaaaccgccggaccuuggcaccuuggcaaguuggagcuggacuuuaauuauugcgaggggacaacgguggugaucaccgaaaacuguggaacucguggcccaaguuuacggacaaccacugucucugguaaacucauucacgaguggugcugucgaagcugcacacugcccccucuuagauacaugggggaagauggauguugguauggcauggagaucaggccaauauccgaaaaggaggagaauaugguuaaaucacuggugagcgcugguucuggcaagguagacaacuucaccauggggguguugugccucgccauucuguuugaagaggucaugcgcggaaaguucggcaaaaagcauaugaucgcagggguguucuuuacguucguucuacugcucuccggacagaucacuuggcgggauauggcucacacccugauuaugaucggcaguaaugccagcgacagaauggguaugggggugacauaccuugcauugauugccaccuuuaaaauacagcccuuccuggcuuuaggauuuuuccucaggaagcugacuucucgcgaaaaccuucugcuaggcgucggccucgcgauggccacaacccugcaauugccggaggauaucgaacagauggcaaaugggauugcucugggauuaauggcccucaaacugaucacacaguuugagacuuaucagcuuuggaccgcccugauuuccuugacguguucaaacacaaucuucacccucacuguggcuuggcgaaccgcaacacugauacuagccgguguuagucugcuuccugugugccaaagcucguccaugcggaagacugacuggcucccaaugaccgucgcggcuaugggcguacccccucugcccuuguuuaucuucucucugaaggauacguuaaaacguagaagcuggccacucaaugagggggugauggccguuggacuggugucaauucuugcaaguucccuguugaggaacgacgucccuauggccggcccccucguggcuggugggcugcuaaucgcauguuacguaauuacaggaaccucugccgaucugacuguggaaaaggcggcugacgucacaugggaggaagaggccgaacagaccggcguuagccauaaccuuaugaucacuguggacgaugacggcacaaugcgcauaaaagaugacgagaccgagaauauucucacggugcuguugaagacugcauuacugaucgucuccgggaucuuuccauacucaauuccggccacccuccugguguggcacacauggcagaaacagacccaacggagcggaguucuuugggauguaccuagucccccagaaacacagaaggcugagcuggaagaggguguguauagaauaaaacagcagggcaucuucgggaagacucaagucggagugggcguucagaaggaggguguguuucauaccauguggcacgucacgaggggggccguguugacauacaacggaaaacgacuagaacccaauugggcaucuguaaagaaagaccugauuuccuauggcggcggguggcgccucagcgcucaguggcaaaagggagaggaaguccaggugaucgccguugagccugguaaaaacccaaagaauuuccagacuaugcccggcaccuuccagacaaccacuggggaaauuggagcgaucgcccuggauuuuaagccuggcaccucggguucaccgauaaucaaccgggaggggaaaguggucggacuuuacggcaauggcgugguuacaaagaacgggggauaugugucugguauugcacaaacgaaugcugagccagacggccccacuccugaauuagaggaagagauguucaaaaagagaaaccugaccaucauggaucuccacccagggaguggaaaaacaaggaaguacuugcccgccauuguccgugaagcuaucaagcgccggcugagaacccucauacuggcaccuacuagggugguagccgccgagauggaggaagcucuuaaaggccugccgauucgauaucagacaaccgcgacgaaguccgagcauacuggucgggaaaucguggacuugaugugccacgcaacauuuaccaugcgccuacugagccccguuagagucccaaauuacaaccucaucauuauggaugaggcccauuucaccgacccugcuucuaucgccgcaaggggguacauaagcacucgggugggaaugggcgaagccgcugcgauuuuuaugacagccacccccccaggcacagcagaugcuuucccucaguccaaugcccccauccaggacgaggagcgagacauuccagaaagaucauggaacagugggaaugaguggaucacugauuuugcaggaaaaacggugugguucgucccgagcauaaaggccgguaacgacauugcuaacuguuuacgcaaaaauggcaagaagguaauccaacugucuaggaaaaccuuugauacagaauaucagaagacuaaacuuaacgacugggauuucgugguuaccacagacaucuccgagaugggggccaauuuuaaggcggaucgugugauugacccucggagaugccugaaacccgucauccucaccgauggaccagagagggugauuuuggcaggccccaugccuguuacugccgcuucagccgcucagcgccgagguagaguggggcggaacccacagaaggaaaaugaccaauacauauucacgggccagccccugaacaaugaugaggaccacgcacauuggaccgaagccaagaugcuccuggacaacaucaauacaccugagggaauuaucccggcucuuuucgaaccagagagggagaaaagugccgcaaucgauggcgaauaucgccuaaagggggagagccguaaaacuuuugucgaacugaugagacggggagacuugcccgugugguuagcgcacaagguagccuccgaggguauuaaauacaccgauaggaaguggugcuucgacggccagcgcaacaaucagauacuggaagagaacauggauguggagaucuggacaaaagaaggggagaagaagaaacuccgaccuagauggcuggacgcucggaccuauucugauccccuugcccugaaggaauuuaaagacuucgcagcuggaaggaagucgauugcccucgauuugguuacugagaucggccgcgucccaagccaccuggcacauagaacaaggaaugcccuagacaaccuggugaugcuccacacgucagaacauggugggaaagcuuaccggcacgcgguggaggagcuuccugaaaccauggagacucuguuauugcugggccucaugauucugcuuacaggaggcgccaugcuguuucucaucuccgggaagggaauagguaagaccaguaucggcuugauuugugucaucgcaucuagcgggaugcuguggauggcugaaauucccuuacaauggaucgccuccgccauaguucuagaguucuuuaugauggugcugcucauuccagagccugaaaaacagcguaccccgcaggauaaucaacuugcauauguagugaucggaauucugacauuggcugccaucauagcggcuaacgagaugggccugcucgaaacuacgaagcgcgaccuggguaugucaaaagagcccggggucgugucuccaaccagcuaccuugauguugaccuccacccugccagugcauggacacuguacgccguggcuacuaccgucaucacacccauguugcgacauaccauugaaaauuccacugcaaacguaagccuggccgcgaucgcuaaccaggccgugguuuuaaugggccuagacaagggauggccaauuucuaaaauggaucugggcgugccucuccuugcacuggggugcuauucacaggucaaucccuugacgcugacagccgcugugcuccugcuuaucacccacuacgccauaauuggaccgggcuuacaggcaaaggcuacuagagaggcccaaaagaggaccgcggccgguaucaugaaaaacccaacagucgacgggaucaugacuauugaucuggacccugugaucuaugauuccaaguucgagaaacagcucggacagguuauguugcuggugcuaugugcaguacagcugcuccuuaugcggaccaguugggcucugugcgaagccuugacacuggcaacgggccccauaaccacucucugggaggguagcccaggcaaguuuuggaauacaaccauugcugugucgauggccaacaucuuccgcgggucuuaccuggccggagcgggcuuagcuuuuuccauuaugaaaagcgucgggacuggaaagagaggcacagguucacaaggggaaacccuuggagagaaguggaaaaagaaacugaaucagcucaguaggaaggaauucgaccuauauaaaaagucuggcaucacggagguugaucggaccgaggcaaaagaaggucugaagcgaggcgagauaacacaucacgccguguccagagggagcgcuaaguugcagugguuugucgaacgcaacauggugauccccgagggaaggguaauugaccugggcugugggcggggaggcuggucauacuauugcgccggucucaaaaaggugacugaaguucguggguacaccaaaggaggcccuggccaugaggagccggugcccaugaguacauacggguggaauaucgucaagcuuaugagcggaaaagauguguucuaucugccaccugaaaagugugacacuuugcugugcgauauuggugaguccucucccagcccuaccgucgaagaguccagaacaaucagggugcucaagaugguugagccaugguuaaaaaacaaucaguucuguauuaagguacugaaccccuacaugccuaccgugaucgaacaccuugagcgccugcaacggaaacacggcgggaugcuaguccgaaauccacucucaagaaacucuacucaugaaauguauuggauaaguaauggaacgggcaacauuguggcaucgguuaauauggugagcaggcuguugcugaaccgcuuuacaaugacccaccggagacccacuaucgagaaggacgucgaucucggugccgggacccgucaugugaacgcugaaccggagacaccuaauauggacguaaucggagagaggauuaaacggauaaaggaagagcacaacuccacguggcacuacgacgaugaaaauccauauaagaccugggcguaccauggcucuuaugaggugaaagccacuggcucagcaagcuccaugaucaacgggguugucaagcuucugacaaaacccugggacguggugccuauggucacccagauggcuaugacugauacaaccccauucggacagcaacgcguuuuuaaggaaaaaguggacacacgaacucccagaaguaugccggguaccaggcggguaaugggcauuacggccgagugguuauggcgcacccuggggagaaauaagaagccuagguugugcacacgagaggaauucacuaaaaaggugcggaccaacgcagccaugggagcugucuuuacagaggaaaaucagugggauucugccaaagcggcaguggaggacgaagauuucuggaagcucguugaccgugagagagagcugcacaaacuaggcaagugugguagcugcguguacaacaugauggggaaacgcgaaaagaagcuuggagaguuuggcaaagccaagggcucaagggcuaucugguacauguggcugggggcccgguaucucgaauucgaggcacugggauuuuugaaugaggaucauugguucuccagagaaaacaguuacagcggugucgagggcgaagggcugcacaaacucggauauauucuucgcgacaucucuaagauacccggcggugcuauguacgccgaugacacugcugggugggacaccaggaucacggaggaugaccugcauaaugaagagaaaauuacacagcagauggauccagagcaccgacaauuagccaacgcaaucuuuaagcugaccuaucagaauaaggugguaaaaguucagcggccuacucccacaggaaccgugauggacauuaucuccagaaaggaucagaggggcucaggccaagucgggacuuacggauugaacaccuucacaaauauggaagcgcagcucauacgccagauggagggugaaggcgugcugagcaaagccgaccuagagaacccacaccuucccgaaaagaaaauuacgcaguggcuggagaccaaggggguggagcgucucaagcggauggcuaucucgggagaugacugcgucguuaaaccuaucgaugacagauuugccaacgcacuguuggcuuuaaaugauaugggcaaggugaggaaagacauuccacaauggcagccgucuaaggguuggcaugauuggcagcagguacccuucuguagucaccauuuccacgaacugauaaugaaagacgggcgcaagcucguggucccuugccgaccacaagacgagcuuaucggacgggccagaauuucccagggcgcaggcuggagccugagggaaacugccugucuagggaaggcguaugcucagauguggucacugauguacuuucaccgcagagaucuccgguuggccuccaacgcaaucugcucugccgugcccguucauugggugccuacaagcaggaccacuuggaguauucacgcucaucaccaauggaugacaaccgaggacaugcugacggucuggaaucguguguggaucgaagauaacccauggauggaggacaaaacacccguaaccacuugggagaauguuccuuaccuuggaaagcgagaagaucaguggugugguucccugauaggccucaccagccgcgccacaugggcacagaacaucccgacugcuauucagcaagugagaucuuuaaucgggaaugaggaauuccuggacuauaugccaucaaugaaacgguuuaggaaggaggaggaaagugagggagccauuugguga

SEQ ID NO: 15451 - RNA, 9873 nt, Artificial Sequence
  derived and/or modified CDS sequence (opt3) from DENV-3__FJ547069__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaaucuggggggaacaucaauauucgcaggucauuuaaagugucggcugaaaauggacaagcuagagcucaaaggcaugaguuacgccaugugcacuaacaccuuugugcugaagaaagaggucagcgaaacgcagcacgggaccauccuuauuaagguggaguacaagggagaagauguucccuguaaaaucccuuucucuacagaggacggccaagguaaggcucauaacgggcguuugauaacugcgaauccagugguaaccaaaaaggaggaacccgucaacauugaggcagaaccgccuuucggcgaguccaauaucgugaucggaauuggcgauaacgcccugaaaaucaauugguauaagaaggggucaagcauuggaaaaauguuugaagcuacagcccgcggugcaagaaggauggccauacucggcgacacugcuugggauuucgggaguguuggaggcgugcugaacucucuugguaagaugguccaccagaucuuuggguccgccuacaccgcacuguucagcggcgugucguggguaaugaaaauuggaaucggcguguugcucacguggaucgggcugaauucuaagaacacauccaugucauuuaguugcauugcgauaggaaucauuaccuuauaucugggcgcuguuguccaggccgacauggguugugugaucaauuggaaagggaaggagcuaaagugcggaagcggcauuuucgugacuaacgagguccauacauggaccgaacaguacaaauuucaagcagauucccccaagcggcucgccacugcuaucgccggugcaugggagaauggcguuugugggauacgaucuaccacacgcauggaaaaccugcuuuggaaacagaucgcuaaugaguugaacuauauucugugggaaaauaacaucaagcucacgguggugguaggagacauuaucggcguccuggagcaggggaaaagaaccuuaacuccacagccuauggagcugaaguacagcuggaaaacauggggaaaggccaagauagugaccgcggaaacacaaaacucaaguuucauuaucgauggccccaauacuccagagugccccuccgccagcagggcuuggaacguuugggaaguggaggacuaugguuuuggggucuucaccacgaauauuuggcuuaaauugcgggaaguguacacacagcucugugaccaccgccugaugucugcagccguuaaggaugagagagcugugcacgccgacaugggauacuggaucgagucacagaaaaacggcaguuggaagcuagaaaaagcaagccugauagagguaaagaccugcacuuggccuaagucccauacccucuggucuaaugguguccuggaaucggauaugaucauuccaaaaagccuugcgggcccgaucucccagcacaacuauaggcccggguaccauacacaaacugccggaccuuggcacuugggcaagcuggaguuagacuuuaauuauugcgaggggaccacaguggugauuacggaaaacuguggaacccguggcccaucacuccggacuacaaccgucagugguaaacugauccacgaguggugcugucgaucuugcacucuucccccucugagauacaugggggaagauggauguugguauggcauggagauaaggccaauuagcgaaaaggaggagaauaugguuaaauccuuggugucagcugguagcggcaagguagacaacuucacaaugggggugcucugccuggccauccuauuugaagaggucaugcgcggaaaguucggcaaaaagcauaugaucgcagggguguucuuuaccuucguucugcuccugucuggacagauuacguggcgggauauggcucacacucuuaucaugauuggcuccaaugccagugacagaauggguaugggggugaccuacuuggcacugauagccacauuuaaaauccagcccuucuuagcucucggauuuuuccugaggaagcuuaccagccgcgaaaaccugcuacucggcgucggccuggcgauggccacuacauugcaacugccggaggauauugaacagauggcaaaugggaucgcuuuaggacucauggcccugaaacuuauuacccaguuugagacauaucagcuguggacugccuugaucucucucaccuguuccaacacgauauucacacugaccguggcuuggcgaacugcaacccuaauccuggccgguguuucacuucucccugugugccaaaguagcucgaugcggaagacagacuggcugccaaugacugucgcggcuaugggcguacccccuuugccccuguuuauuuucuccuuaaaggauacccucaaacguagaucuuggccacugaaugagggggugauggccguuggacuugugagcauccuggcaucaaguuugcucaggaacgacgucccuauggccggcccccugguggcuggugggcuacugauugcauguuacguaaucacgggaacauccgccgaucuuaccguggaaaaggcggcugacgucacuugggaggaagaggccgaacagacaggcguuucucauaaccucaugauaaccguggacgaugacggcacuaugcgcauuaaagaugacgagacagagaauauccugaccguguuguuaaagacggcacugcucaucgucagcgggauuuuuccauacuccauaccggccacucugcuuguguggcacaccuggcagaaacagacacaacggucaggaguucugugggauguaccuagccccccagaaacccagaaggcugaguuggaagaggguguguauagaaucaaacagcagggcauuuucgggaagacacaagucggagugggcguucagaaggaggguguguuucauacuauguggcacgucaccaggggggccgugcuaacguacaacggaaaacgacuggaacccaauugggcaaguguaaagaaagaccucaucucuuauggcggcggguggcgccuguccgcucaguggcaaaagggagaggaaguccaggugauugccguugagccugguaaaaacccaaagaauuuccagacaaugcccggcacuuuccagaccacaaccggggaaaucggagcgauagcccuugauuuuaagccuggcacuagcgguucgccgaucauuaaccgggaggggaaaguggucggauuauacggcaauggcgugguuaccaagaacgggggauaugugucagguaucgcacaaacaaaugcugagccagacggccccacgccugaacuggaggaagagauguucaaaaagagaaaccucacuauuauggauuugcacccagggucuggaaaaaccaggaaguaccugcccgccaucguccgugaagcuauaaagcgccggcucagaacacugauucuugcaccuaccagggugguagccgccgagauggaggaagcucugaaaggcuugccgauccgauaucagacuacagcgaccaagagugagcauacgggucgggaaaucguggaccuaaugugccacgcaacuuuuacaaugcgccugcucucccccguuagagucccaaauuacaacuuaauuaucauggaugaggcccauuucaccgacccugcuagcauagccgcaaggggguacauuucuacccgggugggaaugggcgaagccgcugcgaucuuuaugacugccacacccccaggcaccgcagaugcuuucccucagagcaaugcccccauucaggacgaggagcgagacaucccagaaagauccuggaacucagggaaugaguggauaacagauuuugcaggaaaaacugugugguucgucccgaguauuaaggccgguaacgacaucgcuaacugucugcgcaaaaauggcaagaagguaauccaacuuagcaggaaaacguuugauaccgaauaucagaagacaaaacugaacgacugggauuucgugguuacuaccgacauuucugagaugggggccaauuuuaaggcggaucgugugaucgacccucggagaugccucaaacccgucauuuugacagauggaccagagagggugauacuggcaggccccaugccuguuaccgccgcuuccgccgcucagcgccgagguagaguggggcggaacccacagaaggaaaaugaccaauacaucuucacuggccagccccucaacaaugaugaggaccacgcacauuggacggaagccaagaugcugcuugacaacauuaauaccccugagggaaucaucccggcucuauucgaaccagagagggagaaaucagccgcaauugauggcgaauaucgccugaagggggagagucguaaaacauuugucgaauugaugagacggggagacuuacccguguggcuggcgcacaagguagccagcgaggguauaaaauacacugauaggaaguggugcuucgacggccagcgcaacaaucagauccucgaagagaacauggauguggagauuuggaccaaagaaggggagaagaagaaacugcgaccuagauggcuugacgcucggacauauuccgauccccuggcccucaaggaauuuaaagacuucgcagcuggaaggaagucuaucgccuuggaucugguuaccgagauuggccgcgucccaucgcaccuagcacauagaacuaggaaugcccuggacaaccucgugaugcuucacacaagcgaacauggugggaaagcuuaccggcacgcgguggaggagcugccugaaacgauggagaccuuauugcugcucggccugaugauccuucugacuggaggcgccaugcucuuuuugauaucagggaagggaaucgguaagacauccauuggccugaucugugucauugcaaguucugggauguuauggauggcugaaaucccccuacaauggauagccagcgccauuguucuggaguucuuuaugauggugcuccuuaucccagagccugaaaaacagcguaccccgcaggauaaucaacuggcauauguagugauuggaaucuugacccuggcugccauaaucgcggcuaacgagaugggccuccuggaaacaacuaagcgcgaccuugguauguccaaagagcccggggucgugucaccaacgucuuaccucgauguugaccugcacccugccagcgcauggaccuuguacgccguggcuacaacugucauuacccccaugcugcgacauacaaucgaaaauaguaccgcaaacguauccuuagccgcgauugcuaaccaggccgugguucuaaugggccuggacaagggauggccaaucagcaaaauggaucucggcgugccucuucuggcauuggggugcuauucucaggucaauccccugacucucacggccgcugugcugcuuuuaauaacacacuacgccauuaucggaccgggccugcaggcaaaggcuaccagagaggcccaaaagaggacugcggccgguaucaugaaaaacccaaccgucgacgggauuaugacaaucgaucucgacccugugauauaugauucaaaguucgagaaacaguugggacagguuaugcugcuagugcugugugcaguacagcuccuucugaugcggacuuccugggcuuugugcgaagcccugacccucgcaacaggccccauuacgacccugugggaggguaguccaggcaaguuuuggaauacuacaaucgcugugagcauggccaacauuuuccgcgggucguacuuagccggagcgggccuugcuuuuucuaucaugaaauccgucgggaccggaaagagaggcacugguagccaaggggaaacacugggagagaaguggaaaaagaaacucaaucagcuaucaaggaaggaauucgaccuguauaaaaagaguggcauaaccgagguugaucggacggaggcaaaagaagguuugaagcgaggcgagaucacccaucacgccgugucuagaggguccgcuaagcugcagugguuugucgaacgcaacauggugauucccgagggaaggguaaucgaccucggcugugggcggggaggcuggagcuacuauugcgccggucuuaaaaaggugacagaaguucguggguacacuaaaggaggcccuggccaugaggagccggugcccaugucaaccuacggguggaauauugucaagcugaugaguggaaaagauguguucuauuugccaccugaaaagugugacacacugcucugcgauaucggugagagcucccccucuccuacugucgaagagagcagaaccauuaggguguuaaagaugguugagccauggcugaaaaacaaucaguucuguaucaagguacuuaaccccuacaugccuacagugauagaacaccuggagcgccuacaacggaaacacggcgggaugcucguccgaaauccacuguccagaaacucaacccaugaaauguauuggauuucuaauggaacuggcaacaucguggcaaguguuaauauggugucgagguugcugcucaaccgcuuuacgaugacacaccggagacccaccaucgagaaggacgucgaucuuggugccgggacucgucaugugaacgcugaaccggagaccccuaauauggacguaauuggagagaggauaaaacggaucaaggaagagcacaacagcacauggcacuacgacgaugaaaauccauauaagacgugggcguaccauggcuccuaugaggugaaagccaccggcucugcaucaagcaugauuaacgggguugucaagcuguuaacuaaacccugggacguggugccuauggucacacagauggcuaugaccgauacuacaccauucggacagcaacgcguuuuuaaggaaaaaguggacacccgaacacccagauccaugccggguacuaggcggguaaugggcaucaccgccgaguggcuguggcgcacguuggggagaaauaagaagccuaggcucugcacccgagaggaauucacaaaaaaggugcggacuaacgcagccaugggagcugucuuuaccgaggaaaaucagugggauagugccaaagcggcaguggaggacgaagauuucuggaagcugguugaccgugagagagagcuacacaaacuuggcaagugugguucuugcguguacaacaugauggggaaacgcgaaaagaagcugggagaguuuggcaaagccaagggcagcagggcuauuugguacauguggcucggggcccgguaucuggaauucgaggcauugggauuucugaaugaggaucauugguucucaagagaaaacuccuacaguggugucgagggcgaagggcuccacaaacuuggauauauccugcgcgacauaagcaagauccccggcggugcuauguacgccgaugacacagcugggugggacacuaggauuaccgaggaugacuuacauaaugaagagaaaaucacgcagcagauggauccagagcaccgacaacuggccaacgcaauuuuuaaguugacauaucagaauaaggugguaaaaguucagcggccuacccccacuggaacagugauggacaucauaucuagaaaggaucagaggggcuccggccaagucgggaccuacggacucaacacuuucaccaauauggaagcgcagcugauucgccagauggagggugaaggcgugcuaucaaaagccgaccuugagaacccacaccugcccgaaaagaaaaucacacaguggcucgagacgaaggggguggagcgucugaagcggauggcuaucagcggagaugacugcgucguuaaaccuauugaugacagauuugccaacgcauuguuagcucugaaugauaugggcaaggugaggaaagacauaccacaauggcagccgucgaaggguuggcaugauuggcagcagguacccuucuguucucaccauuuccacgaacucaucaugaaagacgggcgcaagcuuguggucccuugccgaccacaagacgagcugauuggacgggccagaaucagucagggcgcaggcuggucccuaagggaaaccgccugucuggggaaggcguaugcucagauguggagccucauguacuuucaccgcagagauuugcggcuggccucaaacgcaauuugcuccgccgugcccguucauugggugccuacuucuaggacaaccuggagcauccacgcucaucaccaauggaugacuacagaggacaugcuuaccgucuggaaucguguguggauagaagauaacccauggauggaggacaaaacgcccguaacaaccugggagaauguuccuuaccugggaaagcgagaagaucaguggugugguagucucaucggcuuaacuucccgcgccaccugggcacagaacauuccgacagcuauccagcaagugagaagccugauugggaaugaggaauucuuggacuauaugccaucuaugaaacgguuuaggaaggaggaggaaucagagggagccaucugguga

SEQ ID NO: 15452 - RNA, 9873 nt, Artificial Sequence
  derived and/or modified CDS sequence (opt3) from DENV-3__FJ562107__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauuguuauaggaaucauuacccuguauuuaggcgcggucgugcaggcugacauggguugugugaucaauuggaaagggaaggagcugaagugcggauccggcauuuucgucacuaacgagguucauacauggaccgaacaguacaaauuucaagccgauucucccaagcggcuagcaacugccaucgcuggugccugggagaauggcgugugugggauacgaagcaccacacgcauggaaaaccuccuguggaaacagaucgcaaaugagcuuaacuauauuuugugggaaaauaacaucaagcugacggugguagucggagacauuaucggcgugcucgagcaggggaaaagaacccugacuccacagccuauggaguuaaaguacucauggaaaacauggggaaaggcuaagauaguuaccgccgaaacacaaaacaguuccuucauuaucgauggccccaauacuccagagugccccagcgcgucuagggccuggaacgugugggaagucgaggacuaugguuuugggguguucaccacgaauauuuggcugaaacuucgggaaguuuacacacaguugugugaccaccgccucaugucagcugcagugaaggaugagagagccguacacgcugacaugggauacuggaucgagagucagaaaaacggcagcuggaagcuggaaaaagccucccuaauagaggucaagaccugcacuuggccuaagucucauacccuguggucgaauggugugcucgaaagcgauaugaucauuccaaaaucccuggcaggcccgaucucacagcacaacuauaggcccggguaccauacacaaacugcgggaccuuggcaccuuggcaaguuggagcuggacuuuaauuauugcgaggggaccacaguggucauuacggaaaacuguggaacccguggcccaaguuuacggacuacaaccguuucugguaaacucauccacgaguggugcugucgaagcugcacucugcccccucuuagauacaugggggaagauggauguugguauggcauggagauaaggccaauuuccgaaaaggaggagaauauggugaaaucacugguaagcgccgguucuggcaagguggacaacuucacaaugggggucuugugccucgcuauccuguuugaagaggugaugcgcggaaaguucggcaaaaagcauaugaucgccgggguuuucuuuaccuucgugcuacugcucuccggacagauuacguggcgggauauggcacacacucugaucaugauuggcaguaaugcuagcgacagaauggguaugggggucaccuaccuugccuugauagcaacauuuaaaauccagcccuuccuggccuuaggauuuuuccucaggaagcugaccucucgcgaaaaccuucugcuaggcgugggccucgcuauggcgacuacacugcaauugccggaggauauugaacagauggccaaugggaucgcacugggauuaauggcucucaaacugauuacccaguuugagacauaucagcuuuggacugcccugaucuccuugaccuguucaaacacgauauucacacucaccguugccuggcgaacugcuacccugauccuagcaggugugagucugcuuccugucugccaaagcucguccaugcggaagacagacuggcucccaaugacuguagccgcgaugggcgugcccccucugcccuuguuuauuuucucucugaaggauaccuuaaaacguagaagcuggccacucaaugaggggguuauggcugugggacuggucucaauccuugccaguucccuguugaggaacgacgugccuauggcaggcccccucguagccggugggcugcuaauugcuuguuacgugaucacgggaacaucugcagaucugaccgucgaaaaggccgcggacguuacuugggaggaagaggcugaacagacaggcgugagccauaaccuuaugauaaccguggacgaugacggcacuaugcgcauuaaagaugacgagacagagaauauccucaccguccuguugaagacggccuuacugaucguguccgggauuuuuccauacucaauaccggcaacucuccugguuuggcacaccuggcagaaacagacacaacggagcggaguacuuugggaugugccuagucccccagaaacccagaaggccgagcuggaagagggugucuauagaaucaaacagcagggcauuuucgggaagacacaagugggaguuggcgugcagaaggagggugucuuucauacuauguggcacgugaccaggggggcuguauugacguacaacggaaaacgacuagaacccaauugggccucugucaagaaagaccugaucuccuauggcggcggguggcgccucagcgcacaguggcaaaagggagaggaagugcagguuauugcuguggagccugguaaaaacccaaagaauuuccagacaaugcccggcacuuuccagaccacaaccggggaaaucggagccauagcgcuggauuuuaagccuggcacuucggguucaccgaucauuaaccgggaggggaaagucgugggacuuuacggcaauggcguugugaccaagaacgggggauaugucucugguaucgcccaaacaaaugcagagccagacggccccacgccugaauuagaggaagagauguucaaaaagagaaaccugacuauuauggaucuccacccagggaguggaaaaaccaggaaguacuugcccgcuaucgugcgugaagccauaaagcgccggcugagaacacucauucuggcuccuaccaggguaguggcagccgagauggaggaagcccuuaaaggccugccgauccgauaucagacuacagcuaccaaguccgagcauacgggucgggaaaucguugacuugaugugccacgcgacuuuuacaaugcgccuacugagccccgucagagugccaaauuacaaccucauuaucauggaugaggcacauuucaccgacccugccucuauagcugccaggggguacauuagcacccgggugggaaugggcgaagcagccgcuaucuuuaugacugcgacacccccaggcaccgccgaugcauucccucaguccaaugcucccauucaggacgaggagcgagacaucccagaaagaucauggaacagugggaaugaguggauaacagauuuugccggaaaaacugucugguucguaccgagcauuaaggcagguaacgacaucgccaacuguuuacgcaaaaauggcaagaaggugauccaacugucuaggaaaacguuugauaccgaauaucagaagacaaaacuuaacgacugggauuucguugugacuaccgacauuuccgagaugggggcuaauuuuaaggccgaucgugucaucgacccucggagaugccugaaacccgugauucucacagauggaccagagaggguuauauuggcgggccccaugccugugaccgcagccucagcugcccagcgccgagguagagucgggcggaacccacagaaggaaaaugaccaauacaucuucacuggccagccccugaacaaugaugaggaccacgcucauuggacggaagcaaagaugcuccuggacaacauuaauaccccugagggaaucaucccggcccuuuucgaaccagagagggagaaaagugcugccauugauggcgaauaucgccuaaagggggagagccguaaaacauuuguggaacugaugagacggggagacuugcccguaugguuagcauacaagguggcguccgaggguauaaaauauacugauaggaaguggugcuucgacggccagcgcaacaaucagauccuggaagagaacauggauguugagauuuggaccaaagaaggggagaagaagaaacuccgaccuagauggcuggacgcccggacauacucugauccccuugcucugaaggaauuuaaagacuucgccgcaggaaggaagucgaucgcucucgauuuggucaccgagauuggccgcgugccaagccaccuggcccacagaacuaggaaugcacuagacaaccuggugaugcuccauacaucagaacacggugggaaagccuaucggcaugcugucgaggagcuuccugaaacgauggagacccuguuauugcugggccucaugauccugcuuacuggaggcgcgaugcuguuucucauauccgggaagggaaucgguaagacaaguauuggcuugaucuguguuauugccucuagcgggaugcuguggauggcagaaauccccuuacaauggauagcuuccgccauugugcuagaguucuuuaugaugguacugcucaucccagagccugaaaaacagcguaccccgcaggauaaucaacuugccuacguggucauuggaauccugaccuuggcagcuauaaucgccgcgaacgagaugggccugcucgaaacaacuaagcgcgaccuggguaugucaaaagagcccggggugguuucuccaacgagcuaccuugauguggaccuccacccugcuagugccuggacccuguaugcagucgccacaacuguaauuacccccauguugcgacacacaaucgaaaauuccaccgcuaacgugagccuggcagccauugcgaaccaggcuguuguguuaaugggccuagacaagggauggccaaucucuaaaauggaucugggcgucccucuccuugcccuggggugcuacucacaggugaaucccuugacucugacggcagccguccuccugcuuauaacacauuaugcuauuaucggaccgggcuuacaggccaaggcaaccagagaggcucaaaagaggacugccgcggguaucaugaaaaacccaaccguggacgggauuaugacaaucgaucuggacccuguuauauacgauuccaaguucgagaaacagcucggacaggugauguugcugguacuaugugccgugcagcugcuccuuaugcggacuaguugggcacugugcgaagcuuugacccuggccacaggccccauuacgacccucugggaggguagcccaggcaaguuuuggaauacuacaaucgcagucucgauggcuaacauuuuccgcgggucuuaucuggccggagccggcuuagcguuuuccaucaugaaaagcguugggaccggaaagagaggcacugguucacaaggggaaacacuuggagagaaguggaaaaagaaacugaaucagcucaguaggaaggaauucgaccuauacaaaaagucuggcauaaccgagguggaucggacggaggcuaaagaaggucugaagcgaggcgagaucacccaccaugcagucuccagagggagcgccaaguugcagugguuuguggaacgcaacaugguaauucccgagggaagggugaucgaccugggcugugggcggggaggcuggucauauuacugcgcuggucucaaaaagguuacagaagugcguggguacacuaaaggaggcccuggccacgaggagccgguccccaugaguaccuauggguggaauauugugaagcuuaugagcggaaaagaugucuucuaccugccaccugaaaagugugacacauugcugugcgauaucggugaguccucucccagcccuacuguggaagaguccagaaccauuaggguucucaagaugguagagccaugguuaaaaaacaaucaguucuguaucaaggugcugaaccccuauaugccuacagucauagaacaucuugagcgccugcaacggaaacacggcgggaugcuagugcgaaauccacucucaagaaacucuacccacgaaauguacuggauuaguaauggaacuggcaacaucguugccucggugaauauggucagcaggcuguugcugaaccgcuuuacgaugacacaucggagacccaccaucgagaaggacguggaucucggugcagggacucgucacguaaacgccgaaccggagaccccuaauauggacgugauuggagagaggauaaaacggaucaaggaagagcauaacuccacauggcacuaugacgaugaaaauccauacaagacgugggcuuaucacggcucuuacgagguuaaagcgaccggcucagccagcuccaugauuaacggggucgugaagcuucugacuaaacccugggacguggucccuaugguuacacagauggcaaugaccgauacuacaccauucggacagcaacgcguguuuaaggaaaaaguagacacccgaacacccagaaguaugccggguacuaggcgggugaugggcaucaccgcugagugguuauggcgcacgcuggggagaaauaagaagccuagguugugcacccgagaggaauucacaaaaaagguccggacuaacgccgcaaugggagccguguuuaccgaggaaaaucagugggauucugcuaaagccgcgguugaggacgaagauuucuggauucucguggaccgugagagagagcugcauaagcuaggcaaaugugguagcugcgucuacaacaugauggggaagcgcgaaaaaaagcuuggagaguuuggcaaggcaaaaggcucaagggccaucugguauauguggcugggggcucgguaccucgaauucgaggcccugggauuuuugaaugaggaucacugguucuccagagaaaacaguuauagcgguguggagggcgaagggcugcauaagcucggauacauacuucgcgacaucucuaaaauucccggcggugcaauguaugcugaugacacagccgggugggacacuaggaucaccgaggaugaccugcacaaugaagagaagauuacgcagcagauggauccagagcaucgacaauuagcuaacgccaucuuuaaacugacauaccagaauaagguaguuaaggugcagcggccuacccccacuggaacagucauggacauaauuuccagaaaagaucagaggggcucaggccaaguggggaccuauggauugaacacuuucaccaauauggaagcacagcucauccgccagauggagggugaaggcgugcugagcaaggcggaccuagagaacccacaccuucccgaaaaaaagaucacacaguggcuggagacgaaaggggucgagcgucucaagcggauggccauuucgggagaugacugcguugugaagccuauagaugacagauuugcuaacgcccuguuggcauuaaaugauaugggcaaaguaaggaaggacaucccacaauggcagccgucuaaagguuggcacgauuggcagcaggugcccuucuguagucaucacuuccaugaacugauuaugaaggacgggcgcaaacucgucgugccuugccgaccacaagacgagcuuaucggacgggcuagaauuucccagggcgccggcuggagccugagggaaaccgcaugucuagggaaggccuacgcgcagauguggucacugauguacuuucaccgcagagaucuccgguuggcuuccaacgccaucugcucugcaguucccgugcacugggucccuacuagcaggacaaccuggaguauacaugcccaccaucaauggaugacuacagaggacaugcugaccguguggaaucguguauggaucgaagauaacccauggauggaggacaagacgcccguuacaaccugggagaaugugccuuaucuuggaaaacgagaagaucaguggugugguucccugauuggccucacuagccgcgcuaccugggcccagaacaucccgacagcaauucagcaagucagaucuuuaaucgggaaugaggaauuccuggacuacaugccaucaaugaagcgguuuaggaaagaggaggaaagugagggagcuauuugguga

SEQ ID NO: 15453 - RNA, 9873 nt, Artificial Sequence
  derived and/or modified CDS sequence (opt3) from DENV-3__FJ547071__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcaagguagacaacuucacaauggggguguugugccucgccauccuguuugaagaggucaugcgcggaaaguucggcaaaaagcauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaaaauccagcccuuccuggcuuuaggauuuuuccucaggaagcugaccucucgcgaaaaccuucugcuaggcgucggccucgcgauggccacuacacugcaauugccggaggauauugaacagauggcaaaugggaucgcucugggauuaauggcccucaaacugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaagacagacuggcucccaaugacugucgcggcuaugggcguacccccucugcccuuguuuauuuucucucugaaggauaccuuaaaacguagaagcuggccacucaaugagggggugauggccguuggacuggugucaauccuugcaaguucccuguugaggaacgacgucccuauggccggcccccucguggcuggugggcugcuaauugcauguuacguaaucacgggaacaucugccgaucugaccguggaaaagacugcggacgucacaugggaggaagaggcugaacagaccggcguuagccauaaccuuaugauaacuguggacgaugacggcacaaugcgcauuaaagaugacgagaccgagaauauccucacggugcuguugaagacugccuuacugaucgucuccgggauuuuuccauacucaauaccggcaacccuccugguguggcacacauggcagaaacagacccaacggagcggaguucuuugggauguaccuagucccccagaaacacagaaggccgagcuggaagaggguguguauagaaucaaacagcagggcauuuucgggaagacucaagucggagugggcguucagaaggaggguguguuucauaccauguggcacgucacgaggggggcuguguugacauacaacggaaaacgacuagaacccaauugggccucuguaaagaaagaccugaucuccuauggcggcggguggcgccucagcgcacaguggcaaaagggagaggaaguccaggugauugcuguugagccugguaaaaacccaaagaauuuccagacuaugcccggcaccuuccagacaaccacuggggaaaucggagccauagcgcuggauuuuaagccuggcaccucggguucaccgaucauuaaccgggaggggaaaguggucggacuuuacggcaauggcgugguuacaaagaacgggggauaugugucugguaucgcccaaacgaaugcagagccagacggccccacuccugaauuagaggaagagauguucaaaaagagaaaccugaccauuauggaucuccacccagggaguggaaaaacaaggaaguacuugcccgcuaucguccgugaagccauaaagcgccggcugagaacccucauucuggcuccuacuagggugguagcagccgagauggaggaagcccuuaaaggccugccgauccgauaucagacaaccgcuacgaaguccgagcauacuggucgggaaaucguggacuugaugugccacgcgacauuuaccaugcgccuacugagccccguuagagucccaaauuacaaccucauuaucauggaugaggcacauuucaccgacccugccucuauagcugccaggggguacauuagcacucgggugggaaugggcgaagcagccgcuaucuuuaugacagcgacccccccaggcacagccgaugcauucccucaguccaaugcucccauucaggacgaggagcgagacaucccagaaagaucauggaacagugggaaugaguggauaacugauuuugccggaaaaacggugugguucgucccgagcauuaaggcagguaacgacaucgccaacuguuuacgcaaaaauggcaagaagguaauccaacugucuaggaaaaccuuugauacagaauaucagaagacuaaacuuaacgacugggauuucgugguuaccacagacauuuccgagaugggggcuaauuuuaaggccgaucgugugaucgacccucggagaugccugaaacccgucauucucaccgauggaccagagagggugauauuggcgggccccaugccuguuacugcagccucagcugcccagcgccgagguagaguggggcggaacccacagaaggaaaaugaccaauacaucuucacgggccagccccugaacaaugaugaggaccacgcucauuggaccgaagcaaagaugcuccuggacaacauuaauacaccugagggaaucaucccggcccuuuucgaaccagagagggagaaaagugcugccauugauggcgaauaucgccuaaagggggagagccguaaaacuuuugucgaacugaugagacggggagacuugcccgugugguuagcacacaagguagcguccgaggguauaaaauacaccgauaggaaguggugcuucgacggccagcgcaacaaucagauccuggaagagaacauggauguggagauuuggacaaaagaaggggagaagaagaaacuccgaccuagauggcuggacgcccggaccuauucugauccccuugcucugaaggaauuuaaagacuucgccgcaggaaggaagucgaucgcucucgauuugguuacugagauuggccgcgucccaagccaccuggcccauagaacaaggaaugcacuagacaaccuggugaugcuccacacgucagaacauggugggaaagccuaccggcacgcuguggaggagcuuccugaaaccauggagacucuguuauugcugggccucaugauccugcuuacaggaggcgcgaugcuguuucucauauccgggaagggaaucgguaagaccaguauuggcuugaucugugucauugccucuagcgggaugcuguggauggcagaaauccccuuacaauggauagcuuccgccauuguucuagaguucuuuaugauggugcugcucaucccagagccugaaaaacagcguaccccgcaggauaaucaacuugccuauguagugauuggaauccugacauuggcagcuauaaucgccgcgaacgagaugggccugcucgaaacuacgaagcgcgaccuggguaugucaaaagagcccggggucgugucuccaaccagcuaccuugauguugaccuccacccugcuagugccuggacacuguacgcaguggccacuaccgucauuacacccauguugcgacauaccaucgaaaauuccacugcuaacguaagccuggcagccauugcgaaccaggcugugguuuuaaugggccuagacaagggauggccaaucucuaaaauggaucugggcgugccucuccuugcccuggggugcuauucacaggucaaucccuugacgcugacagcagccgugcuccugcuuauaacccacuacgcuauuaucggaccgggcuuacaggccaaggcaacuagagaggcucaaaagaggaccgccgcggguaucaugaaaaacccaacagucgacgggauuaugacuaucgaucuggacccugugauauaugauuccaaguucgagaaacagcucggacagguuauguugcugauucuaugugccgugcagcugcuccuuaugcggaccaguugggcacugugcgaagcuuugacacuggccacgggccccaucaccacucucugggaggguagcccaggcaaguuuuggaauacaaccauugcaguaucgauggcuaacaucuuccgcgggucuuaccuggccggagccggcuuagcguuuuccauaaugaaaagcguggggacuggaaagagaggcacagguucacaaggggaaacccuuggagagaaguggaaaaagaaacugaaucagcucaguaggaaggaauucgaccuauauaaaaagucuggcaucacggaggucgaucggaccgaggcuaaagaaggucugaagcgaggcgagauuacacaucacgcaguuuccagagggagcgccaaguugcagugguuuguggaacgcaacauggucauccccgagggaagggugauugaccugggcugugggcggggaggcuggucauacuauugcgcuggucucaaaaagguaacugaagugcguggguacaccaaaggaggcccuggccaugaggagccgguucccaugaguacauacggguggaauaucgugaagcuuaugagcggaaaagaugucuucuaucugccaccugaaaagugugacacuuugcugugcgauauuggugaguccucucccagcccuaccguggaagaguccagaacaaucaggguccucaagaugguggagccaugguuaaaaaacaaucaguucuguauaaagguucugaaccccuacaugccuaccguaauugaacaccuugagcgccugcaacggaaacacggcgggaugcuagugcgaaauccacucucaagaaacucuacucaugaaauguauuggaucaguaauggaacgggcaacaucgucgccucggugaauaugguuagcaggcuguugcugaaccgcuuuacaaugacccaccggagacccacuauugagaaggacguggaucucggugcagggacccgucaugucaacgccgaaccggagacaccuaauauggacgugauaggagagaggaucaaacggauuaaggaagagcacaacuccacguggcacuacgacgaugaaaauccauauaagaccugggcuuaccauggcucuuaugagguaaaagcgacuggcucagccagcuccaugaucaacggggugguuaagcuucugacaaaacccugggacgucgugccuauggugacccagauggcaaugacugauacaaccccauucggacagcaacgcgucuuuaaggaaaaaguugacacacgaacucccagaaguaugccggguaccaggcgggugaugggcauuacggcugagugguuauggcgcacccuggggagaaauaagaagccuagguugugcacacgagaggaauucacuaaaaagguacggaccaacgccgcaaugggagccguguuuacagaggaaaaucagugggauucugcuaaagccgcggucgaggacgaagauuucuggaagcucguggaccgugagagagagcugcacaaacuaggcaagugugguagcugcguuuacaacaugauggggaaacgcgaaaagaagcuuggagaguuuggcaaagcaaagggcucaagggccaucugguacauguggcugggggcucgguaucucgaauucgaggcccugggauuuuugaaugaggaucauugguucuccagagaaaacaguuacagcgguguggagggcgaagggcugcacaaacucggauauauacuucgcgacaucucuaagauucccggcggugcaauguacgcugaugacacugccgggugggacaccaggaucacggaggaugaccugcauaaugaagagaaaauuacacagcagauggauccagagcaccgacaauuagcuaacgccaucuuuaagcugaccuaucagaauaaggucgugaaaguacagcggccuacucccacaggaaccguuauggacauaauuuccagaaaggaucagaggggcucaggccaaguggggacuuacggauugaacaccuucacaaauauggaagcacagcucauccgccagauggagggugaaggcguccugagcaaagcggaccuagagaacccacaccuucccgaaaagaaaaucacgcaguggcuggagaccaaggggguggagcgucucaagcggauggccauuucgggagaugacugcguggucaaaccuauagaugacagauuugcuaacgcccuguuggcauuaaaugauaugggcaagguuaggaaagacaucccacaauggcagccgucuaaggguuggcaugauuggcagcaggugcccuucuguagucaccauuuccacgaacugauuaugaaagacgggcgcaagcucguagugccuugccgaccacaagacgagcuuaucggacgggcuagaauuucccagggcgccggcuggagccugagggaaacugcaugucuagggaaggccuaugcgcagauguggucacugauguacuuucaccgcagagaucuccgguuggcuuccaacgccaucugcucugcaguccccgugcauuggguuccuacaagcaggaccacuuggaguauacacgcccaucaccaauggaugacaaccgaggacaugcugacgguguggaaucgugucuggaucgaagauaacccauggauggaggacaaaacacccgugaccacuugggagaauguaccuuaccuuggaaagcgagaagaucaguggugugguucccugauuggccucaccagccgcgcuacaugggcccagaacaucccgacugcaauucagcaaguuagaucuuuaaucgggaaugaggaauuccuggacuauaugccaucaaugaaacgguuuaggaaggaggaggaaagugagggagcuauuugguga

SEQ ID NO: 15454 - RNA, 9873 nt, Artificial Sequence
  derived and/or modified CDS sequence (opt3) from DENV-3__FJ410176__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacaccauuggcguccucgagcaggggaaaagaacucugacaccacagccuauggaguuaaaguacucauggaaaaccuggggaaaggccaagaucgugacagcggaaacucaaaacaguuccuucauaauugauggccccaauaccccagagugccccagcgccucuagggcuuggaacguuugggaaguggaggacuaugguuuuggggucuucacgacaaauaucuggcugaaacuucgggaaguguacacccaguugugugaccaccgccucaugucagcagccguuaaggaugagagagcugugcacgccgacaugggauacuggauugagagucagaaaaacggcagcuggaagcuggaaaaagcaucccuaaucgagguaaagacuugcaccuggccuaagucucauacacuguggucgaaugguguccucgaaagcgauaugauaaucccaaaaucccuggcgggcccgauuucacagcacaacuauaggcccggguaccauacucaaaccgccggaccuuggcaccuuggcaaguuggagcuggacuuuaauuauugcgaggggacaacgguggugaucaccgaaaacuguggaacucguggcaguucuuuacggacaaccacugucagcgguaaacucauucacgaguggugcugucgauccugcacacugccaccccuuagauacaugggggaagauggauguugguauggcauggagaucaggccuauaucagaaaaggaggagaauaugguuaaaagccuggugucugcugguuccggcaagguagacaacuucaccauggggguguugugccucgccauucuguuugaagaggucaugcgcggaaaguucggcaaaaagcauaugaucgcaggggugcuauucacguuuguucugcuccugaguggacagaucacuuggcgggauauggcucacacccuuauuaugaucggcagcaaugccucugacagaauggguaugggggugacauacuuggcacugauugccaccuucaaaauacagccauuuuuagcucucggauucuuucugaggaagcuuacuucccgcgaaaaccugcuacucggcgucggccuggcgauggccacaaccuugcaacugcccgaggauaucgaacagauggcaaaugggauugcuuuaggacucauggcccugaaacuuacaacucaguucgagaccuaucagcuguggacggccuugaucucacucacauguaguaacaccauuuuuacucugaccguggcuuggcgaacagcaacucuaauccuggccgguguuagccuucucccggugugccaaucguccucuaugcggaagaccgacuggcugccuaugacggucgcggcuaugggcguaccacccuugccucuguucauauuuagcuuaaaggauacacucaaacguagaucauggccccugaaugagggggugauggccguuggacuugugaguauccuggcauccucuuugcucaggaacgacgucccaauggccggcccucugguggcuggugggcuacugauugcauguuacguaaucaccggaacuagcgccgaucuuacaguggaaaaggcggcugacgucaccugggaggaagaggccgaacagacuggcguuucccauaaccucaugauuacaguggacgaugacggcaccaugcgcaucaaagaugacgagacggagaauauacugacuguguuguuaaagaccgcacugcucauugucucagggaucuuccccuacagcaucccagccacacugcuuguguggcacaccuggcagaaacagacacaacggaguggaguucugugggauguaccgucuccucccgaaacucagaaggcugaguuggaagaggguguguauagaauuaaacagcagggcauauuugggaagacccaagucggagugggcguucagaaggaggguguguuccauacgauguggcacgucacaaggggggccgugcuaacuuacaacggaaaacgacuggaaccaaauugggcauccguaaagaaagaccucaucagcuauggcggcggguggcgccugucggcucaguggcaaaagggagaggaaguccaggugauugccguugagcccgguaaaaacccuaagaauuuucagaccaugccaggcacauuccagaccacuaccggggaaaucggagcgauugcccuugauuucaagcccggcacaucagguucuccuaucauaaaccgggaggggaaaguggucggauuauacggcaauggcgugguuacgaagaacgggggauaugugagugguaucgcacaaacuaaugcugagccggacggcccaacccccgaacuggaggaagagauguuuaaaaagagaaaccucacaauuauggauuugcacccuggguccggaaaaaccaggaaguaccugccagccaucguccgugaagcuauuaagcgccggcucagaacucugauccuugcacccacaagggugguagccgccgagauggaggaagcucugaaaggcuugccuauacgauaucagaccacggcgacuaagagcgagcauacaggucgggaaauuguggaccuaaugugccacgcaaccuucaccaugcgccugcucucuccgguuagaguccccaauuacaacuuaaucaucauggaugaggcccauuuuacugacccagcuagcauugccgcaaggggguacaucuccacacgggugggaaugggcgaagccgcugcgauauucaugaccgccacaccucccggcacugcagaugcuuuuccacagucaaaugccccuauucaggacgaggagcgagacauccccgaaagaaguuggaacagcgggaaugaguggauuacggauuucgcaggaaaaaccgugugguuugucccaucuaucaaggccgguaacgacauagcuaacugucugcgcaaaaauggcaagaagguaauucaacuuuccaggaaaacauucgauacugaauaucagaagaccaaacugaacgacugggauuuugugguuacaaccgacaucucagagaugggggccaauuucaaggcggaucgugugaucgacccgcggagaugccucaaaccugucauuuugacugauggacccgagagggugauccuggcaggcccaaugcccguuacggccgcuagugccgcucagcgccgagguagaguggggcggaacccucagaaggaaaaugaccaauacauuuuuaccggccagccacucaacaaugaugaggaccacgcacauuggacagaagccaagaugcugcuugacaacauaaauacucccgagggaaucauuccugcucuauucgaaccggagagggagaaaagcgccgcaaucgauggcgaauaucgccugaagggggagucccguaaaaccuucgucgaauugaugagacggggagacuuaccaguguggcuggcgcacaagguagccucugaggguaucaaauacacagauaggaaguggugcuuugacggccagcgcaacaaucagauucucgaagagaacauggauguggagauauggaccaaagaaggggagaagaagaaacugcgacccagauggcuugacgcucggacuuauucggauccucuggcccucaaggaauucaaagacuuugcagcuggaaggaagagcaucgccuuggaucugguuacagagauuggccgcguccccucacaccuagcacauagaacgaggaaugcccuggacaaccucgugaugcuucacaccuccgaacauggugggaaagcuuaccggcacgcgguggaggagcugccagaaacuauggagacauuauugcugcucggccugaugauccuucugaccggaggcgccaugcucuucuugauuagugggaagggaaucgguaagaccucuauaggccugaucugugucauugcaagcuccgggauguuauggauggcugaaaucccucuacaauggauugccucagccaucguucuggaguuuuucaugauggugcuccuuauacccgagccagaaaaacagcguacaccucaggauaaucaacuggcauauguagugauuggaaucuugacucuggcugccauuaucgcggcuaacgagaugggccuccuggaaacgaccaagcgcgaccuugguaugucuaaagagccgggggucgugagccccacaaguuaccucgauguugaccugcacccagccuccgcauggacuuuguacgccguggcuaccacagucauaaccccuaugcugcgacauacuaucgaaaauagcacggcaaacguaucuuuagccgcgauugcuaaccaggccgugguucuaaugggccuggacaagggauggcccaucucaaaaauggaucucggcgugccacuucuggcauuggggugcuauucccaggucaauccucugacacucaccgccgcugugcugcuuuuaauuacucacuacgccaucauaggacccggccugcaggcaaaggcuaccagagaggcccaaaagaggacagcggccgguauuaugaaaaacccgacugucgacgggaucaugaccaucgaucucgacccagugauuuaugauaguaaguuugagaaacaguugggacagguuaugcugcuagugcugugugcaguacagcuccuucugaugcggacaagcugggcuuugugcgaagcccugacgcucgcaaccggcccuaucacuacacugugggaggguucgcccggcaaguucuggaauaccacuauagcugugucuauggccaacauuuuucgcggguccuacuuagccggagcgggccuugcuuucagcaucaugaaaucagucgggacaggaaagagaggcaccgguagucaaggggaaacgcugggagagaaguggaaaaagaaacucaaucagcuaucuaggaaggaauuugaccuguauaaaaaguccggcauuaccgagguugaucggacagaggcaaaagaagguuugaagcgaggcgagaucacucaucacgccgugagcagagggucagcuaagcugcagugguucgucgaacgcaacauggugauaccagagggaaggguaaucgaccucggcugugggcggggaggcuggaguuacuauugcgccggucuuaaaaaggugaccgaaguucguggguacacaaaaggaggccccggccaugaggagccugugccgaugagcacuuacggguggaauauugucaagcugauguccggaaaagauguguuuuauuugcccccagaaaagugugacacccugcucugcgauaucggugagucuagcccuucccccacagucgaagagucaagaaccauuaggguguuaaagaugguugagccuuggcugaaaaacaaucaguucuguaucaagguacuuaacccauacaugcccacugugauugaacaccuggagcgccuacaacggaaacacggcgggaugcucguccgaaauccucugucuagaaacaguacgcaugaaauguauuggaucucgaauggaacaggcaacauaguggcaagcguuaauaugguguccagguugcugcucaaccgcuucaccaugacucaccggagaccaaccauugagaaggacgucgaucuuggugccgggacacgucaugugaacgcugaacccgagacgccgaauauggacguaaucggagagaggaucaaacggauuaaggaagagcacaacucuaccuggcacuacgacgaugaaaauccuuauaagacuugggcguaccauggcucauaugaggugaaagccacaggcagcgcauccaguaugauaaacgggguugucaagcuguuaaccaaaccaugggacguggugcccauggucacucagauggcuaugacagauaccacaccuuuuggacagcaacgcguuuucaaggaaaaaguggacacucgaaccccaagaucuaugcccgguacgaggcggguaaugggcaucaccgccgaguggcuguggcgcacauuggggagaaauaagaagccgaggcucugcacucgagaggaauuuaccaaaaaggugcggacaaacgcagccaugggagcugucuucacugaggaaaaucagugggauagcgccaaagcggcaguggaggacgaagauuuuuggaagcugguugaccgugagagagagcuacacaaacuuggcaagugugguucaugcguguacaacaugauggggaaacgcgaaaagaagcugggagaguucggcaaagccaagggcuccagggcuauuugguacauguggcucggggcccgguaucuggaauuugaggcauugggauuccugaaugaggaucauugguuuaguagagaaaacagcuacucuggugucgagggcgaagggcuccacaaacuuggauauauccugcgcgacauuuccaagaucccuggcggugcuauguacgccgaugacaccgcugggugggacacgaggauaacagaggaugacuuacauaaugaagagaaaaucacccagcagauggaucccgagcaccgacaacuggccaacgcaauuuucaaguugacuuaucagaauaaggugguaaaaguucagcggccaacaccuaccggaacugugauggacaucauuucaagaaaggaucagaggggcagcggccaagucgggaccuacggacucaacacauuuacgaauauggaagcgcagcugauccgccagauggagggugaaggcgugcuaucgaaagccgaccuugagaacccccaccugccagaaaagaaaauaacccaguggcucgagacuaaggggguggagcgucugaagcggauggcuauuucuggagaugacugcgucguuaaacccaucgaugacagauucgccaacgcauuguuagcucugaaugauaugggcaaggugaggaaagacaucccucaauggcagccaaguaaggguuggcaugauuggcagcagguaccguuuuguucccaccauuuccacgaacucauuaugaaagacgggcgcaagcuugugguccccugccgaccucaagacgagcugauaggacgggccagaaucagccagggcgcaggcuggucacuaagggaaacagccugucuggggaaggcguaugcucagauguggucccucauguacuuccaccgcagagauuugcggcuggccucuaacgcaauuugcagcgccgugccaguucauugggugcccaccaguaggacuacaugguccauccacgcucaucaccaauggaugaccacggaggacaugcuuacagucuggaaucguguguggauugaagauaacccuuggauggaggacaaaaccccaguaacuaccugggagaauguucccuaccugggaaagcgagaagaucaguggugugguagccucaucggcuuaacaucucgcgccacuugggcacagaacauaccuaccgcuauccagcaagugagaucacugauugggaaugaggaauuuuuggacuauaugccgaguaugaaacgguucaggaaggaggaggaauccgagggagccaucugguga

SEQ ID NO: 15455 - RNA, 9873 nt, Artificial Sequence
  derived and/or modified CDS sequence (opt3) from DENV-3__FJ410177__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacaccauuggcguccucgagcaggggaaaagaacucugacaccacagccuauggaguuaaaguacucauggaaaaccuggggaaaggccaagaucgugacagcggaaacucaaaacaguuccuucauaauugauggccccaauaccccagagugccccagcgccucuagggcuuggaacguuugggaaguggaggacuaugguuuuggggucuucacgacaaauaucuggcugaaacuucgggaaguguacacccaguugugugaccaccgccucaugucagcagccguuaaggaugagagagcugugcacgccgacaugggauacuggauugagagucagaaaaacggcagcuggaagcuggaaaaagcaucccuaaucgagguaaagacuugcaccuggccuaagucucauacacuguggucgaaugguguccucgaaagcgauaugauaaucccaaaaucccuggcgggcccgauuucacagcacaacuauaggcccggguaccauacucaaaccgccggaccuuggcaccuuggcaaguuggagcuggacuuuaauuauugcgaggggacaacgguggugaucaccgaaaacuguggaacuggcgguccaaguuuacguacaaccacugucucugggaaacucauucacgaguggugcugucggagcugcacacugcccccucuucgauacaugggagaagauggcuguugguaugguauggagaucagaccaauauccgaaaaggaggagaauaugguuaaaucacuggugagcgcuggcucugggaagguagacaacuucaccaugggaguguugugccucgccauucuguuugaagaggucaugaggggcaaguucgggaaaaagcauaugaucgcaggaguguucuuuacguucguucuacugcucuccggccagaucacuuggcgcgauauggcucacacccugauuaugaucgguaguaaugccagcgaccggauggggaugggagugacauaccuugcauugauugccaccuuuaaaauacagcccuuccuggcuuuaggcuuuuuccucagaaagcugacuucuagggaaaaccuucugcuaggcgucgggcucgcgauggccacaacccugcaauugccggaggauaucgaacagauggcaaauggaauugcucuggguuuaauggcccucaaacugacaacucaguuugagaccuaucagcuuuggacggcccugaucuccuugacauguucaaacaccauuuucacucucaccguggcuuggcgcacagcaacucugauccuagccggcguuagucugcuuccugugugccaaagcucguccaugcgaaagaccgacuggcucccaaugacggucgcggcuauggggguacccccucugcccuuguuuauauucucucugaaggauacauuaaaacggcguagcuggccacucaaugagggagugauggccguuggccuggugucaauccuugcaaguucccuguugagaaacgacgucccuauggccgguccccucguggcugggggacugcuaauugcauguuacguaaucaccggcacuucugccgaucugacaguggaaaaggcggcugacgucaccugggaggaagaggccgaacagacuggcguuagccauaaccuuaugauuacaguggacgaugacgggaccaugaggaucaaagaugacgagacggagaauauacucacugugcuguugaagaccgcauuacugauugucuccggaaucuuuccauacucaaucccggccacacuccugguguggcacaccuggcagaaacagacacaacgcagcgguguucuuugggauguaccuagucccccagaaacucagaaggcugagcuggaagagggcguguaucggauuaaacagcaggggauauucggaaagacccaagucggcguggguguucagaaggaggggguguuucauacgauguggcacgucacaagaggagccguguugacuuacaacggcaaaaggcuagaacccaauugggcaucuguaaagaaagaccugaucuccuauggcgggggauggcgacucagcgcucaguggcaaaagggugaggaaguccaggugauugccguugagccuggcaaaaacccaaagaauuuccagaccaugcccgggacauuccagaccacuaccggagaaaucggcgcgauugcccuggauuuuaagccugguacaucggggucaccgaucauaaaccgcgagggaaaaguggucggccuuuacggcaauggggugguuacgaagaacggagguuaugugucuggcaucgcacaaacuaaugcugagccagacgggcccaccccugaauuagaggaagagauguucaaaaagcggaaccugacaauuauggaucuccacccaggaaguggcaaaaccagaaaguacuugcccgccaucgucagggaagcuauuaagcgucgccugcggacucucauccuggcaccuacaagagugguagccgccgagauggaggaagcucuuaaaggucugccgauaagguaucagaccacggcgacuaaguccgagcauacagggcgagaaauuguggacuugaugugccacgcaaccuuuaccaugcggcuacugagccccguucgcgucccaaauuacaaccucaucaucauggaugaggcccauuucacugacccugcuucuauugccgcaagaggauacaucagcacaagggugggcaugggcgaagccgcugcgauauuuaugaccgccacacccccagggacugcagaugcuuucccucaguccaaugcccccauucaggacgaggagcgggacaucccagaacgaucauggaacaguggaaaugaguggauuacggauuuugcagguaaaaccgugugguucgucccgagcaucaaggccggcaacgacauagcuaacuguuuaagaaaaaaugggaagaagguaauucaacugucucgcaaaacauuugauacugaauaucagaagaccaaacuuaacgacugggauuucgugguuacaaccgacaucuccgagaugggagccaauuuuaaggcggauagggugaucgacccucgucggugccugaaacccgucauucucacugauggcccagagagagugaucuuggcaggucccaugccuguuacggccgcuucagccgcucagaggcgcgggcgagugggcagaaacccacagaaggaaaaugaccaauacauuuucaccggacagccccugaacaaugaugaggaccacgcacauuggacagaagccaagaugcuccuggacaacauaaauacuccugagggcaucauuccggcucuuuucgaaccagagcgggagaaaagugccgcaaucgauggggaauauaggcuaaagggagagagccgcaaaaccuuugucgaacugaugcguagaggugacuugcccgugugguuagcgcacaagguagccuccgagggcaucaaauacacagaucggaaguggugcuucgacgggcagaggaacaaucagauucuggaagagaacauggauguggagauauggaccaaagaaggagagaagaagaaacuccgcccucgauggcuggacgcuagaacuuauucugauccccuugcccugaaggaauuuaaagacuucgcagcuggccggaagucgaucgcccucgauuugguuacagagauugguagggucccaagccaccuggcacaucgcacgagaaaugcccuagacaaccuggugaugcuccacaccucagaacaugggggcaaagcuuacaggcacgcgguggaggagcuuccugaaacuauggagacacuguuauugcugggacucaugauccugcuuaccggcggggccaugcuguuucucauuuccggaaaggguaucggcaagaccaguauaggguugaucugugucauugcaucuagcggaaugcuguggauggcugaaauccccuuacaauggauugccuccgccaucguucuagaguucuuuaugauggugcugcucauaccagagccugaaaaacagcggacaccgcaggauaaucaacuugcauauguagugauuggcauccugacuuuggcugccauuaucgcggcuaacgagaugggucugcucgaaacgaccaagcgugaccuggggaugucaaaagagcccggcgucgugucuccaacaagcuaccuugauguugaccuccacccugccagugcauggacucuguacgccguggcuaccacagucauaacccccauguugcgccauacuaucgaaaauuccacggcaaacguaagccuggccgcgauugcuaaccaggccgugguuuuaaugggacuagacaagggcuggccaaucucuaaaauggaucugggggugccucuccuugcacugggaugcuauucacaggucaaucccuugacacugaccgccgcugugcuccugcuuauuacucacuacgccaucauaggcccggguuuacaggcaaaggcuacccgagaggcccaaaagagaacagcggccgggauuaugaaaaacccaacugucgacggaaucaugaccaucgaucuggacccugugauuuaugauuccaaguucgagaaacagcucggccagguuauguugcuggugcuaugugcaguacagcugcuccuuaugaggacaaguugggcucugugcgaagccuugacgcuggcaaccggucccaucacuacacucugggagggcagcccagggaaguuuuggaauaccacuauagcugugucgauggccaacauuuuccggggaucuuaccuggccggcgcgggguuagcuuuuuccaucaugaaaagcgucggaacaggcaagcgcgguaccgggucacaaggagaaacgcuuggcgagaaguggaaaaagaaacugaaucagcucaguagaaaggaauucgaccuauauaaaaagucugguauuaccgagguugauaggacagaggcaaaagaaggccugaagcggggggagaucacucaucacgccgugucccgaggaagcgcuaaguugcagugguuugucgaaagaaacauggugauacccgagggccgcguaaucgaccugggguguggaaggggcgguuggucauacuauugcgccgggcucaaaaaggugaccgaaguucggggauacacaaaaggcggcccugggcaugaggagccggugcccaugaguacuuacggauggaauauugucaagcuuaugagcgguaaagauguguucuaucugccaccugaaaagugugacaccuugcugugcgauaucggcgaguccucucccagcccuacagucgaagagucccguaccauuagagugcucaagaugguugagccaugguuaaaaaacaaucaguucuguaucaagguacugaaccccuacaugccuacugugauugaacaccuugagaggcugcaacgcaaacacgggggaaugcuaguccggaauccacucucacgaaacucuacgcaugaaauguauuggaucaguaauggcacagguaacauaguggcaucgguuaauauggugagcagacuguugcugaacagguuuaccaugacucaccgccggcccaccauugagaaggacgucgaucucggggccggaacaagacaugugaacgcugaaccggagacgccuaauauggacguaaucggcgagcguaucaaaaggauuaaggaagagcacaacuccaccuggcacuacgacgaugaaaauccauauaagacuugggcguaccauggcucuuaugaggugaaagccacagggucagcaagcuccaugauaaacggaguugucaagcuucugaccaaacccugggacguggugccuauggucacucagauggcuaugacagauaccacaccauucggucagcaacggguuuuuaaggaaaaaguggacacucgcaccccccgaaguaugccgggcacgagaaggguaauggggaucaccgccgagugguuauggcggacacugggacgcaauaagaagccuagauugugcacuagggaggaauucaccaaaaaggugcgaacaaacgcagccaugggcgcugucuuuacugaggaaaaucagugggauucugccaaagcggcaguggaggacgaagauuucuggaagcucguugaccgggagcgugagcugcacaaacuagguaagugugggagcugcguguacaacaugaugggaaaaagagaaaagaagcuuggcgaguuuggcaaagccaaggggucacgcgcuauuugguacauguggcugggagccagguaucucgaauucgaggcacuggguuuuuugaaugaggaucauugguucucccgggaaaacaguuacagcggcgucgagggggaaggacugcacaaacucggcuauauccuuagagacauuucuaagauccccgguggggcuauguacgccgaugacaccgcuggaugggacacgcgcauaacagaggaugaccugcauaaugaagagaaaaucacccagcagauggauccagagcacaggcaauuagccaacgcaauuuuuaagcugacuuaucagaauaaggugguaaaaguucagcgaccuacacccaccggcacugugauggacaucauuucccggaaggaucagagaggcucagggcaagucggaaccuacgguuugaacacauucacgaauauggaagcgcagcucaucaggcagauggagggcgaaggggugcugagcaaagccgaccuagagaacccacaccuucccgaaaagaaaauaacccaguggcuggagacuaagggaguggagcgccucaagcguauggcuauuucgggcgaugacugcgucguuaaaccuaucgaugaccgguuugccaacgcacuguuggcuuuaaaugauauggguaaggugagaaaagacaucccacaauggcagccgucuaagggguggcaugauuggcagcagguacccuucuguagucaccauuuccacgaacugauuaugaaagacggaaggaagcucguggucccuugccgcccacaagacgagcuuauaggccgagcccggaucucccagggcgcaggguggagccugagagaaacagccugucuaggaaaggcguaugcucagauguggucacugauguacuuucacaggcgcgaucucagauuggccuccaacgcaauuugcucugccgugcccguucauugggugccuaccagccggacuacauggaguauccacgcucaucaccaauggaugaccacggaggacaugcugacagucuggaauaggguguggauugaagauaacccauggauggaggacaaaacccccguaacuaccugggagaauguuccuuaccuugguaagcgugaagaucagugguguggcucccugaucgggcucacaagccgagccacuugggcacagaacauaccgaccgcuauccagcaagugcgcucuuuaauuggaaaugaggaauuccuggacuauaugccaucaaugaaaagauuucggaaggaggaggaaagugagggcgccaucugguga

SEQ ID NO: 15456 - RNA, 9873 nt, Artificial Sequence
  derived and/or modified CDS sequence (opt3) from DENV-3__FJ547072__SS-prME
accagccugugccucaugaugauccuucccgccgcucuggcauuccacuugacauccagagacggcgagccuaggaugauuguggggaagaacgaacggggacgcucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugacaaaagaagcguagcccuugcaccccaugugggcaugggucuggauacaaggacccaaacguggauguccgccgagggggcuuggcggcaggucgaaaagguggagacuugggcauugcgccacccuggauucaccauucucgcccuguuucuggcucauuacaucggcacaucucucacucagaaaguugugauauucaucuuacugaugcuugucaccccaucgaugacaaugagaugugugggcguagggaacagggacuuuguugaaggauugucaggugccaccuggguggaugucgugcuggagcacggcgggugcgugacgacuauggcgaagaauaagcccacacuagacauugagcuccagaaaaccgaagcaacucaacuggccacacuucggaagcuguguaucgagggaaaaauuaccaacaucacgaccgauagccgcugcccuacacagggcgaagcugucuugccagaggaacaggaccagaauuauguuuguaagcacacuuacguggaucgagguugggggaacggaugcggccucuucggcaaagggagucugguaaccugcgccaaguuucaauguuuagagcccauagagggaaaggugguccaguaugaaaaucugaaauacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgagaacugguuuggacuucaaugagaugauccuacugaccaugaagaacaaagcguggauggugcauaggcagugguuuuucgaucucccccugccuuggacaagcggggccaccacugaaacaccaacguggaaucggaaggagcuucugguaaccuuuaaaaacgcacacgcuaagaaacaagaaguuguggucuugggcucccaggagggagccaugcacacugcucucacaggcgccaccgaaauucagaauucagggggaacaaguauauucgcaggucaucugaagugucguuuaaagauggacaaacuggagcuaaagggcaugagcuacgccaugugcacuaacaccuuugugcucaaaaaggaggucucugaaacgcagcacgggaccauccugauuaaaguggaguacaagggagaagauguucccuguaagaucccuuucuccacagaggacggccaagguaaagcucauaacgggcgccuuauaacugcgaauccagugguaaccaagaaagaggaacccgucaacauugaggcagaaccgccuuucggcgagucaaauaucgugaucggaauuggcgauaacgccuugaagaucaauugguauaaaaaggggagcaguauuggaaagauguuugaagcuacagccagaggugcaaggcggauggccauacugggcgacacugcuugggauuucgggucuguuggaggcgugcucaacucccuggguaaaaugguccaccagaucuuugggagcgccuacaccgcacuuuucucgggcgugucuuggguaaugaagauuggaaucggcgugcuguugacguggaucgggcucaauuccaaaaacacaucaaugaguuuuagcugcauuguuauaggaaucauuacccuguauuuaggcgcggucgugcaggcugacauggguugugugaucaauuggaaggggaaagagcugaagugcggauccggcauuuucgucacuaacgagguucauacauggaccgaacaguacaaguuucaagccgauucucccaaacgacuagcaacugccaucgcuggugccugggagaauggcgugugugggauacgcagcaccacaagaauggaaaaccuccuguggaagcagaucgcaaaugagcuuaacuauauuuugugggaaaauaacaucaaacugacggugguagucggagacauuaucggcgugcucgagcaggggaagaggacccugacuccacagccuauggaguuaaaauacucauggaagacauggggaaaagcuaagauaguuaccgccgaaacacaaaacaguuccuucauuaucgauggccccaauacuccagagugccccagcgcgucucgggccuggaacgugugggaagucgaggacuaugguuuugggguguucaccacgaauauuuggcugaagcuucgcgaaguuuacacacaguugugugaccacagacucaugucagcugcagugaaagaugagagggccguacacgcugacaugggauacuggaucgagagucagaagaacggcagcuggaaacuggaaaaggccucccuaauagaggucaaaaccugcacuuggccuaagucucauacccuguggucgaauggugugcucgaaagcgauaugaucauuccaaagucccuggcaggcccgaucucacagcacaacuaucgucccggguaccauacacaaacugcgggaccuuggcaccuuggcaaauuggagcuggacuuuaauuauugcgaggggaccacaguggucauuacggaaaacuguggaacccggggcccaaguuuacgaacuacaaccguuucugguaagcucauccacgaguggugcuguagaagcugcacucugcccccucuuagguacaugggggaagauggauguugguauggcauggagauacgcccaauuuccgaaaaagaggagaauauggugaagucacugguaagcgccgguucuggcaaaguggacaacuucacaaugggggucuugugccucgcuauccuguuugaagaggugaugcggggaaaguucggcaagaaacauaugaucgccgggguuuucuuuaccuucgugcuacugcucuccggacagauuacguggagagauauggcacacacucugaucaugauuggcaguaaugcuagcgacaggauggguaugggggucaccuaccuugccuugauagcaacauuuaagauccagcccuuccuggccuuaggauuuuuccuccgcaaacugaccucucgagaaaaccuucugcuaggcgugggccucgcuauggcgacuacacugcaauugccggaggauauugaacagauggccaaugggaucgcacugggauuaauggcucucaagcugauuacccaguuugagacauaucagcuuuggacugcccugaucuccuugaccuguucaaacacgauauucacacucaccguugccuggcggacugcuacccugauccuagcaggugugagucugcuuccugucugccaaagcucguccaugcguaaaacagacuggcucccaaugacuguagccgcgaugggcgugcccccucugcccuuguuuauuuucucucugaaggauaccuuaaagagaaggagcuggccacucaaugaggggguuauggcugugggacuggucucaauccuugccaguucccuguugcgcaacgacgugccuauggcaggcccccucguagccggugggcugcuaauugcuuguuacgugaucacgggaacaucugcagaucugaccgucgaaaaagccgcggacguuacuugggaggaagaggcugaacagacaggcgugagccauaaccuuaugauaaccguggacgaugacggcacuaugcggauuaaggaugacgagacagagaauauccucaccguccuguugaaaacggccuuacugaucguguccgggauuuuuccauacucaauaccggcaacucuccugguuuggcacaccuggcagaagcagacacaaagaagcggaguacuuugggaugugccuagucccccagaaacccagaaagccgagcuggaagagggugucuauaggaucaagcagcagggcauuuucgggaaaacacaagugggaguuggcgugcagaaggagggugucuuucauacuauguggcacgugacccgaggggcuguauugacguacaacggaaagcgccuagaacccaauugggccucugucaaaaaggaccugaucuccuauggcggcggguggcggcucagcgcacaguggcaaaaaggagaggaagugcagguuauugcuguggagccugguaagaacccaaaaaauuuccagacaaugcccggcacuuuccagaccacaaccggggaaaucggagccauagcgcuggauuuuaagccuggcacuucggguucaccgaucauuaacagagaggggaaggucgugggacuuuacggcaauggcguugugaccaaaaacgggggauaugucucugguaucgcccaaacaaaugcagagccagacggccccacgccugaauuagaggaagagauguucaagaaaaggaaccugacuauuauggaucuccacccagggaguggaaagacccguaaauacuugcccgcuaucgugcgcgaagccauaaagcggagacugaggacacucauucuggcuccuacccgaguaguggcagccgagauggaggaagcccuuaagggccugccgauccgguaucagacuacagcuaccaaauccgagcauacgggucgcgaaaucguugacuugaugugccacgcgacuuuuacaaugagacuacugagccccgucagggugccaaauuacaaccucauuaucauggaugaggcacauuucaccgacccugccucuauagcugcccggggguacauuagcacccgagugggaaugggcgaagcagccgcuaucuuuaugacugcgacacccccaggcaccgccgaugcauucccucaguccaaugcucccauucaggacgaggagagagacaucccagaacgcucauggaacagugggaaugaguggauaacagauuuugccggaaagacugucugguucguaccgagcauuaaagcagguaacgacaucgccaacuguuuaaggaagaauggcaaaaaggugauccaacugucucguaagacguuugauaccgaauaucagaaaacaaagcuuaacgacugggauuucguugugacuaccgacauuuccgagaugggggcuaauuuuaaagccgaucgggucaucgacccuagaaggugccugaagcccgugauucucacagauggaccagagcgcguuauauuggcgggccccaugccugugaccgcagccucagcugcccagcgaagaggucgggucgggaggaacccacagaaagaaaaugaccaauacaucuucacuggccagccccugaacaaugaugaggaccacgcucauuggacggaagcaaagaugcuccuggacaacauuaauaccccugagggaaucaucccggcccuuuucgaaccagagcgcgagaagagugcugccauugauggcgaauaucgucuaaaaggggagagcagaaagacauuuguggaacugaugcggaggggagacuugcccguaugguuagcacacaaaguggcguccgaggguauaaaguacacugaucgcaaauggugcuucgacggccagcgaaacaaucagauccuggaagagaacauggauguugagauuuggaccaaggaaggggagaaaaagaagcucagaccucgguggcuggacgccaggacauauucugauccccuugcucugaaagaauuuaaggacuucgccgcaggacgcaaaucgaucgcucucgauuuggucaccgagauuggcagagugccaagccaccuggcccauaggacucggaaugcacuagacaaccuggugaugcuccacacaucagaacauggugggaaggccuaccgucacgcugucgaggagcuuccugaaacgauggagacccuguuauugcugggccucaugauccugcuuacuggaggcgcgaugcuguuucucauauccgggaaaggaaucgguaagacaaguauuggcuugaucuguguuauugccucuagcgggaugcuguggauggcagaaauccccuuacaauggauagcuuccgccauugugcuagaguucuuuaugaugguacugcucaucccagagccugaaaagcagcgcaccccgcaggauaaucaacuugccuauguggucauuggaauccugaccuuggcagcuauaaucgccgcgaacgagaugggccugcucgaaacaacuaaacgagaccuggguaugucaaaggagcccggggugguuucuccaacgagcuaccuugauguggaccuccacccugcuagugccuggacccuguacgcagucgccacaacuguaauuacccccauguugagacauacaaucgaaaauuccaccgcuaacgugagccuggcagccauugcgaaccaggcuguuguguuaaugggccuagacaaaggauggccaaucucuaagauggaucugggcgucccucuccuugcccuggggugcuauucacaggugaaucccuugacucugacggcagccguccuccugcuuauaacacacuacgcuauuaucggaccgggcuuacaggccaaagcaaccagggaggcucaaaagcggacugccgcggguaucaugaagaacccaaccguggacgggauuaugacaaucgaucuggacccuguuauauaugauuccaaauucgagaagcagcucggacaggugauguugcugguacuaugugccgugcagcugcuccuuaugcgcacuaguugggcacugugcgaagcuuugacccuggccacaggccccauuacgacccucugggaggguagcccaggcaaauuuuggaauacuacaaucgcagucucgauggcuaacauuuucagagggucuuaccuggccggagccggcuuagcguuuuccaucaugaagagcguugggaccggaaaaaggggcacugguucacaaggggaaacacuuggagagaaguggaagaaaaagcugaaucagcucagucggaaagaauucgaccuauauaagaaaucuggcauaaccgagguggaucgaacggaggcuaaggaaggucugaaaagaggcgagaucacccaucacgcagucucccgcgggagcgccaaguugcagugguuuguggaaaggaacaugguaauucccgagggacgggugaucgaccugggcugugggcguggaggcuggucauacuauugcgcuggucucaagaaaguuacagaagugagaggguacacuaagggaggcccuggccaugaggagccgguccccaugaguaccuacggguggaauauugugaaacuuaugagcggaaaggaugucuucuaucugccaccugaaaaaugugacacauugcugugcgauaucggugaguccucucccagcccuacuguggaagaguccaggaccauucgcguucucaagaugguagagccaugguuaaagaacaaucaguucuguaucaaagugcugaaccccuacaugccuacagucauagaacaccuugagcggcugcaacgaaagcacggcgggaugcuagugagaaauccacucucaaggaacucuacccaugaaauguauuggauuaguaauggaacuggcaacaucguugccucggugaauauggucagccgccuguugcugaaccgguuuacgaugacacacagacgucccaccaucgagaaagacguggaucucggugcagggacuaggcauguaaacgccgaaccggagaccccuaauauggacgugauuggagagcggauaaagcgcaucaaagaagagcacaacuccacauggcacuacgacgaugaaaauccauauaagacgugggcuuaccauggcucuuaugagguuaaggcgaccggcucagccagcuccaugauuaacggggucgugaaacuucugacuaagcccugggacguggucccuaugguuacacagauggcaaugaccgauacuacaccauucggacagcaacgaguguuuaaagaaaagguagacaccagaacacccaggaguaugccggguacucggcgcgugaugggcaucaccgcugagugguuauggagaacgcuggggaggaauaaaaagccucgauugugcacccgggaggaauucacaaagaaaguccguacuaacgccgcaaugggagccguguuuaccgaggaaaaucagugggauucugcuaaggccgcgguugaggacgaagauuucuggauucucguggacagagagcgcgagcugcacaaacuaggcaagugugguagcugcgucuacaacaugauggggaaaagggaaaagaaacuuggagaguuuggcaaggcaaagggcucacgggccaucugguacauguggcugggggcuagauaucucgaauucgaggcccugggauuuuugaaugaggaucauugguucucccgcgaaaacaguuacagcgguguggagggcgaagggcugcacaaacucggauauauacuuagggacaucucuaagauucccggcggugcaauguacgcugaugacacagccgggugggacacucgaaucaccgaggaugaccugcauaaugaagagaaaauuacgcagcagauggauccagagcaccggcaauuagcuaacgccaucuuuaagcugacauaucagaauaaaguaguuaaggugcagagaccuacccccacuggaacagucauggacauaauuuccaggaaggaucagcgcggcucaggccaaguggggaccuacggauugaacacuuucaccaauauggaagcacagcucauccgucagauggagggugaaggcgugcugagcaaagcggaccuagagaacccacaccuucccgaaaagaaaaucacacaguggcuggagacgaagggggucgagcggcucaaaagaauggccauuucgggagaugacugcguugugaagccuauagaugacagguuugcuaacgcccuguuggcauuaaaugauaugggcaagguacgcaaagacaucccacaauggcagccgucuaaggguuggcaugauuggcagcaggugcccuucuguagucaccauuuccacgaacugauuaugaaagacgggcgaaagcucgucgugccuugccggccacaagacgagcuuaucggaagagcuaggauuucccagggcgccggcuggagccugcgcgaaaccgcaugucuagggaaagccuaugcgcagauguggucacugauguacuuucacagacgggaucucagguuggcuuccaacgccaucugcucugcaguucccgugcauugggucccuacuagccguacaaccuggaguauacacgcccaucaccaauggaugacuacagaggacaugcugaccguguggaaucgaguauggaucgaagauaacccauggauggaggacaagacgcccguuacaaccugggagaaugugccuuaccuuggaaagcgcgaagaucaguggugugguucccugauuggccucacuagcagagcuaccugggcccagaacaucccgacagcaauucagcaaguccggucuuuaaucgggaaugaggaauuccuggacuauaugccaucaaugaaaagguuucgcaaggaggaggaaagugagggagcuauuugguga

SEQ ID NO: 15457 - RNA, 9873 nt, Artificial Sequence
  derived and/or modified CDS sequence (opt3) from DENV-3__FJ547073__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauuguuauaggaaucauuacccuguauuuaggcgcggucgugcaggcugacauggguugugugaucaauuggaaagggaaggagcugaagugcggauccggcauuuucgucacuaacgagguucauacauggaccgaacaguacaaauuucaagccgauucucccaagcggcuagcaacugccaucgcuggugccugggagaauggcgugugugggauacgaagcaccacacgcauggaaaaccuccuguggaaacagaucgcaaaugagcuuaacuauauuuugugggaaaauaacaucaagcugacggugguagucggagacauuaucggcgugcucgagcaggggaaaagaacccugacuccacagccuauggaguuaaaguacucauggaaaacauggggaaaggcuaagauaguuaccgccgaaacacaaaacaguuccuucauuaucgauggccccaauacuccagagugccccagcgcgucuagggccuggaacgugugggaagucgaggacuaugguuuugggguguucaccacgaauauuuggcugaaacuucgggaaguuuacacacaguugugugaccaccgccucaugucagcugcagugaaggaugagagagccguacacgcugacaugggauacuggaucgagagucagaaaaacggcagcuggaagcuggaaaaagccucccuaauagaggucaagaccugcacuuggccuaagucucauacccuguggucgaauggugugcucgaaagcgauaugaucauuccaaaaucccuggcaggcccgaucucacagcacaacuauaggcccggguaccauacacaaacugcgggaccuuggcaccuuggcaaguuggagcuggacuuuaauuauugcgaggggaccacaguggucauuacggaaaacuguggaacccguggcccaaguuuacggacuacaaccguuucugguaaacucauccacgaguggugcugucgaagcugcacucugcccccucuuagauacaugggggaagauggauguugguauggcauggagauaaggccaauuuccgaaaaggaggagaauauggugaaaucacugguaagcgccgguucuggcaagguggacaacuucacaaugggggucuugugccucgcuauccuguuugaagaggugaugcgcggaaaguucggcaaaaagcauaugaucgccgggguuuucuuuaccuucgugcuacugcucuccggacagauuacguggcgggauauggcacacacucugaucaugauuggcaguaaugcuagcgacagaauggguaugggggucaccuaccuugccuugauagcaacauuuaaaauccagcccuuccuggccuuaggauuuuuccucaggaagcugaccucucgcgaaaaccuucugcuaggcgugggccucgcuauggcgacuacacugcaauugccggaggauauugaacagauggccaaugggaucgcacugggauuaauggcucucaaacugauuacccaguuugagacauaucagcuuuggacugcccugaucuccuugaccuguucaaacacgauauucacacucaccguugccuggcgaacugcuacccugauccuagcaggugugagucugcuuccugucugccaaagcucguccaugcggaagacagacuggcucccaaugacuguagccgcgaugggcgugcccccucugcccuuguuuauuuucucucugaaggauaccuuaaaacguagaagcuggccacucaaugaggggguuauggcugugggacuggucucaauccuugccaguucccuguugaggaacgacgugccuauggcaggcccccucguagccggugggcugcuaauugcuuguuacgugaucacgggaacaucugcagaucugaccgucgaaaaggccgcggacguuacuugggaggaagaggcugaacagacaggcgugagccauaaccuuaugauaaccguggacgaugacggcacuaugcgcauuaaagaugacgagacagagaauauccucaccguccuguugaagacggccuuacugaucguguccgggauuuuuccauacucaauaccggcaacucuccugguuuggcacaccuggcagaaacagacacaacggagcggaguacuuugggaugugccuagucccccagaaacccagaaggccgagcuggaagagggugucuauagaaucaaacagcagggcauuuucgggaagacacaagugggaguuggcgugcagaaggagggugucuuucauacuauguggcacgugaccaggggggcuguauugacguacaacggaaaacgacuagaacccaauugggccucugucaagaaagaccugaucuccuauggcggcggguggcgccucagcgcacaguggcaaaagggagaggaagugcagguuauugcuguggagccugguaaaaacccaaagaauuuccagacaaugcccggcacuuuccagaccacaaccggggaaaucggagccauagcgcuggauuuuaagccuggcacuucggguucaccgaucauuaaccgggaggggaaagucgugggacuuuacggcaauggcguugugaccaagaacgggggauaugucucugguaucgcccaaacaaaugcagagccagacggccccacgccugaauuagaggaagagauguucaaaaagagaaaccugacuauuauggaucuccacccagggaguggaaaaaccaggaaguacuugcccgcuaucgugcgugaagccauaaagcgccggcugagaacacucauucuggcuccuaccaggguaguggcagccgagauggaggaagcccuuaaaggccugccgauccgauaucagacuacagcuaccaaguccgagcauacgggucgggaaaucguugacuugaugugccacgcgacuuuuacaaugcgccuacugagccccgucagagugccaaauuacaaccucauuaucauggaugaggcacauuucaccgacccugccucuauagcugccaggggguacauuagcacccgggugggaaugggcgaagcagccgcuaucuuuaugacugcgacacccccaggcaccgccgaugcauucccucaguccaaugcucccauucaggacgaggagcgagacaucccagaaagaucauggaacagugggaaugaguggauaacagauuuugccggaaaaacugucugguucguaccgagcauuaaggcagguaacgacaucgccaacuguuuacgcaaaaauggcaagaaggugauccaacugucuaggaaaacguuugauaccgaauaucagaagacaaaacuuaacgacugggauuucguugugacuaccgacauuuccgagaugggggcuaauuuuaaggccgaucgugucaucgacccucggagaugccugaaacccgugauucucacagauggaccagagaggguuauauuggcgggccccaugccugugaccgcagccucagcugcccagcgccgagguagagucgggcggaacccacagaaggaaaaugaccaauacaucuucacuggccagccccugaacaaugaugaggaccacgcucauuggacggaagcaaagaugcuccuggacaacauuaauaccccugagggaaucaucccggcccuuuucgaaccagagagggagaaaagugcugccauugauggcgaauaucgccuaaagggggagagccguaaaacauuuguggaacugaugagacggggagacuugcccguaugguuagcacacaagguggcguccgaggguauaaaauacacugauaggaaguggugcuucgacggccagcgcaacaaucagauccuggaagagaacauggauguugagauuuggaccaaagaaggggagaagaagaaacuccgaccuagauggcuggacgcccggacauauucugauccccuugcucugaaggaauuuaaagacuucgccgcaggaaggaagucgaucgcucucgauuuggucaccgagauuggccgcgugccaagccaccuggcccauagaacuaggaaugcacuagacaaccuggugaugcuccacacaucagaacauggugggaaagccuaccgguaugcugucgaggagcuuccugaaacgauggagacccuguuauugcugggccucaugauccugcuuacuggaggcgcgaugcuguuucucauauccgggaagggaaucgguaagacaaguauuggcuugaucuguguuauugccucuagcgggaugcuguggauggcagaaauccccuuacaauggauagcuuccgccauugugcuagaguucuuuaugaugguacugcucaucccagagccugaaaaacagcguaccccgcaggauaaucaacuugccuacguggucauuggaauccugaccuuggcagcuauaaucgccgcgaacgagaugggccugcucgaaacaacuaagcgcgaccuggguaugucaaaagagcccggggugguuucuccaacgagcuaccuugauguggaccuccacccugcuagugccuggacccuguaugcagucgccacaacuguaauuacccccauguugcgacacacaaucgaaaauuccaccgcuaacgugagccuggcagccauugcgaaccaggcuguuguguuaaugggccuagacaagggauggccaaucucuaaaauggaucugggcgucccucuccuugcccuggggugcuacucacaggugaaucccuugacucugacggcagccguccuccugcuuauaacacauuaugcuauuaucggaccgggcuuacaggccaaggcaaccagagaggcucaaaagaggacugccgcggguaucaugaaaaacccaaccguggacgggauuaugacaaucgaucuggacccuguuauauacgauuccaaguucgagaaacagcucggacaggugauguugcugguacuaugugccgugcagcugcuccuuaugcggacuaguugggcacugugcgaagcuuugacccuggccacaggccccauuacgacccucugggaggguagcccaggcaaguuuuggaauacuacaaucgcagucucgauggcuaacauuuuccgcgggucuuaucuggccggagccggcuuagcguuuuccaucaugaaaagcguugggaccggaaagagaggcacugguucacaaggggaaacacuuggagagaaguggaaaaagaaacugaaucagcucaguaggaaggaauucgaccuauacaaaaagucuggcauaaccgagguggaucggacggaggcuaaagaaggucugaagcgaggcgagaucacccaccaugcagucuccagagggagcgccaaguugcagugguuuguggaacgcaacaugguaauucccgagggaagggugaucgaccugggcugugggcggggaggcuggucauauuacugcgcuggucucaaaaagguuacagaagugcguggguacacuaaaggaggcccuggccacgaggagccgguccccaugaguaccuauggguggaauauugugaagcuuaugagcggaaaagaugucuucuaccugccaccugaaaagugugacacauugcugugcgauaucggugaguccucucccagcccuacuguggaagaguccagaaccauuaggguucucaagaugguagagccaugguuaaaaaacaaucaguucuguaucaaggugcugaaccccuauaugccuacagucauagaacaucuugagcgccugcaacggaaacacggcgggaugcuagugcgaaauccacucucaagaaacucuacccacgaaauguacuggauuaguaauggaacuggcaacaucguugccucggugaauauggucagcaggcuguugcugaaccgcuuuacgaugacacaucggagacccaccaucgagaaggacguggaucucggugcagggacucgucacguaaacgccgaaccggagaccccuaauauggacgugauuggagagaggauaaaacggaucaaggaagagcauaacuccacauggcacuaugacgaugaaaauccauacaagacgugggcuuaucacggcucuuacgagguuaaagcgaccggcucagccagcuccaugauuaacggggucgugaagcuucugacuaaacccugggacguggucccuaugguuacacagauggcaaugaccgauacuacaccauucggacagcaacgcguguuuaaggaaaaaguagacacccgaacacccagaaguaugccggguacuaggcgggugaugggcaucaccgcugagugguuauggcgcacgcuggggagaaauaagaagccuagguugugcacccgagaggaauucacaaaaaagguccggacuaacgccgcaaugggagccguguuuaccgaggaaaaucagugggauucugcuaaagccgcgguugaggacgaagauuucuggauucucguggaccgugagagagagcugcauaagcuaggcaaaugugguagcugcgucuacaacaugauggggaagcgcgaaaaaaagcuuggagaguuuggcaaggcaaaaggcucaagggccaucugguauauguggcugggggcucgguaccucgaauucgaggcccugggauuuuugaaugaggaucacugguucuccagagaaaacaguuauagcgguguggagggcgaagggcugcauaagcucggauacauacuucgcgacaucucuaaaauucccggcggugcaauguaugcugaugacacagccgggugggacacuaggaucaccgaggaugaccugcacaaugaagagaagauuacgcagcagauggauccagagcaucgacaauuagcuaacgccaucuuuaaacugacauaccagaauaagguaguuaaggugcagcggccuacccccacuggaacagucauggacauaauuuccagaaaagaucagaggggcucaggccaaguggggaccuauggauugaacacuuucaccaauauggaagcacagcucauccgccagauggagggugaaggcgugcugagcaaggcggaccuagagaacccacaccuucccgaaaaaaagaucacacaguggcuggagacgaaaggggucgagcgucucaagcggauggccauuucgggagaugacugcguugugaagccuauagaugacagauuugcuaacgcccuguuggcauuaaaugauaugggcaaaguaaggaaggacaucccacaauggcagccgucuaaagguuggcacgauuggcagcaggugcccuucuguagucaucacuuccaugaacugauuaugaaggacgggcgcaaacucgucgugccuugccgaccacaagacgagcuuaucggacgggcuagaauuucccagggcgccggcuggagccugagggaaaccgcaugucuagggaaggccuacgcgcagauguggucacugauguacuuucaccgcagagaucuccgguuggcuuccaacgccaucugcucugcaguucccgugcacugggucccuacuagcaggacaaccuggaguauacaugcccaccaucaauggaugacuacagaggacaugcugaccguguggaaucguguauggaucgaagauaacccauggauggaggacaagacgcccguuacaaccugggagaaugugccuuaucuuggaaaacgagaagaucaguggugugguucccugauuggccucacuagccgcgcuaccugggcccagaacaucccgacagcaauucagcaagucagaucuuuaaucgggaaugaggaauuccuggacuacaugccaucaaugaagcgguuuaggaaagaggaggaaagugagggagcuauuugguga

SEQ ID NO: 15458 - RNA, 9873 nt, Artificial Sequence
  derived and/or modified CDS sequence (opt3) from DENV-3__FJ547074__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauuguuauaggaaucauuacccuguauuuaggcgcggucgugcaggcugacauggguugugugaucaauuggaaagggaaggagcugaagugcggauccggcauuuucgucacuaacgagguucauacauggaccgaacaguacaaauuucaagccgauucucccaagcggcuagcaacugccaucgcuggugccugggagaauggcgugugugggauacgaagcaccacacgcauggaaaaccuccuguggaaacagaucgcaaaugagcuuaacuauauuuugugggaaaauaacaucaagcugacggugguagucggagacauuaucggcgugcucgagcaggggaaaagaacccugacuccacagccuauggaguuaaaguacucauggaaaacauggggaaaggcuaagauaguuaccgccgaaacacaaaacaguuccuucauuaucgauggccccaauacuccagagugccccagcgcgucuagggccuggaacgugugggaagucgaggacuaugguuuugggguguucaccacgaauauuuggcugaaacuucgggaaguuuacacacaguugugugaccaccgccucaugucagcugcagugaaggaugagagagccguacacgcugacaugggauacuggaucgagagucagaaaaacggcagcuggaagcuggaaaaagccucccuaauagaggucaagaccugcacuuggccuaagucucauacccuguggucgaauggugugcucgaaagcgauaugaucauuccaaaaucccuggcaggcccgaucucacagcacaacuauaggcccggguaccauacacaaacugcgggaccuuggcaccuuggcaaguuggagcuggacuuuaauuauugcgaggggaccacaguggucauuacggaaaacuguggaacccguggcccaaguuuacggacuacaaccguuucugguaaacucauccacgaguggugcugucgaagcugcacucugcccccucuuagauacaugggggaagauggauguugguauggcauggagauaaggccaauuuccgaaaaggaggagaauauggugaaaucacugguaagcgccgguucuggcaagguggacaacuucacaaugggggucuugugccucgcuauccuguuugaagaggugaugcgcggaaaguucggcaaaaagcauaugaucgccgggguuuucuuuaccuucgugcuacugcucuccggacagauuacguggcgggauauggcacacacucugaucaugauuggcaguaaugcuagcgacagaauggguaugggggucaccuaccuugccuugauagcaacauuuaaaauccagcccuuccuggccuuaggauuuuuccucaggaagcugaccucucgcgaaaaccuucugcuaggcgugggccucgcuauggcgacuacacugcaauugccggaggauauugaacagauggccaaugggaucgcacugggauuaauggcucucaaacugauuacccaguuugagacauaucagcuuuggacugcccugaucuccuugaccuguucaaacacgauauucacacucaccguugccuggcgaacugcuacccugauccuagcaggugugagucugcuuccugucugccaaagcucguccaugcggaagacagacuggcucccaaugacuguagccgcgaugggcgugcccccucugcccuuguuuauuuucucucugaaggauaccuuaaaacguagaagcuggccacucaaugaggggguuauggcugugggacuggucucaauccuugccaguucccuguugaggaacgacgugccuauggcaggcccccucguagccggugggcugcuaauugcuuguuacgugaucacgggaacaucugcagaucugaccgucgaaaaggccgcggacguuacuugggaggaagaggcugaacagacaggcgugagccauaaccuuaugauaaccguggacgaugacggcacuaugcgcauuaaagaugacgagacagagaauauccucaccguccuguugaagacggccuuacugaucguguccgggauuuuuccauacucaauaccggcaacucuccugguuuggcacaccuggcagaaacagacacaacggagcggaguacuuugggaugugccuagucccccagaaacccagaaggccgagcuggaagagggugucuauagaaucaaacagcagggcauuuucgggaagacacaagugggaguuggcgugcagaaggagggugucuuucauacuauguggcacgugaccaggggggcuguauugacguacaacggaaaacgacuagaacccaauugggccucugucaagaaagaccugaucuccuauggcggcggguggcgccucagcgcacaguggcaaaagggagaggaagugcagguuauugcuguggagccugguaaaaacccaaagaauuuccagacaaugcccggcacuuuccagaccacaaccggggaaaucggagccauagcgcuggauuuuaagccuggcacuucggguucaccgaucauuaaccgggaggggaaagucgugggacuuuacggcaauggcguugugaccaagaacgggggauaugucucugguaucgcccaaacaaaugcagagccagacggccccacgccugaauuagaggaagagauguucaaaaagagaaaccugacuauuauggaucuccacccagggaguggaaaaaccaggaaguacuugcccgcuaucgugcgugaagccauaaagcgccggcugagaacacucauucuggcuccuaccaggguaguggcagccgagauggaggaagcccuuaaaggccugccgauccgauaucagacuacagcuaccaaguccgagcauacgggucgggaaaucguugacuugaugugccacgcgacuuuuacaaugcgccuacugagccccgucagagugccaaauuacaaccucauuaucauggaugaggcacauuucaccgacccugccucuauagcugccaggggguacauuagcacccgggugggaaugggcgaagcagccgcuaucuuuaugacugcgacacccccaggcaccgccgaugcauucccucaguccaaugcucccauucaggacgaggagcgagacaucccagaaagaucauggaacagugggaaugaguggauaacagauuuugccggaaaaacugucugguucguaccgagcauuaaggcagguaacgacaucgccaacuguuuacgcaaaaauggcaagaaggugauccaacugucuaggaaaacguuugauaccgaauaucagaagacaaaacuuaacgacugggauuucguugugacuaccgacauuuccgagaugggggcuaauuuuaaggccgaucgugucaucgacccucggagaugccugaaacccgugauucucacagauggaccagagaggguuauauuggcgggccccaugccugugaccgcagccucagcugcccagcgccgagguagagucgggcggaacccacagaaggaaaaugaccaauacaucuucacuggccagccccugaacaaugaugaggaccacgcucauuggacggaagcaaagaugcuccuggacaacauuaauaccccugagggaaucaucccggcccuuuucgaaccagagagggagaaaagugcugccauugauggcgaauaucgccuaaagggggagagccguaaaacauuuguggaacugaugagacggggagacuugcccguaugguuagcacacaagguggcguccgaggguauaaaauacacugauaggaaguggugcuucgacggccagcgcaacaaucagauccuggaagagaacauggauguugagauuuggaccaaagaaggggagaagaagaaacuccgaccuagauggcuggacgcccggacauauucugauccccuugcucugaaggaauuuaaagacuucgccgcaggaaggaagucgaucgcucucgauuuggucaccgagauuggccgcgugccaagccaccuggcccauagaacuaggaaugcacuagacaaccuggugaugcuccacacaucagaacauggugggaaagccuaccggcacgcugucgaggagcuuccugaaacgauggagacccuguuauugcugggccucaugauccugcuuacuggaggcgcgaugcuguuucucauauccgggaagggaaucgguaagacaaguauuggcuugaucuguguuauugccucuagcgggaugcuguggauggcagaaauccccuuacaauggauagcuuccgccauugugcuagaguucuuuaugaugguacugcucaucccagagccugaaaaacagcguaccccgcaggauaaucaacuugccuauguggucauuggaauccugaccuuggcagcuauaaucgccgcgaacgagaugggccugcucgaaacaacuaagcgcgaccuggguaugucaaaagagcccggggugguuucuccaacgagcuaccuugauguggaccuccacccugcuagugccuggacccuguacgcagucgccacaacuguaauuacccccauguugcgacauacaaucgaaaauuccaccgcuaacgugagccuggcagccauugcgaaccaggcuguuguguuaaugggccuagacaagggauggccaaucucuaaaauggaucugggcgucccucuccuugcccuggggugcuauucacaggugaaucccuugacucugacggcagccguccuccugcuuauaacacacuacgcuauuaucggaccgggcuuacaggccaaggcaaccagagaggcucaaaagaggacugccgcggguaucaugaaaaacccaaccguggacgggauuaugacaaucgaucuggacccuguuauauaugauuccaaguucgagaaacagcucggacaggugauguugcugguacuaugugccgugcagcugcuccuuaugcggacuaguugggcacugugcgaagcuuugacccuggccacaggccccauuacgacccucugggaggguagcccaggcaaguuuuggaauacuacaaucgcagucucgauggcuaacauuuuccgcgggucuuaccuggccggagccggcuuagcguuuuccaucaugaaaagcguugggaccggaaagagaggcacugguucacaaggggaaacacuuggagagaaguggaaaaagaaacugaaucagcucaguaggaaggaauucgaccuauauaaaaagucuggcauaaccgagguggaucggacggaggcuaaagaaggucugaagcgaggcgagaucacccaucacgcagucuccagagggagcgccaaguugcagugguuuguggaacgcaacaugguaauucccgagggaagggugaucgaccugggcugugggcggggaggcuggucauacuauugcgcuggucucaaaaagguuacagaagugcguggguacacuaaaggaggcccuggccaugaggagccgguccccaugaguaccuacggguggaauauugugaagcuuaugagcggaaaagaugucuucuaucugccaccugaaaagugugacacauugcugugcgauaucggugaguccucucccagcccuacuguggaagaguccagaaccauuaggguucucaagaugguagagccaugguuaaaaaacaaucaguucuguaucaaggugcugaaccccuacaugccuacagucauagaacaccuugagcgccugcaacggaaacacggcgggaugcuagugcgaaauccacucucaagaaacucuacccaugaaauguauuggauuaguaauggaacuggcaacaucguugccucggugaauauggucagcaggcuguugcugaaccgcuuuacgaugacauaccggagacccaccaucgagaaggacgugguacucggugcagggacucgucacgugaacgccgaaccggagaccccuaauauggauguuauuggagagaggauaaaacggaucaaggaagagcauaacuccacauggcacuaugacgacgaaaauccauacaagacgugggcuuaucacggcucuuacgaggucaaagcgaccggcucagccagcuccaugauuaacgggguggugaagcuucugacuaaacccugggaugucguuccuauggugacacagauggcaaugaccgacacuacaccauucggacagcaacgcguauuuaaggaaaaaguggauacccgaacacccagaaguaugccggguacuaggcgggucaugggcaucaccgcugagugguuauggcgcacgcuggggagaaauaagaagccuagguugugcacccgagaggaauucacaaaaaaggugcggacuaacgccgcaaugggagccguuuuuaccgaggaaaaucagugggacucugcuaaagccgcgguggaggaugaagacuucuggauucucgucgaucgugagagagagcugcauaagcuaggcaaaugugguagcugcguguacaacaugauggggaagcgcgaaaaaaagcuuggagaguuuggcaaggcaaaaggcucaagggccaucugguauauguggcugggggcucgguaccucgaauucgaggcccugggauuuuugaaugaggaccacugguucuccagagaaaacaguuauagcgguguagagggcgaagggcugcauaagcucggauacauacuucgcgauaucucuaaaauucccggcggugcaauguaugcugacgauacagccgggugggacacuaggaucaccgaggacgaucugcacaaugaagagaagauuacgcagcagauggacccagagcaucgacaauuagcuaacgccaucuuuaaacugacauaccagaauaagguugugaagguccagcggccuacccccacuggaacagugauggauauaauuuccagaaaagaccagaggggcucaggccaaguggggaccuauggauugaacacuuucaccaauauggaagcacagcucauccgccagauggagggugaaggcguccugagcaaggcggaucuagagaacccacaccuucccgaaaaaaagaucacacaguggcuggagacgaaagggguugagcgucucaagcggauggccauuucgggagacgauugcgugguaaagccuauagacgauagauuugcuaacgcccuguuggcauuaaaugacaugggcaaagugaggaaggauaucccacaauggcagccgucuaaagguuggcacgacuggcagcagguccccuucuguagucaucacuuccaugaacugauuaugaaggaugggcgcaaacucgugguuccuugccgaccacaagacgagcuuaucggacgggcuagaauuucccagggcgccggcuggagccugagggaaaccgcaugucuagggaaggccuacgcgcagauguggucacugauguacuuucaccgcagagaccuccgguuggcuuccaacgccaucugcucugcagugcccguccacugggugccuacuagcaggacaaccuggaguauacaugcccaccaucaauggaugacuacagaggauaugcugaccguauggaaucguguuuggaucgaagacaacccauggauggaggauaagacgcccgugacaaccugggagaaugucccuuaucuuggaaaacgagaagaccaguggugugguucccugauuggccucacuagccgcgcuaccugggcccagaacaucccgacagcaauucagcaagugagaucuuuaaucgggaaugaggaauuccuggauuacaugccaucaaugaagcgguuuaggaaagaggaggaaagugagggagcuauuugguga

SEQ ID NO: 15459 - RNA, 9873 nt, Artificial Sequence
  derived and/or modified CDS sequence (opt3) from DENV-3__FJ547075__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauuguuauaggaaucauuacccuguauuuaggcgcggucgugcaggcugacauggguugugugaucaauuggaaagggaaggagcugaagugcggauccggcauuuucgucacuaacgagguucauacauggaccgaacaguacaaauuucaagccgauucucccaagcggcuagcaacugccaucgcuggugccugggagaauggcgugugugggauacgaagcaccacacgcauggaaaaccuccuguggaaacagaucgcaaaugagcuuaacuauauuuugugggaaaauaacaucaagcugacggugguagucggagacauuaucggcgugcucgagcaggggaaaagaacccugacuccacagccuauggaguuaaaguacucauggaaaacauggggaaaggcuaagauaguuaccgccgaaacacaaaacaguuccuucauuaucgauggccccaauacuccagagugccccagcgcgucuagggccuggaacgugugggaagucgaggacuaugguuuugggguguucaccacgaauauuuggcugaaacuucgggaaguuuacacacaguugugugaccaccgccucaugucagcugcagugaaggaugagagagccguacacgcugacaugggauacuggaucgagagucagaaaaacggcagcuggaagcuggaaaaagccucccuaauagaggucaagaccugcacuuggccuaagucucauacccuguggucgaauggugugcucgaaagcgauaugaucauuccaaaaucccuggcaggcccgaucucacagcacaacuauaggcccggguaccauacacaaacugcgggaccuuggcaccuuggcaaguuggagcuggacuuuaauuauugcgaggggaccacaguggucauuacggaaaacuguggaacccguggcccaaguuuacggacuacaaccguuucugguaaacucauccacgaguggugcugucgaagcugcacucugcccccucuuagauacaugggggaagauggauguugguauggcauggagauaaggccaauuuccgaaaaggaggagaauauggugaaaucacugguaagcgccgguucuggcaagguggacaacuucacaaugggggucuugugccucgcuauccuguuugaagaggugaugcgcggaaaguucggcaaaaagcauaugaucgccgggguuuucuuuaccuucgugcuacugcucuccggacagauuacguggcgggauauggcacacacucugaucaugauuggcaguaaugcuagcgacagaauggguaugggggucaccuaccuugccuugauagcaacauuuaaaauccagcccuuccuggccuuaggauuuuuccucaggaagcugaccucucgcgaaaaccuucugcuaggcgugggccucgcuauggcgacuacacugcaauugccggaggauauugaacagauggccaaugggaucgcacugggauuaauggcucucaaacugauuacccaguuugagacauaucagcuuuggacugcccugaucuccuugaccuguucaaacacgauauucacacucaccguugccuggcgaacugcuacccugauccuagcaggugugagucugcuuccugucugccaaagcucguccaugcggaagacagacuggcucccaaugacuguagccgcgaugggcgugcccccucugcccuuguuuauuuucucucugaaggauaccuuaaaacguagaagcuggccacucaaugaggggguuauggcugugggacuggucucaauccuugccaguucccuguugaggaacgacgugccuauggcaggcccccucguagccggugggcugcuaauugcuuguuacgugaucacgggaacaucugcagaucugaccgucgaaaaggccgcggacguuacuugggaggaagaggcugaacagacaggcgugagccauaaccuuaugauaaccguggacgaugacggcacuaugcgcauuaaagaugacgagacagagaauauccucaccguccuguugaagacggccuuacugaucguguccgggauuuuuccauacucaauaccggcaacucuccugguuuggcacaccuggcagaaacagacacaacggagcggaguacuuugggaugugccuagucccccagaaacccagaaggccgagcuggaagagggugucuauagaaucaaacagcagggcauuuucgggaagacacaagugggaguuggcgugcagaaggagggugucuuucauacuauguggcacgugaccaggggggcuguauugacguacaacggaaaacgacuagaacccaauugggccucugucaagaaagaccugaucuccuauggcggcggguggcgccucagcgcacaguggcaaaagggagaggaagugcagguuauugcuguggagccugguaaaaacccaaagaauuuccagacaaugcccggcacuuuccagaccacaaccggggaaaucggagccauagcgcuggauuuuaagccuggcacuucggguucaccgaucauuaaccgggaggggaaagucgugggacuuuacggcaauggcguugugaccaagaacgggggauaugucucugguaucgcccaaacaaaugcagagagugacggcccaacgcccgaauuagaggaagagauguucaaaaagagaaaccugacuauuauggaucuccacccuggguccggaaaaaccaggaaguacuugccagcuaucgugcgugaagccauaaagcgccggcugagaacacucauucuggcucccaccaggguaguggcagccgagauggaggaagcccuuaaaggccugccuauccgauaucagacuacagcuaccaagagcgagcauacgggucgggaaaucguugacuugaugugccacgcgacuuuuacaaugcgccuacugucuccggucagagugcccaauuacaaccucauuaucauggaugaggcacauuucaccgacccagccagcauagcugccaggggguacauuuccacccgggugggaaugggcgaagcagccgcuaucuuuaugacugcgacaccucccggcaccgccgaugcauucccacagucaaaugcuccuauucaggacgaggagcgagacauccccgaaagaaguuggaacagcgggaaugaguggauaacagauuuugccggaaaaacugucugguucguaccaucuauuaaggcagguaacgacaucgccaacuguuuacgcaaaaauggcaagaaggugauccaacuguccaggaaaacguuugauaccgaauaucagaagacaaaacuuaacgacugggauuucguugugacuaccgacauuucagagaugggggcuaauuuuaaggccgaucgugucaucgacccgcggagaugccugaaaccugugauucucacagauggacccgagaggguuauauuggcgggcccaaugcccgugaccgcagccagugcugcccagcgccgagguagagucgggcggaacccucagaaggaaaaugaccaauacaucuucacuggccagccacugaacaaugaugaggaccacgcucauuggacggaagcaaagaugcuccuggacaacauuaauacccccgagggaaucaucccugcccuuuucgaaccggagagggagaaaagcgcugccauugauggcgaauaucgccuaaagggggagucccguaaaacauuuguggaacugaugagacggggagacuugccaguaugguuagcacacaagguggcgucugaggguauaaaauacacugauaggaaguggugcuucgacggccagcgcaacaaucagauccuggaagagaacauggauguugagauuuggaccaaagaaggggagaagaagaaacuccgacccagauggcuggacgcccggacauauucggauccucuugcucugaaggaauuuaaagacuucgccgcaggaaggaagagcaucgcucucgauuuggucaccgagauuggccgcgugcccucacaccuggcccauagaacuaggaaugcacuagacaaccuggugaugcuccacacauccgaacauggugggaaagccuaccggcacgcugucgaggagcuuccagaaacgauggagacccuguuauugcugggccucaugauccugcuuacuggaggcgcgaugcuguuucucauaagugggaagggaaucgguaagacaucuauuggcuugaucuguguuauugccagcuccgggaugcuguggauggcagaaaucccuuuacaauggauagcuucagccauugugcuagaguucuuuaugaugguacugcucauccccgagccagaaaaacagcguaccccucaggauaaucaacuugccuauguggucauuggaauccugaccuuggcagcuauaaucgccgcgaacgagaugggccugcucgaaacaacuaagcgcgaccuggguaugucuaaagagccgggggugguuagccccacgaguuaccuugauguggaccuccacccagcuuccgccuggacccuguacgcagucgccacaacuguaauuaccccuauguugcgacauacaaucgaaaauagcaccgcuaacgugucucuggcagccauugcgaaccaggcuguuguguuaaugggccuagacaagggauggcccaucucaaaaauggaucugggcgucccacuccuugcccuggggugcuauucccaggugaauccuuugacucugacggcagccguccuccugcuuauaacacacuacgcuauuaucggacccggcuuacaggccaaggcaaccagagaggcucaaaagaggacugccgcggguaucaugaaaaacccgaccguggacgggauuaugacaaucgaucuggacccaguuauauaugauaguaaguucgagaaacagcucggacaggugauguugcugguacuaugugccgugcagcugcuccuuaugcggacuagcugggcacugugcgaagcuuugacccuggccacaggcccuauuacgacccucugggaggguucgcccggcaaguuuuggaauacuacaaucgcagucucuauggcuaacauuuuccgcggguccuaccuggccggagccggcuuagcguuuagcaucaugaaaucaguugggaccggaaagagaggcacugguagucaaggggaaacacuuggagagaaguggaaaaagaaacugaaucagcucucuaggaaggaauucgaccuauauaaaaaguccggcauaaccgagguggaucggacggaggcuaaagaaggucugaagcgaggcgagaucacccaucacgcagucagcagagggucagccaaguugcagugguuuguggaacgcaacaugguaauuccagagggaagggugaucgaccugggcugugggcggggaggcuggaguuacuauugcgcuggucucaaaaagguuacagaagugcguggguacacuaaaggaggccccggccaugaggagccugucccgaugagcaccuacggguggaauauugugaagcuuauguccggaaaagaugucuucuaucugcccccagaaaagugugacacauugcugugcgauaucggugagucuagcccuucccccacuguggaagagucaagaaccauuaggguucucaagaugguagagccuugguuaaaaaacaaucaguucuguaucaaggugcugaacccauacaugcccacagucauagaacaccuugagcgccugcaacggaaacacggcgggaugcuagugcgaaauccucucucuagaaacaguacccaugaaauguauuggauuucgaauggaacuggcaacaucguugccagcgugaauauggucuccaggcuguugcugaaccgcuuuacgaugacacaccggagaccaaccaucgagaaggacguggaucucggugcagggacucgucauguaaacgccgaacccgagaccccgaauauggacgugauuggagagaggauaaaacggaucaaggaagagcacaacucuacauggcacuacgacgaugaaaauccuuauaagacgugggcuuaccauggcucauaugagguuaaagcgaccggcagcgccuccaguaugauuaacggggucgugaagcuucugacuaaaccaugggacgugguccccaugguuacacagauggcaaugaccgauacuacaccuuucggacagcaacgcguguuuaaggaaaaaguagacacccgaacaccaagaucuaugcccgguacuaggcgggugaugggcaucaccgcugagugguuauggcgcacgcuggggagaaauaagaagccgagguugugcacccgagaggaauucacaaaaaagguccggacuaacgccgcaaugggagccguguuuaccgaggaaaaucagugggauagcgcuaaagccgcgguugaggacgaagauuucuggauucucguggaccgugagagagagcugcacaagcuaggcaaaugugguucaugcgucuacaacaugauggggaagcgcgaaaaaaagcuuggagaguuuggcaaggcaaaaggcuccagggccaucugguacauguggcugggggcucgguaucucgaauucgaggcccugggauuuuugaaugaggaucauugguucaguagagaaaacagcuacucugguguggagggcgaagggcugcacaagcucggauauauacuucgcgacaucuccaaaauuccuggcggugcaauguacgcugaugacacagccgggugggacacuaggaucaccgaggaugaccugcauaaugaagagaagauuacgcagcagauggaucccgagcaccgacaauuagcuaacgccaucuuuaaacugacauaucagaauaagguaguuaaggugcagcggccaaccccuacuggaacagucauggacauaauuucaagaaaagaucagaggggcagcggccaaguggggaccuacggauugaacacuuucaccaauauggaagcacagcucauccgccagauggagggugaaggcgugcugucgaaggcggaccuagagaacccccaccuuccagaaaaaaagaucacacaguggcuggagacgaaaggggucgagcgucucaagcggauggccauuucuggagaugacugcguugugaagcccauagaugacagauuugcuaacgcccuguuggcauuaaaugauaugggcaaaguaaggaaggacaucccucaauggcagccaaguaaagguuggcaugauuggcagcaggugccguucuguucccaccauuuccacgaacugauuaugaaggacgggcgcaaacucgucgugcccugccgaccucaagacgagcuuaucggacgggcuagaauuagccagggcgccggcuggucacugagggaaaccgcaugucuagggaaggccuaugcgcagauguggucccugauguacuuucaccgcagagaucuccgguuggcuucuaacgccaucugcagcgcaguuccagugcauuggguccccacuaguaggacaaccugguccauacacgcccaucaccaauggaugacuacagaggacaugcugaccguguggaaucguguauggaucgaagauaacccuuggauggaggacaagacgccaguuacaaccugggagaaugugcccuaccuuggaaaacgagaagaucaguggugugguagccugauuggccucacuucucgcgcuaccugggcccagaacaucccuacagcaauucagcaagucagaucauuaaucgggaaugaggaauuccuggacuauaugccgaguaugaagcgguuuaggaaagaggaggaauccgagggagcuauuugguga

SEQ ID NO: 15460 - RNA, 9873 nt, Artificial Sequence
  derived and/or modified CDS sequence (opt3) from DENV-3__FJ547076__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaguuuccgaaaaggaggagaauauggugaaaucacugguaagcgcugguucuggcaagguggacaacuucacaaugggggucuugugccucgccauucuguuugaagaggugaugcgcggaaaguucggcaaaaagcauaugaucgcagggguuuucuuuaccuucgugcuacugcucuccggacagaucacguggcgggauauggcucacacucugauuaugaucggcaguaaugccagcgacagaauggguaugggggucaccuaccuugcauugauugccacauuuaaaauacagcccuuccuggcuuuaggauuuuuccucaggaagcugaccucucgcgaaaaccuucugcuaggcgugggccucgcgauggccacuacacugcaauugccggaggauaucgaacagauggcaaaugggauugcucugggauuaauggcccucaaacugaucacccaguuugagacauaucagcuuuggacugcccugauuuccuugaccuguucaaacacgaucuucacacucaccguugcuuggcgaacugcaacccugauacuagccggugugagucugcuuccugucugccaaagcucguccaugcggaagacagacuggcucccaaugacuguagcggcuaugggcgugcccccucugcccuuguuuaucuucucucugaaggauaccuuaaaacguagaagcuggccacucaaugaggggguuauggccgugggacuggucucaauucuugcaaguucccuguugaggaacgacgugccuauggccggcccccucguagcuggugggcugcuaaucgcauguuacgugauuacgggaacaucugccgaucugaccgucgaaaaggcggcugacguuacuugggaggaagaggccgaacagacaggcgugagccauaaccuuaugaucaccguggacgaugacggcacuaugcgcauaaaagaugacgagacagagaauauucucaccguccuguugaagacggcauuacugaucguguccgggaucuuuccauacucaauuccggccacucuccugguuuggcacaccuggcagaaacagacacaacggagcggaguacuuugggaugugccuagucccccagaaacccagaaggcugagcuggaagagggugucuauagaauaaaacagcagggcaucuucgggaagacacaagugggaguuggcgugcagaaggagggugucuuucauacuauguggcacgugaccaggggggccguauugacguacaacggaaaacgacuagaacccaauugggcaucugucaagaaagaccugauuuccuauggcggcggguggcgccucagcgcucaguggcaaaagggagaggaagugcagguuaucgccguggagccugguaaaaacccaaagaauuuccagacaaugcccggcacuuuccagaccacaaccggggaaauuggagcgaucgcccuggauuuuaagccuggcacuucggguucaccgauaaucaaccgggaggggaaagucgugggacuuuacggcaauggcguugugaccaagaacgggggauaugucucugguauugcacaaacaaaugcugagccagacggccccacgccugaauuagaggaagagauguucaaaaagagaaaccugacuaucauggaucuccacccagggaguggaaaaaccaggaaguacuugcccgccauugugcgugaagcuaucaagcgccggcugagaacacucauacuggcaccuaccaggguaguggccgccgagauggaggaagcucuuaaaggccugccgauucgauaucagacuacagcgaccaaguccgagcauacgggucgggaaaucguugacuugaugugccacgcaacuuuuacaaugcgccuacugagccccgucagagugccaaauuacaaccucaucauuauggaugaggcccauuucaccgacccugcuucuaucgccgcaaggggguacauaagcacccgggugggaaugggcgaagccgcugcgauuuuuaugacugccacacccccaggcaccgcagaugcuuucccucaguccaaugcccccauccaggacgaggagcgagacauuccagaaagaucauggaacagugggaaugaguggaucacagauuuugcaggaaaaacugucugguucguaccgagcauaaaggccgguaacgacauugcuaacuguuuacgcaaaaauggcaagaaggugauccaacugucuaggaaaacguuugauaccgaauaucagaagacaaaacuuaacgacugggauuucguugugacuaccgacaucuccgagaugggggccaauuuuaaggcggaucgugucauugacccucggagaugccugaaacccgugauccucacagauggaccagagaggguuauuuuggcaggccccaugccugugaccgccgcuucagccgcucagcgccgagguagagucgggcggaacccacagaaggaaaaugaccaauacauauucacuggccagccccugaacaaugaugaggaccacgcacauuggacggaagccaagaugcuccuggacaacaucaauaccccugagggaauuaucccggcucuuuucgaaccagagagggagaaaagugccgcaaucgauggcgaauaucgccuaaagggggagagccguaaaacauuuguggaacugaugagacggggagacuugcccguaugguuagcgcacaagguggccuccgaggguauuaaauacacugauaggaaguggugcuucgacggccagcgcaacaaucagauacuggaagagaacauggauguugagaucuggaccaaagaaggggagaagaagaaacuccgaccuagauggcuggacgcucggacauauucugauccccuugcccugaaggaauuuaaagacuucgcagcuggaaggaagucgauugcccucgauuuggucaccgagaucggccgcgugccaagccaccuggcacauagaacuaggaaugcccuagacaaccuggugaugcuccacacaucagaacauggugggaaagcuuaccggcacgcggucgaggagcuuccugaaacgauggagacccuguuauugcugggccucaugauucugcuuacuggaggcgccaugcuguuucucaucuccgggaagggaauagguaagacaaguaucggcuugauuuguguuaucgcaucuagcgggaugcuguggauggcugaaauucccuuacaauggaucgccuccgccauagugcuagaguucuuuaugaugguacugcucauuccagagccugaaaaacagcguaccccgcaggauaaucaacuugcauauguggucaucggaauucugaccuuggcugccaucauagcggcuaacgagaugggccugcucgaaacaacuaagcgcgaccuggguaugucaaaagagcccggggugguuucuccaacgagcuaccuugauguggaccuccacccugccagugcauggacccuguacgccgucgcuacaacuguaaucacccccauguugcgacauacaauugaaaauuccaccgcaaacgugagccuggccgcgaucgcuaaccaggccguuguguuaaugggccuagacaagggauggccaauuucuaaaauggaucugggcgucccucuccuugcacuggggugcuauucacaggugaaucccuugacucugacggccgcuguccuccugcuuaucacacacuacgccauaauuggaccgggcuuacaggcaaaggcuaccagagaggcccaaaagaggacugcggccgguaucaugaaaaacccaaccguggacgggaucaugacaauugaucuggacccuguuaucuaugauuccaaguucgagaaacagcucggacaggugauguugcugguacuaugugcagugcagcugcuccuuaugcggacuaguugggcucugugcgaagccuugacccuggcaacaggccccauaacgacccucugggaggguagcccaggcaaguuuuggaauacuacaauugcugucucgauggccaacaucuuccgcgggucuuaccuggccggagcgggcuuagcuuuuuccauuaugaaaagcguugggaccggaaagagaggcacugguucacaaggggaaacacuuggagagaaguggaaaaagaaacugaaucagcucaguaggaaggaauucgaccuauauaaaaagucuggcaucaccgagguggaucggacggaggcaaaagaaggucugaagcgaggcgagauaacccaucacgccgucuccagagggagcgcuaaguugcagugguuuguggaacgcaacaugguaauccccgagggaagggugauugaccugggcugugggcggggaggcuggucauacuauugcgccggucucaaaaagguuacagaagugcguggguacacuaaaggaggcccuggccaugaggagccgguccccaugaguaccuacggguggaauaucgugaagcuuaugagcggaaaagaugucuucuaucugccaccugaaaagugugacacauugcugugcgauauuggugaguccucucccagcccuacuguggaagaguccagaaccaucaggguucucaagaugguagagccaugguuaaaaaacaaucaguucuguauuaaggugcugaaccccuacaugccuacagucaucgaacaccuugagcgccugcaacggaaacacggcgggaugcuagugcgaaauccacucucaagaaacucuacccaugaaauguauuggauaaguaauggaacuggcaacauuguugcaucggugaauauggucagcaggcuguugcugaaccgcuuuacgaugacacaccggagacccaccaucgagaaggacguggaucucggugccgggacucgucauguaaacgcugaaccggagaccccuaauauggacgugaucggagagaggauuaaacggauaaaggaagagcacaacuccacauggcacuacgacgaugaaaauccauauaagacgugggcguaccauggcucuuaugagguuaaagccaccggcucagcaagcuccaugaucaacggggucgugaagcuucugacuaaacccugggacguggucccuaugguuacacagauggcuaugaccgauacuacaccauucggacagcaacgcguguuuaaggaaaaaguagacacccgaacacccagaaguaugccggguacuaggcgggugaugggcauuaccgccgagugguuauggcgcacgcuggggagaaauaagaagccuagguugugcacccgagaggaauucacaaaaaagguccggacuaacgcagccaugggagcuguguuuaccgaggaaaaucagugggauucugccaaagcggcaguugaggacgaagauuucuggaagcucguggaccgugagagagagcugcacaaacuaggcaagugugguagcugcgucuacaacaugauggggaaacgcgaaaagaagcuuggagaguuuggcaaagccaagggcucaagggcuaucugguacauguggcugggggcccgguaucucgaauucgaggcacugggauuuuugaaugaggaucauugguucuccagagaaaacaguuacagcgguguggagggcgaagggcugcacaaacucggauauauucuucgcgacaucucuaagauacccggcggugcuauguacgccgaugacacagcugggugggacacuaggaucaccgaggaugaccugcauaaugaagagaaaauuacgcagcagauggauccagagcaccgacaauuagccaacgcaaucuuuaagcugacauaucagaauaagguaguuaaagugcagcggccuacccccacuggaacagucauggacauuaucuccagaaaggaucagaggggcucaggccaaguggggaccuacggauugaacacuuucaccaauauggaagcgcagcucauacgccagauggagggugaaggcgugcugagcaaagccgaccuagagaacccacaccuucccgaaaagaaaauuacacaguggcuggagacgaagggggucgagcgucucaagcggauggcuaucucgggagaugacugcguugugaaaccuaucgaugacagauuugccaacgcacuguuggcuuuaaaugauaugggcaagguaaggaaagacauuccacaauggcagccgucuaaggguuggcaugauuggcagcaggugcccuucuguagucaccauuuccacgaacugauaaugaaagacgggcgcaagcucgucgugccuugccgaccacaagacgagcuuaucggacgggccagaauuucccagggcgcaggcuggagccugagggaaaccgccugucuagggaaggcguaugcucagauguggucacugauguacuuucaccgcagagaucuccgguuggccuccaacgcaaucugcucugccguucccgugcauugggucccuacuagcaggacaaccuggaguauucacgcucaucaccaauggaugacuacagaggacaugcugaccguguggaaucguguauggaucgaagauaacccauggauggaggacaaaacgcccguuacaaccugggagaaugugccuuaccuuggaaagcgagaagaucaguggugugguucccugauaggccucacuagccgcgccaccugggcacagaacaucccgacagcuauucagcaagucagaucuuuaaucgggaaugaggaauuccuggacuauaugccaucaaugaaacgguuuaggaaggaggaggaaagugagggagccauuugguga

SEQ ID NO: 15461 - RNA, 9873 nt, Artificial Sequence
  derived and/or modified CDS sequence (opt3) from DENV-3__FJ547077__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgcaggugcuugggagaauggcgucugugggauacgaagcaccacacgcauggaaaaccuccuguggaaacagaucgccaaugagcuuaacuauauuuugugggaaaauaacaucaagcugacgguuguggugggagacauuaucggcguacucgagcaggggaaaagaacccugacuccacagccuauggaguuaaaguacucauggaaaacauggggaaaggcgaagauagucaccgccgaaacacaaaacaguuccuucauuaucgauggccccaauacuccagagugccccagcgcuucuagggcauggaacgugugggaaguugaggacuaugguuuugggguguucaccacgaauauuuggcugaaacuucgggaagucuacacacaguugugugaccaccgccucaugucagccgcugugaaggaugagagagccguucacgcagacaugggauacuggaucgagagucagaaaaacggcagcuggaagcuggaaaaagcgucccuaauagaggugaagaccugcacuuggccuaagucucauacccuguggucgaaugguguacucgaaagcgauaugaucauuccaaaaucccuggccggcccgaucucacagcacaacuauaggcccggguaccauacacaaacugcuggaccuuggcaccuuggcaaguuggagcuggacuuuaauuauugcgaggggaccacagucgugauuacggaaaacuguggaacccguggcccaaguuuacggacuacaaccgugucugguaaacucauccacgaguggugcugucgaagcugcacucugcccccucuuagauacaugggggaagauggauguugguauggcauggagauaaggccaauuuccgaaaaggaggagaauauggucaaaucacugguuagcgccgguucuggcaagguggacaacuucacaauggggguauugugccucgcaauccuguuugaagaggugaugcgcggaaaguucggcaaaaagcauaugaucgcuggggucuucuuuaccuucgugcuacugcucuccggacagauuacguggcgggauauggcccacacucugaucaugauuggcaguaaugcaagcgacagaauggguauggggguuaccuaccuugccuugauagcuacauuuaaaauccagcccuuccuggcguuaggauuuuuccucaggaagcugaccucucgcgaaaaccuucugcuaggcgugggccucgccauggcaacuacacugcaauugccggaggauauugaacagauggcuaaugggaucgcccugggauuaauggcccucaaacugauuacccaguuugagacauaucagcuuuggacugcucugaucuccuugaccuguucaaacacgauauucacacucaccgucgcauggcgaacugccacccugauccuagcgggugugagucugcuuccuguuugccaaagcucguccaugcggaagacagacuggcucccaaugacuguggcugccaugggcguccccccucugcccuuguuuauuuucucucugaaggauaccuuaaaacguagaagcuggccacucaaugaggggguaauggcagugggacugguuucaauccuugccaguucccuguugaggaacgacgugccuauggcuggcccccucgucgcaggugggcugcuaauugccuguuacgugaucacgggaacaucugcggaucugaccguagaaaaggcugccgacgugacuugggaggaagaggcagaacagacaggcgucagccauaaccuuaugauaaccguugacgaugacggcacuaugcgcauuaaagaugacgagacagagaauauccucaccgugcuguugaagacggccuuacugaucguguccgggauuuuuccauacucaauaccggcuacucuccuggucuggcacaccuggcagaaacagacacaacggagcggagugcuuugggauguuccuagucccccagaaacccagaaggccgagcuggaagaggguguauauagaaucaaacagcagggcauuuucgggaagacacaagugggagucggcgugcagaaggaggguguuuuucauacuauguggcacgugaccaggggggcagucuugacguacaacggaaaacgacuagaacccaauugggcuucugugaagaaagaccugaucuccuauggcggcggguggcgccucagcgcccaguggcaaaagggagaggaaguacaggucauugcgguggagccugguaaaaacccaaagaauuuccagacaaugcccggcacuuuccagaccacaaccggggaaaucggagccauagcacuggauuuuaagccuggcacuucggguucaccgaucauuaaccgggaggggaaaguugugggacuuuacggcaauggcgucgugaccaagaacgggggauauguuucugguaucgcucaaacaaaugccgagccagacggccccacgccugaauuagaggaagagauguucaaaaagagaaaccugacuauuauggaucuccacccagggaguggaaaaaccaggaaguacuugcccgcuaucgugcgugaagcaauaaagcgccggcugagaacacucauucuggccccuaccagggucguggccgcugagauggaggaagcgcuuaaaggccugccgauccgauaucagacuacagcaaccaaguccgagcauacgggucgggaaaucguagacuugaugugccacgccacuuuuacaaugcgccuacugagccccgugagaguuccaaauuacaaccucauuaucauggaugaggcucauuucaccgacccugccucuauagcagccaggggguacauuagcacccgggucggaaugggcgaagcugcggccaucuuuaugacugcaacacccccaggcaccgcugaugccuucccucaguccaaugcacccauucaggacgaggagcgagacaucccagaaagaucauggaacagugggaaugaguggauaacagauuuugccggaaaaacugugugguucgugccgagcauuaaggcugguaacgacaucgccaacuguuuacgcaaaaauggcaagaaggucauccaacugucuaggaaaacguuugauaccgaauaucagaagacaaaacuuaacgacugggauuucguagugacuaccgacauuuccgagaugggggcgaauuuuaaggcagaucguguuaucgacccucggagaugccugaaacccgugauucucacagauggaccagagagggucauauuggccggccccaugccugugaccgcugccucagcugcacagcgccgagguagaguugggcggaacccacagaaggaaaaugaccaauacaucuucacuggccagccccugaacaaugaugaggaccacgcccauuggacggaagcuaagaugcuccuggacaacauuaauaccccugagggaaucaucccggcccuuuucgaaccagagagggagaaaagugcagcgauugauggcgaauaucgccuaaagggggagagccguaaaacauuuguggaacugaugagacggggagacuugcccgucugguuagcccacaagguggcuuccgaggguauaaaauacacugauaggaaguggugcuucgacggccagcgcaacaaucagauccuggaagagaacauggauguagagauuuggaccaaagaaggggagaagaagaaacuccgaccuagauggcuggacgcccggacauauucugauccccuugcacugaaggaauuuaaagacuucgcugccggaaggaagucgaucgcacucgauuuggugaccgagauuggccgcguuccaagccaccuggcccauagaacuaggaaugcucuagacaaccuggucaugcuccacacaucagaacauggugggaaagcguaccggcacgccguggaggagcuuccugaaacgauggagacccuguuauugcugggccucaugauccugcuuacuggaggcgcaaugcuguuucucauauccgggaagggaaucgguaagacaaguauuggcuugaucugugugauugcuucuagcgggaugcuguggauggccgaaauccccuuacaauggauagccuccgcaauuguccuagaguucuuuaugaugguucugcucaucccagagccugaaaaacagcguaccccgcaggauaaucaacuugcuuaugugguaauuggaauccugaccuuggccgcgacaauagcugccaacgagaugggccugcucgaaacuacgaagcgcgaccuggguaugucaaaagagcccgggguggucucuccaaccagcuaccuugauguggaccuccacccugcaagugccuggacacuguacgcuguugcaacuaccgugaucacacccauguugcgacauaccauugaaaauuccacugccaacgucagccuggcggcuaucgccaaccaggcaguaguguuaaugggccuagacaagggauggccaauuucuaaaauggaucugggcguuccucuccuugcccuggggugcuauucacaggugaaucccuugacgcugacagcugccguccuccugcuuaucacccacuacgcaauaauuggaccgggcuuacaggcuaaggccacuagagaggcgcaaaagaggaccgccgcagguaucaugaaaaacccaacaguggacgggaucaugacuauugaucuggacccugucaucuaugauuccaaguucgagaaacagcucggacaggugauguugcugguucuaugugcugugcagcugcuccuuaugcggaccaguugggcccugugcgaagcauugacacuggcuacgggccccauaaccacucucugggaggguagcccaggcaaguuuuggaauacaaccauugccguaucgauggccaacaucuuccgcgggucuuaccuggcgggagcuggcuuagcauuuuccauuaugaaaagcguggggacuggaaagagaggcacagguucacaaggggaaacccuuggagagaaguggaaaaagaaacugaaucagcucaguaggaaggaauucgaccuauauaaaaagucuggcaucacggaggucgaucggaccgaggccaaagaaggucugaagcgaggcgagauaacacaucacgcuguuuccagagggagcgccaaguugcagugguuuguggaacgcaacauggucauccccgagggaagggugauugaccugggcugugggcggggaggcuggucauacuauugcgcaggucucaaaaagguaacugaagugcguggguacaccaaaggaggcccuggccaugaggagccgguucccaugaguacauacggguggaauaucgugaagcuuaugagcggaaaagaugucuucuaucugccaccugaaaagugugacacuuugcugugcgauauuggugaguccucucccagcccuaccguggaagaguccagaacaaucaggguccucaagaugguggagccaugguuaaaaaacaaucaguucuguauuaagguucugaaccccuacaugccuaccguaaucgaacaccuugagcgccugcaacggaaacacggcgggaugcuagugcgaaauccacucucaagaaacucuacucaugaaauguauuggauaaguaauggaacgggcaacauugucgccucggugaauaugguuagcaggcuguugcugaaccgcuuuacaaugacccaccggagacccacuaucgagaaggacguggaucucggugcugggacccgucaugucaacgcggaaccggagacaccuaauauggacgugaucggagagaggauuaaacggauaaaggaagagcacaacuccacguggcacuacgacgaugaaaauccauauaagaccugggccuaccauggcucuuaugagguaaaagcaacuggcucagcuagcuccaugaucaacggggugguuaagcuucugacaaaacccugggacgucgugccuauggugacccagauggccaugacugauacaaccccauucggacagcaacgcgucuuuaaggaaaaaguugacacacgaacucccagaaguaugccggguaccaggcgggugaugggcauuacggcagagugguuauggcgcacccuggggagaaauaagaagccuagguugugcacacgagaggaauucacuaaaaagguacggaccaacgccgcuaugggagccguguuuacagaggaaaaucagugggauucugcgaaagcagccgucgaggacgaagauuucuggaagcucguggaccgugagagagagcugcacaaacuaggcaagugugguagcugcguuuacaacaugauggggaaacgcgaaaagaagcuuggagaguuuggcaaagcuaagggcucaagggccaucugguacauguggcugggggcacgguaucucgaauucgaggcucugggauuuuugaaugaggaucauugguucuccagagaaaacaguuacagcgguguggagggcgaagggcugcacaaacucggauauauucuucgcgacaucucuaagauacccggcggugccauguacgcugaugacacugccgggugggacaccaggaucacggaggaugaccugcauaaugaagagaaaauuacacagcagauggauccagagcaccgacaauuagcaaacgcgaucuuuaagcugaccuaucagaauaaggucgugaaaguacagcggccuacucccacaggaaccguuauggacauuaucuccagaaaggaucagaggggcucaggccaaguggggacuuacggauugaacaccuucacaaauauggaagcccagcucauacgccagauggagggugaaggcguccugagcaaagcugaccuagagaacccacaccuucccgaaaagaaaauuacgcaguggcuggagaccaaggggguggagcgucucaagcggauggccaucucgggagaugacugcguggucaaaccuaucgaugacagauuugcaaacgcucuguuggccuuaaaugauaugggcaagguuaggaaagacauuccacaauggcagccgucuaaggguuggcaugauuggcagcaggugcccuucuguagucaccauuuccacgaacugauaaugaaagacgggcgcaagcucguagugccuugccgaccacaagacgagcuuaucggacgggcaagaauuucccagggcgccggcuggagccugagggaaacugcgugucuagggaaggcuuaugcccagauguggaaccugauguacuuucaccgcagagaucuccgguuggcaucaaaugccaucugcuccgcuguccccgugcauuggguuccuacaucuaggaccacuuggagcauucacgcccaucaccaauggaugacaaccgaggacaugcugacgguguggaaccgugucuggaucgaagauaauccauggauggaggacaaaacacccgugaccacuugggagaacguaccuuaccuuggaaagcgagaagaucaguggugugguagucugauaggccucaccucccgcgcaacaugggcucagaauaucccgacugccauucagcaaguuagaagcuuaaucgggaacgaggaauuccuggacuauaugccaucuaugaaacgguuuaggaaggaggaggaaucagagggagcgauuugguga

SEQ ID NO: 15462 - RNA, 9873 nt, Artificial Sequence
  derived and/or modified CDS sequence (opt3) from DENV-3__FJ547078__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggauugaugugguccuggagcacggcgggugcgugacgacuauggcgaagaauaaacccacacuagacaucgagcuccagaagaccgaagcaacucaacuggccacacuuaggaaacuguguauugagggaaagaucaccaacauaacgaccgauagccggugcccuacacagggcgaagcuguguugccagaggaacaggaccagaauuaugucuguaaacacacuuacguugaucgcgguugggggaacggaugcggccucuucggcaaggggagucuggugaccugcgccaaguuucaauguuuagagcccauugagggaaaaguagugcaguaugaaaaucugaaguacacagucaucauuacugugcauaccggugaccagcaccagguuggcaacgagacacaaggggugaccgcagaaaucacuccucaggcuuccacgacagaggccauccucccagaauauggaacccuuggccuggagugcucuccgcgaacugguuuggacuucaaugagaugauucuacugaccaugaaaaacaaggcguggaugguccauagacagugguuuuucgaucucccccugccuuggacaagcggggccaccacugaaacaccaacguggaauaggaaagagcuucuggugaccuuuaagaacgcacacgcuaaaaagcaagaaguaguuguguugggcucccaggagggagccaugcacacugcucucacaggcgccaccgaaauacagaauucagggggaacaaguaucuucgcaggucaucugaagugucgguuaaaaauggacaagcuggagcuaaaaggcaugagcuacgccaugugcacuaacaccuuuguccucaagaaagaggugucugaaacgcagcacgggaccauucugaucaaggucgaguacaagggagaagaugugcccuguaaaauaccuuucuccacagaggacggccaagguaaggcucauaacgggcgucuuauuacugcgaauccaguugugaccaaaaaggaggaacccguaaacaucgaggcagaaccgccuuucggcgagucaaauaucgucauuggaaucggcgauaacgccuugaaaauuaauugguauaagaaggggagcaguauaggaaaaauguuugaagcuacagcccgcggugcaagaaggauggccauccugggcgacacugcuugggauuucgggucugugggaggcguucucaacucccuggguaagauggugcaccagauuuuugggagcgccuacaccgcacuuuucucgggcgucucuugggugaugaaaaucggaaucggcguacuguugacguggauugggcucaauuccaagaacacaucaaugaguuuuagcugcauagcgaucggaauuaucacccuguauuuaggcgcugugguucaggccgacauggguugugucauuaauuggaaagggaaggagcugaagugcggauccggcaucuucgugacuaacgaggugcauacauggaccgaacaguacaaauuucaagcagauucucccaagcggcuagccacugcuauagccggugcaugggagaauggcgucugugggauccgaagcaccacacgcauggaaaaccuccuguggaaacagauugcuaaugagcuuaacuauaucuugugggaaaauaacauuaagcugacgguuguggugggagacaucauaggcguacucgagcaggggaaaagaacccugacuccacagccuauggaguuaaaguacucauggaaaacauggggaaaggccaagauugucaccgcggaaacacaaaacaguuccuucaucauugauggccccaauacuccagagugccccagcgccucuagggcuuggaacgugugggaaguugaggacuaugguuuugggguguucaccacgaauaucuggcugaaacuucgggaagucuacacacaguugugugaccaccgccucaugucagcagccgugaaggaugagagagcuguucacgccgacaugggauacuggauagagagucagaaaaacggcagcuggaagcuggaaaaagcaucccuaaucgaggugaagaccugcacuuggccuaagucucauacccuguggucgaaugguguacucgaaagcgauaugauuaucccaaaaucccuggcgggcccgauuucacagcacaacuauaggcccggguaccauacacaaacugccggaccuuggcaccuuggcaaguuggagcuggacuuuaauuauugcgaggggaccacagucgugaucacggaaaacuguggaacccguggcccaaguuuacggacuacaaccgugucugguaaacucauacacgaguggugcugucgaagcugcacucugcccccucuuagauacaugggggaagauggauguugguauggcauggagauuaggccaaucuccgaaaaggaggagaauauggucaaaucacugguuagcgcugguucuggcaagguggacaacuucacaauggggguauugugccucgccauccuguuugaagaggugaugcgcggaaaguucggcaaaaagcauaugauugcaggggucuucuuuaccuucgugcuacugcucuccggacagaucacguggcgggauauggcucacacucugauuaugauaggcaguaaugccagcgacagaauggguauggggguuaccuaccuugcauugaucgccacauuuaaaauucagcccuuccuggcuuuaggauuuuuccucaggaagcugaccucucgcgaaaaccuucugcuaggcgugggccucgcgauggccacuacacugcaauugccggaggauaucgaacagauggcaaaugggauugcucugggauuaauggcccucaaacugaucacccaguuugagauauaucagcuuuggacagcccugaucuccuugacuuguucaaacaccauuuucacgcucacagucgcuuggcgaaccgcaacucugauccuagccggugugagucugcuuccuguuugccaaagcucguccaugcggaagaccgacuggcucccaaugacaguggcggcuaugggcguccccccucugcccuuguuuauuuucucucugaaggauacuuuaaaacguagaagcuggccacucaaugaggggguaauggccgugggacugguuucaauccuugcaaguucccuguugaggaacgacgugccuauggccggcccccucgucgcuggugggcugcuaauagcauguuacgugauuaccggaacgucugccgaucugacaguagaaaaggcggcugacgugaccugggaggaagaggccgaacagacuggcgucagccauaaccuuaugaucacaguugacgaugacggcaccaugcgcaucaaagaugacgagacugagaauauucucacagugcuguugaagaccgcauuacugauaguguccgggaucuuuccauacucaauuccggccacgcuccuggucuggcacacuuggcagaaacagacccaacggagcggagugcuuugggauguuccuagucccccagaaacacagaaggcugagcuggaagaggguguauauagaaucaaacagcagggcauuuucgggaagacccaagugggagucggcgugcagaaggaggguguuuuucauacaauguggcacgugacuaggggggccgucuugaccuacaacggaaaacgacuagaacccaauugggcaucugugaagaaagaccugaucuccuauggcggcggguggcgccucagcgcucaguggcaaaagggagaggaaguacaggucauagccguggagccugguaaaaacccaaagaauuuccagacgaugcccggcacauuccagacuaccacaggggaaaucggagcgauugcccuggauuuuaagccuggcaccucggguucaccgaucauuaaccgggaggggaaaguugugggacuuuacggcaauggcgucgugacuaagaacgggggauauguuucugguaucgcacaaaccaaugcugagccagacggccccacaccugaauuagaggaagagauguucaaaaagagaaaccugacgauaauggaucuccacccagggaguggaaaaacuaggaaguacuugcccgccauugugcgugaagcuaucaagcgccggcugagaacccucauccuggcaccuacaagggucguggccgccgagauggaggaagcucuuaaaggccugccgauucgauaucagaccacugcgacaaaguccgagcauaccggucgggaaaucguagacuugaugugccacgcaacguuuacuaugcgccuacugagccccgugagaguuccaaauuacaaccucauaauuauggaugaggcccauuucacagacccugcuucuaucgccgcaaggggguacauuagcacccgggucggaaugggcgaagccgcugcgaucuuuaugaccgccacucccccaggcacagcagaugcuuucccucaguccaaugcccccauacaggacgaggagcgagacauuccagaaagaucauggaacagugggaaugaguggaucaccgauuuugcaggaaaaacagugugguucgugccgagcaucaaggccgguaacgacauugcuaacuguuuacgcaaaaauggcaagaaggucauccaacugucuaggaaaacuuuugauacggaauaucagaagaccaaacuuaacgacugggauuucguagugacaacugacauuuccgagaugggggccaauuuuaaggcggaucguguuauagacccucggagaugccugaaacccgugauccucaccgauggaccagagagggucauuuuggcaggccccaugccugugacagccgcuucagccgcucagcgccgagguagaguugggcggaacccacagaaggaaaaugaccaauacaucuucaccggccagccccugaacaaugaugaggaccacgcacauuggacugaagccaagaugcuccuggacaacaucaauacgccugagggaauuauaccggcucuuuucgaaccagagagggagaaaagugccgcaaucgauggcgaauaucgccuaaagggggagagccguaaaaccuuuguggaacugaugagacggggagacuugcccgucugguuagcgcacaagguggccuccgaggguauuaaauacacagauaggaaguggugcuucgacggccagcgcaacaaucagauccuggaagagaacauggauguagagauuuggacuaaagaaggggagaagaagaaacuccgaccuagauggcuggacgcucggaccuauucugauccccuugcccugaaggaauuuaaagacuucgcagcuggaaggaagucgaucgcccucgauuuggugacagagauaggccgcguuccaagccaccuggcacauagaaccaggaaugcccuagacaaccuggucaugcuccacacuucagaacauggugggaaagcuuaccggcacgcgguggaggagcuuccugaaacaauggagacgcuguuauugcugggccucaugauccugcuuaccggaggcgccaugcuguuucucauuuccgggaagggaaucgguaagacuaguauuggcuugaucugugugauagcaucuagcgggaugcuguggauggcugaaauucccuuacaauggaucgccuccgccauuguccuagaguucuuuaugaugguucugcucaucccagagccugaaaaacagcguacaccgcaggauaaucaacuugcauaugugguaauaggaauccugaccuuggcugccauuaucgcggcuaacgagaugggccugcucgaaaccacaaagcgcgaccuggguaugucaaaagagcccgggguggucucuccaacuagcuaccuugauguggaccuccacccugccagugcauggacgcuguacgccguugcuaccacagugauuacucccauguugcgacauaccaucgaaaauuccacagcaaacgucagccuggccgcgauagcuaaccaggccguaguguuaaugggccuagacaagggauggccaauuucuaaaauggaucugggcguuccucuccuugcacuggggugcuauucacaggugaaucccuugacccugacugccgcuguccuccugcuuaucacgcacuacgccaucauuggaccgggcuuacaggcaaaggcuacaagagaggcccaaaagaggaccgcggccgguaucaugaaaaacccaacuguggacgggauaaugaccauugaucuggacccugucaucuaugauuccaaguucgagaaacagcucggacaggugauguugcugguucuaugugcagugcagcugcuccuuaugcggacaaguugggcucugugcgaagccuugacucuggcaaccggccccauuacaacgcucugggaggguagcccaggcaaguuuuggaauaccacuaucgcuguaucgauggccaacauauuccgcgggucuuaccuggccggagcgggcuuagcuuuuuccaucaugaaaagcguggggacaggaaagagaggcaccgguucacaaggggaaacucuuggagagaaguggaaaaagaaacugaaucagcucaguaggaaggaauucgaccuauauaaaaagucuggcauuacagaggucgaucggaccgaggcaaaagaaggucugaagcgaggcgagaucacgcaucacgccguuuccagagggagcgcuaaguugcagugguuuguggaacgcaacauggucauucccgagggaagggugaucgaccugggcugugggcggggaggcuggucauacuauugcgccggucucaaaaagguaaccgaagugcguggguacacaaaaggaggcccuggccaugaggagccgguucccaugaguacuuacggguggaauauugugaagcuuaugagcggaaaagaugucuucuaucugccaccugaaaagugugacaccuugcugugcgauaucggugaguccucucccagcccuacaguggaagaguccagaacuauaaggguccucaagaugguggagccaugguuaaaaaacaaucaguucuguauuaagguucugaaccccuacaugccuaccguaaucgaacaccuugagcgccugcaacggaaacacggcgggaugcuagugcgaaauccacucucaagaaacucuacacaugaaauguauuggaucaguaauggaaccggcaacauugucgcaucggugaauaugguuagcaggcuguugcugaaccgcuuuacuaugacgcaccggagacccacaauagagaaggacguggaucucggugccgggacccgucaugucaacgcugaaccggagacuccuaauauggacgugaucggagagaggauuaaacggaucaaggaagagcacaacuccaccuggcacuacgacgaugaaaauccauauaagacaugggcguaccauggcucuuaugagguaaaagccacgggcucagcaagcuccaugauuaacggggugguuaagcuucugaccaaacccugggacgucgugccuauggugacucagauggcuaugacagauaccacuccauucggacagcaacgcgucuuuaaggaaaaaguugacacacgaacccccaagaguaugccggguacaagaagggugaugggcaucacugccgagugguuauggcggacccuggggcgcaauaagaaaccuagauugugcacgagggaggaauucaccaagaaaguacgaacaaacgcagccaugggagcuguguuuacugaggaaaaucagugggauucugccaaggcggcagucgaggacgaagauuucuggaaacucguggaccgggagcgugagcugcacaagcuaggcaaaugugguagcugcguuuacaacaugauggggaagagagaaaagaaacuuggagaguuuggcaaggccaaaggcucacgcgcuauaugguacauguggcugggggccagguaucucgaauucgaggcacugggauuuuugaaugaggaucauugguucucccgggaaaacaguuacagcgguguggagggcgaagggcugcacaagcucggauauauccuuagagacauuucuaaaauccccggcggugcuauguacgccgaugacaccgcugggugggacacacgcauuacugaggaugaccugcauaaugaagagaagaucacccagcagauggauccagagcacaggcaauuagccaacgcaauauuuaagcugacguaucagaauaaagucgugaagguacagcgaccuacacccaccggaacuguuauggacauuaucucccggaaagaucagagaggcucaggccaaguggggacauacggauugaacaccuucacuaauauggaagcgcagcucaucaggcagauggagggugaaggcguccugagcaaggccgaccuagagaacccacaccuucccgaaaaaaagauuacccaguggcuggagacaaaggggguggagcgccucaaacguauggcuauaucgggagaugacugcguggucaagccuaucgaugaccgguuugccaacgcacuguuggcuuuaaaugauaugggcaaaguuagaaaggacauuccacaauggcagccgucuaaagguuggcaugauuggcagcaggugcccuucuguagucaccauuuccacgaacugaucaugaaggacgggaggaagcucguagugccuugccgcccacaagacgagcuuauuggacgagcccggaucucccagggcgcaggcuggagccugagagaaacggccugucuagggaaagcguaugcucagauguggucacugauguacuuucacaggcgcgaucucagauuggccuccaacgcaauaugcucugccguccccgugcauuggguuccuaccagccggacuacauggaguauccacgcucaucaccaauggaugaccacugaggacaugcugacaguguggaauagggucuggauugaagauaacccauggauggaggacaagacccccgugacgacaugggagaauguaccuuaccuuggaaaacgugaagaucaguggugugguucccugaucggccucaccagccgagccacuugggcacagaacauuccgaccgcuauccagcaaguucgcucuuuaauugggaaugaggaauuccuggacuauaugccaucaaugaagagauuucggaaagaggaggaaagugagggagccauaugguga

SEQ ID NO: 15463 - RNA, 9873 nt, Artificial Sequence
  derived and/or modified CDS sequence (opt3) from DENV-3__FJ547079__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcaagguagacaacuucacaauggggguguugugccucgccauccuguuugaagaggucaugcgcggaaaguucggcaaaaagcauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaaaauccagcccuuccuggcuuuaggauuuuuccucaggaagcugaccucucgcgaaaaccuucugcuaggcgucggccucgcgauggccacuacacugcaauugccggaggauauugaacagauggcaaaugggaucgcucugggauuaauggcccucaaacugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaagacagacuggcucccaaugacugucgcggcuaugggcguacccccucugcccuuguuuauuuucucucugaaggauaccuuaaaacguagaagcuggccacucaaugagggggugauggccguuggacuggugucaauccuugcaaguucccuguugaggaacgacgucccuauggccggcccccucguggcuggugggcugcuaauugcauguuacguaaucacgggaacaucugccgaucugaccguggaaaaggcggcugacgucacuugggaggaagaggccgaacagacaggcguuagccauaaccuuaugauaaccguggacgaugacggcacuaugcgcauuaaagaugacgagacagagaauauccucaccgugcuguugaagacggcauuacugaucgucuccgggauuuuuccauacucaauaccggccacucuccugguguggcacaccuggcauaaacagacacagcggagcggaguucuuugggauguaccuagucccccagaaacccaaaaggcugagcuggaagaggguguguauagaaucaaacagcagggcauuuucgggaagacacaggucggagugggcguucaaaaggaggguguguuucacacuauguggcacgucaccaggggggccguguugacguacaacggaaaacgacuagaacccaauugggcaucuguaaagaaagaccugaucuccuauggcggcggguggcgccucagcgcucaguggcagaagggagaggaaguccaagugauugccguugagccugguaaaaacccaaagaauuuccagacaaugcccggcacuuuccagaccacaaccggggaaaucggagcgauagcccuggauuuuaagccuggcacuucggguucaccgaucauuaaccgggaggggaaaguggucggacuuuacggcaauggcgugguuaccaagaacgggggauaugugucugguaucgcacagacaaaugcugagccagacggccccacgccugaauuagaggaagagauguucaaaaagagaaaccugacuauuauggaucuccauccagggaguggaaaaaccaggaaguacuugcccgccaucguccgugaagcuauaaagcgccggcugagaacacucauucuggcaccuaccagggugguagccgccgagauggaggaagcucuuaaaggccugccgauccgauaucaaacuacagcgaccaaguccgagcacacgggucgggaaaucguggacuugaugugccaugcaacuuuuacaaugcgccuacugagccccguuagagucccaaauuacaaccucauuaucauggaugaggcccacuucaccgacccugcuucuauagccgcaaggggguacauuagcacccgggugggaaugggcgaagccgcugcgaucuuuaugacugccacacccccaggcaccgcagaugcuuucccucaguccaaugcccccauucaggacgaggagcgagacaucccagaaagaucauggaacagugggaaugaguggauaacagauuuugcaggaaaaacugugugguucgucccgagcauuaaggccgguaacgacaucgcuaacuguuuacgcaaaaauggcaagaagguaauccagcugucuaggaaaacguuugauaccgaauaucaaaagacaaaacuuaacgacugggauuucgugguuacuaccgacauuuccgagaugggggccaauuuuaaggcggaucgugugaucgacccucggagaugccugaaacccgucauucucacagauggaccagagagggugauauuggcaggccccaugccuguuaccgccgcuucagccgcucagcgccgagguagaguggggcggaacccacagaaggaaaaugaccaguacaucuucacuggccaaccccugaacaaugaugaggaccaugcacacuggacggaagccaagaugcuccuggacaacauuaauaccccugagggaaucaucccggcucuuuucgaaccagagagggagaaaagugccgcaauugauggcgaauaucgccuaaagggggagagccguaaaacauuugucgaacugaugagacggggagacuugcccgugugguuagcgcacaagguagccuccgaggguauaaaauacacugauaggaaguggugcuucgacggccagcgcaacaaucagauccuggaagagaacauggauguggagauuuggaccaaagaaggggagaagaagaaacuccgaccuagauggcuggacgcucggacauauucugauccccuugcccugaaggaauuuaaagacuucgcagcuggaaggaagucgaucgcccucgauuugguuaccgagauuggccgcgucccaagccaucuggcacacagaacuaggaaugcccuagacaaccuggugaugcuccauacaucagaacacggugggaaagcuuaccggcacgcgguggaggagcuuccugaaacgauggagacccuguuauugcugggccucaugauccugcuuacuggaggcgccaugcuguuucucauauccgggaagggaaucgguaagacaaguauuggcuugaucugugucauugcaucuagcgggaugcuguggauggcugaaauccccuuacaguggauagccuccgccauuguucuagaguucuuuaugauggugcugcucaucccagagccugaaaaacaacguaccccgcaggauaaucagcuugcauauguagugauuggaauccugaccuuggcugccauaaucgcggcuaacgagaugggccugcucgaaacaacuaagcgcgaccuggguaugucaaaagagcccggggucgugucuccaacgagcuaccuugauguugaccuccauccugccagugcauggacccuguacgccguggcuacaacugucauuacccccauguugcgacacacaaucgaaaauuccaccgcaaacguaagccuggccgcgauugcuaaccaagccgugguuuuaaugggccuagacaagggauggccaaucucuaaaauggaucugggcgugccucuccuugcacuggggugcuauucacaggucaaucccuugacucugacggccgcugugcuccugcuuauaacacauuacgccauuaucggaccgggcuuacaggcaaaggcuaccagagaggcccagaagaggacugcggccgguaucaugaaaaacccaaccgucgacgggauuaugacaaucgaucuggacccugugauauaugauuccaaguucgagaaacaacucggacagguuauguugcuggugcuaugugcaguacagcugcuccuuaugcggacuaguugggcucugugcgaagccuugacccuggcaacaggccccauuacgacccucugggaggguagcccaggcaaguuuuggaauacuacaaucgcugugucgauggccaacauuuuccgcgggucuuaccuggccggagcgggcuuagcuuuuuccaucaugaaaagcgucgggaccggaaagagaggcacugguucacagggggaaacacuuggagagaaguggaaaaagaaacugaaucaacucaguaggaaggaauucgaccuauauaaaaagucuggcauaaccgagguugaucggacggaggcaaaagaaggucugaagcgaggcgagaucacccaccaugccguguccagagggagcgcuaaguugcagugguuugucgaacgcaacauggugauucccgagggaaggguaaucgaccugggcugugggcggggaggcuggucauacuauugcgccggucucaaaaaggugacagaaguucguggguacacuaaaggaggcccuggccacgaggagccggugcccaugaguaccuacggguggaauauugucaagcuuaugagcggaaaagauguguucuaucugccaccugaaaagugugacacauugcugugcgauaucggugaguccucucccagcccuacugucgaagaguccagaaccauuagggugcucaagaugguugagccaugguuaaaaaacaaucaguucuguaucaagguacugaaccccuacaugccuacagugauagaacaccuugagcgccugcagcggaaacauggcgggaugcuaguccgaaauccacucucaagaaacucuacccacgaaauguauuggauuaguaauggaacuggcaacaucguggcaucgguuaauauggugagcaggcuguugcugaaccgcuuuacgaugacacaucggagacccaccaucgagaaggacgucgaucucggugccgggacucgucacgugaacgcugaaccggagaccccuaauauggacguaauuggagagaggauaaaacggaucaaggaagagcacaacuccacauggcauuacgacgaugaaaauccauauaagacgugggcguaccacggcucuuaugaggugaaagccaccggcucagcaagcuccaugauuaacgggguugucaagcuucugacuaaacccugggacguggugccuauggucacacaaauggcuaugaccgauacuacaccauucggacagcagcgcguuuuuaaggaaaaaguggacacccgaacacccagaaguaugccggguacuaggcggguaaugggcaucaccgccgagugguuauggcgcacgcuggggagaaauaagaagccuagguugugcacccgagaggaauucacaaaaaaggugcggacuaacgcagccaugggagcugucuuuaccgaggaaaaucaaugggauucugccaaagcggcaguggaggacgaagauuucuggaagcucguugaccgugagagagagcugcauaaacuaggcaagugugguagcugcguguacaacaugauggggaaacgcgaaaagaagcuuggagaguuuggcaaagccaagggcucaagggcuauuugguacauguggcugggggcccgguaucucgaauucgaggcacugggauuuuugaaugaggaucacugguucuccagagaaaacaguuacagcggugucgagggcgaagggcugcauaaacucggauauauccuucgcgacauaucuaagauccccggcggugcuauguacgccgaugacacagcugggugggacacuaggauuaccgaggaugaccugcacaaugaagagaaaaucacgcagcagauggauccagagcaccgacaguuagccaacgcaauuuuuaagcugacauaucaaaauaaggugguaaaaguucagcggccuacccccacuggaacagugauggacaucauauccagaaaggaucagaggggcucaggccaggucgggaccuacggauugaacacuuucaccaauauggaagcgcaacucauucgccagauggagggugaaggcgugcugagcaaagccgaccuagagaacccacaucuucccgaaaagaaaaucacacaguggcuggagacgaaggggguggagcgucucaagcggauggcuaucucgggagaugacugcgucguuaaaccuauugaugacagauuugccaacgcacuguuggcuuuaaaugauaugggcaaggugaggaaagacauaccacaguggcaaccgucuaaggguuggcacgauuggcagcagguacccuucuguagucaucacuuccacgaacugaucaugaaagacgggcgcaagcucguggucccuugccgaccacaggacgagcuuauuggacgggccagaaucucccaaggcgcaggcuggagccugagggaaaccgccugucuagggaaggcguaugcucagauguggucacugauguacuuucaucgcagagaucuccgguuggccuccaacgcaauuugcucugccgugcccguucacugggugccuacuagcaggacaaccuggaguauccaugcucaccaucaguggaugacuacagaggacaugcugaccgucuggaaucguguguggauagaagauaacccauggauggaggacaaaacgcccguaacaaccugggagaauguuccuuaccuuggaaagcgagaagaucaauggugugguucccugaucggccucacuagccgcgccaccugggcacagaacauuccgacagcuauccagcaggugagaucuuuaauugggaaugaggaauuccuggacuauaugccaucaaugaaacgguuuaggaaggaggaggaaagugagggagccaucugguga

SEQ ID NO: 15464 - RNA, 9873 nt, Artificial Sequence
  derived and/or modified CDS sequence (opt3) from DENV-3__FJ547080__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccagcaugaaaaucugaaguauacagugauuaucacuguucacaccggugaccagcaucaggugggcaacgagacacaaggggucaccgcagaaauuacuccucaggcuuccacgacagaggccauccucccagaauacggaacccuuggccuggagugcucuccgcgaacugguuuggacuucaaugagaugauccuacugaccaugaaaaacaaggcguggauggugcacagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcauacugcucucacaggcgccaccgaaauucagaauucagggggaacaaguauauucgcaggucaccugaagugucgguuaaaaauggacaagcuggagcuaaaaggcaugagcuaugccaugugcacuaacaccuuugugcucaagaaagaggucucugaaacgcagcaugggaccauccugauuaagguggaguacaagggagaagauguucccuguaaaaucccuuucuccacagaggacggccaagguaaggcucacaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguacaagaaggggagcaguauuggaaaaauguuugaagcuacagcccgcggugcaagaaggauggccauacugggcgacacugcuugggauuucgggucuguuggaggcgugcucaacucccuggguaagaugguccaucagaucuuugggagcgccuauaccgcacuuuucucgggcgugucuuggguaaugaaaauuggaaucggcgugcuguugacguggaucgggcucaauuccaagaacacaucaaugaguuuuagcugcauuguuauaggaaucauuacccuguacuuaggcgcggucgugcaggcugacauggguugugugaucaauuggaaagggaaggagcugaagugcggauccggcauuuucgucacuaacgagguucacacauggaccgaacaguauaaauuucaagccgauucucccaagcggcuagcaacugccaucgcuggugccugggagaauggcgugugugggauacgaagcaccacacgcauggaaaaccuccuguggaaacagaucgcaaaugagcuuaacuacauuuugugggaaaauaacaucaagcugacggugguagucggagacauuaucggcgugcucgagcaggggaaaagaacccugacuccacagccuauggaguuaaaguauucauggaaaacauggggaaaggcuaagauaguuaccgccgaaacacaaaacaguuccuucauuaucgauggccccaauacuccagagugccccagcgcgucuagggccuggaacgugugggaagucgaggacuacgguuuugggguguucaccacgaauauuuggcugaaacuucgggaaguuuauacacaguugugugaccaccgccucaugucagcugcagugaaggaugagagagccguacaugcugacaugggauacuggaucgagagucagaaaaacggcagcuggaagcuggaaaaagccucccuaauagaggucaagaccugcacuuggccuaagucucacacccuguggucgaauggugugcucgaaagcgauaugaucauuccaaaaucccuggcaggcccgaucucacagcauaacuacaggcccggguaucacacacaaacugcgggaccuuggcaccuuggcaaguuggagcuggacuuuaauuacugcgaggggaccacaguggucauuacggaaaacuguggaacccguggcccaaguuuacggacuacaaccguuucugguaaacucauccaugaguggugcugucgaagcugcacucugcccccucuuagauauaugggggaagauggauguugguacggcauggagauaaggccaauuuccgaaaaggaggagaauauggugaaaucacugguaagcgccgguucuggcaagguggacaacuucacaaugggggucuugugccucgcuauccuguuugaagaggugaugcgcggaaaguucggcaaaaagcacaugaucgccgggguuuucuuuaccuucgugcuacugcucuccggacagauuacguggcgggauauggcacauacucugaucaugauuggcaguaaugcuagcgacagaauggguaugggggucaccuaucuugccuugauagcaacauuuaaaauccagcccuuccuggccuuaggauuuuuccucaggaagcugaccucucgcgaaaaccuucugcuaggcgugggccucgcuauggcgacuacacugcaauugccggaggauauugaacagauggccaaugggaucgcacugggauuaauggcucucaaacugauuacccaguuugagacauaccagcuuuggacugcccugaucuccuugaccuguucaaacacgauauucacacucaccguugccuggcgaacugcuacccugauccuagcaggugugagucugcuuccugucugccaaagcucguccaugcggaagacagacuggcucccaaugacuguagccgcgaugggcgugcccccucugcccuuguuuauuuucucucugaaggauaccuuaaaacguagaagcuggccacucaaugaggggguuauggcugugggacuggucucaauccuugccaguucccuguugaggaacgacgugccuauggcaggcccccucguagccggugggcugcuaauugcuuguuaugugaucacgggaacaucugcagaucugaccgucgaaaaggccgcggacguuacuugggaggaagaggcugaacagacaggcgugagccacaaccuuaugauaaccguggacgaugacggcacuaugcgcauuaaagaugacgagacagagaauauccucaccguccuguugaagacggccuuacugaucguguccgggauuuuuccauacucaauaccggcaacucuccugguuuggcauaccuggcagaaacagacacaacggagcggaguacuuugggaugugccuagucccccagaaacccagaaggccgagcuggaagagggugucuacagaaucaaacagcagggcauuuucgggaagacacaagugggaguuggcgugcagaaggagggugucuuucacacuauguggcacgugaccaggggggcuguauugacguauaacggaaaacgacuagaacccaauugggccucugucaagaaagaccugaucuccuacggcggcggguggcgccucagcgcacaguggcaaaagggagaggaagugcagguuauugcuguggagccugguaaaaacccaaagaauuuccagacaaugcccggcacuuuccagaccacaaccggggaaaucggagccauagcgcuggauuuuaagccuggcacuucggguucaccgaucauuaaccgggaggggaaagucgugggacuuuauggcaauggcguugugaccaagaacgggggauacgucucugguaucgcccaaacaaaugcagagccagacggccccacgccugaauuagaggaagagauguucaaaaagagaaaccugacuauuauggaucuccauccagggaguggaaaaaccaggaaguauuugcccgcuaucgugcgugaagccauaaagcgccggcugagaacacucauucuggcuccuaccaggguaguggcagccgagauggaggaagcccuuaaaggccugccgauccgauaccagacuacagcuaccaaguccgagcacacgggucgggaaaucguugacuugaugugccaugcgacuuuuacaaugcgccuacugagccccgucagagugccaaauuauaaccucauuaucauggaugaggcacacuucaccgacccugccucuauagcugccaggggguacauuagcacccgggugggaaugggcgaagcagccgcuaucuuuaugacugcgacacccccaggcaccgccgaugcauucccucaguccaaugcucccauucaggacgaggagcgagacaucccagaaagaucauggaacagugggaaugaguggauaacagauuuugccggaaaaacugucugguucguaccgagcauuaaggcagguaacgacaucgccaacuguuuacgcaaaaauggcaagaaggugauccaacugucuaggaaaacguuugauaccgaauaccagaagacaaaacuuaacgacugggauuucguugugacuaccgacauuuccgagaugggggcuaauuuuaaggccgaucgugucaucgacccucggagaugccugaaacccgugauucucacagauggaccagagaggguuauauuggcgggccccaugccugugaccgcagccucagcugcccagcgccgagguagagucgggcggaacccaaggaaggaaaaugaccaguauaucuucacuggccaaccccugaacaaugaugaggaccaugcucacuggacggaagcaaagaugcuccuggacaacauuaauaccccugagggaaucaucccggcccuuuucgaaccagagcgcgagaaaagugcugccauugauggcgaauaccgucuaaagggggagagcagaaaaacauuuguggaacugaugcggaggggagacuugcccguaugguuagcacacaagguggcguccgaggguauaaaauauacugaucgcaaguggugcuucgacggccagcgaaacaaucagauccuggaagagaacauggauguugagauuuggaccaaagaaggggagaagaagaaacucagaccucgguggcuggacgccaggacauacucugauccccuugcucugaaggaauuuaaagacuucgccgcaggacgcaagucgaucgcucucgauuuggucaccgagauuggcagagugccaagccaucuggcccacaggacucggaaugcacuagacaaccuggugaugcuccauacaucagaacacggugggaaagccuaucgucacgcugucgaggagcuuccugaaacgauggagacccuguuauugcugggccucaugauccugcuuacuggaggcgcgaugcuguuucucauauccgggaagggaaucgguaagacaaguauuggcuugaucuguguuauugccucuagcgggaugcuguggauggcagaaauccccuuacaguggauagcuuccgccauugugcuagaguucuuuaugaugguacugcucaucccagagccugaaaaacaacgcaccccgcaggauaaucagcuugccuacguggucauuggaauccugaccuuggcagcuauaaucgccgcgaacgagaugggccugcucgaaacaacuaagcgagaccuggguaugucaaaagagcccggggugguuucuccaacgagcuaucuugauguggaccuccauccugcuagugccuggacccuguacgcagucgccacaacuguaauuacccccauguugagacacacaaucgaaaauuccaccgcuaacgugagccuggcagccauugcgaaccaagcuguuguguuaaugggccuagacaagggauggccaaucucuaaaauggaucugggcgucccucuccuugcccuggggugcuacucacaggugaaucccuugacucugacggcagccguccuccugcuuauaacacauuaugcuauuaucggaccgggcuuacaggccaaggcaaccagggaggcucagaagcggacugccgcggguaucaugaaaaacccaaccguggacgggauuaugacaaucgaucuggacccuguuauauacgauuccaaguucgagaaacaacucggacaggugauguugcugguacuaugugccgugcagcugcuccuuaugcgcacuaguugggcacugugcgaagcuuugacccuggccacaggccccauuacgacccucugggaggguagcccaggcaaguuuuggaauacuacaaucgcagucucgauggcuaacauuuucagagggucuuaucuggccggagccggcuuagcguuuuccaucaugaaaagcguugggaccggaaagaggggcacugguucacagggggaaacacuuggagagaaguggaaaaagaaacugaaucaacucagucggaaggaauucgaccuauacaaaaagucuggcauaaccgagguggaucgaacggaggcuaaagaaggucugaagagaggcgagaucacccaccaugcagucucccgcgggagcgccaaguugcagugguuuguggaaaggaacaugguaauucccgagggacgggugaucgaccugggcugugggcguggaggcuggucauauuacugcgcuggucucaaaaagguuacagaagugagaggguauacuaaaggaggcccuggccacgaggagccgguccccaugaguaccuacggguggaauauugugaagcuuaugagcggaaaagaugucuucuaccugccaccugaaaagugugacacauugcugugcgauaucggugaguccucucccagcccuacuguggaagaguccaggaccauucgcguucucaagaugguagagccaugguuaaaaaacaaucaguucuguaucaaggugcugaaccccuauaugccuacagucauagaacaccuugagcggcugcagcgaaaacauggcgggaugcuagugagaaauccacucucaaggaacucuacccacgaaauguacuggauuaguaauggaacuggcaacaucguugccucggugaauauggucagccgccuguugcugaaccgguuuacgaugacacauagacgucccaccaucgagaaggacguggaucucggugcagggacuaggcacguaaacgccgaaccggagaccccuaauauggacgugauuggagagcggauaaaacgcaucaaggaagagcacaacuccacauggcauuaugacgaugaaaauccauacaagacgugggcuuaucacggcucuuacgagguuaaagcgaccggcucagccagcuccaugauuaacggggucgugaagcuucugacuaaacccugggacguggucccuaugguuacacaaauggcaaugaccgauacuacaccauucggacagcagcgaguguuuaaggaaaaaguagacaccagaacacccaggaguaugccggguacucggcgcgugaugggcaucaccgcugagugguuauggagaacgcuggggaggaauaagaagccucgauugugcacccgggaggaauucacaaaaaagguccguacuaacgccgcaaugggagccguguuuaccgaggaaaaucaaugggauucugcuaaagccgcgguugaggacgaagauuucuggauucucguggacagagagcgcgagcugcauaagcuaggcaaaugugguagcugcgucuauaacaugauggggaagagggaaaaaaagcuuggagaguuuggcaaggcaaaaggcucacgggccaucugguacauguggcugggggcuagauaccucgaauucgaggcccugggauuuuugaaugaggaucacugguucucccgcgaaaacaguuauagcgguguggagggcgaagggcugcauaagcucggauacauacuuagggacaucucuaaaauucccggcggugcaauguaugcugaugacacagccgggugggacacucgaaucaccgaggaugaccugcacaaugaagagaagauuacgcagcagauggauccagagcaccggcaguuagcuaacgccaucuuuaaacugacauaccaaaauaagguaguuaaggugcagagaccuacccccacuggaacagucauggacauaauuuccaggaaagaucagcgcggcucaggccagguggggaccuauggauugaacacuuucaccaauauggaagcacaacucauccgucagauggagggugaaggcgugcugagcaaggcggaccuagagaacccacaucuucccgaaaaaaagaucacacaguggcuggagacgaaaggggucgagcggcucaagagaauggccauuucgggagaugacugcguugugaagccuauagaugacagguuugcuaacgcccuguuggcauuaaaugauaugggcaaaguacgcaaggacaucccacaguggcaaccgucuaaagguuggcacgauuggcagcaggugcccuucuguagucaucacuuccacgaacugauuaugaaggacgggcgaaaacucgucgugccuugccggccacaggacgagcuuaucggaagagcuaggauuucccaaggcgccggcuggagccugcgcgaaaccgcaugucuagggaaggccuacgcgcagauguggucacugauguauuuucauagacgggaucucagguuggcuuccaacgccaucugcucugcaguucccgugcacugggucccuacuagccguacaaccuggaguauacaugcccaccaucaguggaugacuacagaggacaugcugaccguguggaaucgaguauggaucgaagauaacccauggauggaggacaagacgcccguuacaaccugggagaaugugccuuaccuuggaaaacgcgaagaucaauggugugguucccugauuggccucacuagcagagcuaccugggcccagaacaucccgacagcaauucagcagguccggucuuuaaucgggaaugaggaauuccuggacuacaugccaucaaugaagagguuucgcaaagaggaggaaagugagggagcuauuugguga

SEQ ID NO: 15465 - RNA, 9873 nt, Artificial Sequence
  derived and/or modified CDS sequence (opt3) from DENV-3__FJ547081__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucagcggucaucugaagugucgguuaaaaauggacaagcuggagcuaaaaggcaugucuuacgcaaugugcacuaacaccuuugugcucaagaaagaggucuccgaaacgcagcacgggaccauccugauuaagguggaguacaagggagaagauguucccuguaaaaucccuuucucaacagaggacggccaagguaaggcccauaacgggcgucuuauaacugcuaauccagugguaaccaaaaaggaggaacccgucaacauugaggcggaaccgccuuucggcgagagcaauaucgugaucggaauuggcgauaacgcauugaaaaucaauugguauaagaaggggaguucuauuggaaaaauguuugaagccacagcucgcggugccagaaggauggcaauacugggcgacacugccugggauuucggguccguuggaggcgugcucaacagccuggguaagaugguccaccagaucuuugggucggcuuacaccgcccuuuucucuggcguguccuggguaaugaaaauuggaaucggcgugcuguugacguggaucgggcucaauucaaagaacacaaguaugagcuuuuccugcauugcaauaggaaucauuacccuguauuuaggcgcgguuguccaggcugacauggguugugugaucaauuggaaagggaaggagcugaagugcggaucuggcauuuucgugacuaacgagguccauacauggaccgaacaguacaaauuucaagccgauagccccaagcggcuagcaacugccaucgcuggugccugggagaauggcguuugugggauacgaucaaccacacgcauggaaaaccuccuguggaaacagaucgcaaaugagcuuaacuauauuuugugggaaaauaacaucaagcugacgguggugguaggagacauuaucggcguccucgagcaggggaaaagaacccugacuccacagccuauggaguuaaaguacaguuggaaaacauggggaaaggcuaagauagugaccgccgaaacacaaaacuccagcuucauuaucgauggccccaauacuccagagugccccucugcgucaagggccuggaacguuugggaaguggaggacuaugguuuuggggucuucaccacgaauauuuggcugaaacuucgggaaguguacacacaguugugugaccaccgccucaugagugcugcaguuaaggaugagagagccgugcacgcugacaugggauacuggaucgagagccagaaaaacggcuccuggaagcuggaaaaagccucucuaauagagguaaagaccugcacuuggccuaagucgcauacccuguggagcaaugguguccucgaauccgauaugaucauuccaaaaucacuggcaggcccgaucagucagcacaacuauaggcccggguaccauacacaaacugcgggaccuuggcaccuuggcaaguuggagcuggacuuuaauuauugcgaggggaccacaguggugauuacggaaaacuguggaacccguggcccaucuuuacggacuacaaccgucagcgguaaacucauccacgaguggugcugucgauccugcacucugcccccucuuagauacaugggggaagauggauguugguauggcauggagauaaggccaauuucagaaaaggaggagaauaugguuaaaagccuggugucugccgguuccggcaagguagacaacuucacaauggggguguugugccucgcuauccuguuugaagaggucaugcgcggaaaguucggcaaaaagcauaugaucgccgggguguucuuuaccuucguucuacugcucaguggacagauuacguggcgggauauggcacacacucugaucaugauuggcagcaaugcuucugacagaauggguaugggggugaccuaccuugccuugauagcaacauuuaaaauccagcccuuccuggccuuaggauuuuuccucaggaagcugaccucccgcgaaaaccuucugcuaggcgucggccucgcuauggcgacuacacugcaauugccggaggauauugaacagauggccaaugggaucgcacugggauuaaugacccucaaacugauuacacaguuugagacuuaucagcuuuggaccgcucugaucucauugacguguaguaacacaauauucacccucacuguggccuggcgaaccgccacacugauccuagcugguguuagccugcuuccugugugccaaucguccucuaugcggaagacugacuggcucccaaugaccgucgcagccaugggcguacccccucugcccuuguuuauuuucagccugaaggauacguuaaaacguagaucauggccacucaaugagggggugauggcgguuggacuggugaguauccuugcuuccucucuguugaggaacgacgucccuauggccggcccccucguggcaggugggcugcuaauugccuguuacguaaucacaggaaccagcgcugaucugacuguggaaaaggcagccgacgucacaugggaggaagaggcggaacagaccggcguuucccauaaccuuaugauaacuguggacgaugacggcacaaugcgcauuaaagaugacgagaccgagaauauccucacggugcuguugaagacugcuuuacugaucgucucagggauuuuuccauacagcauaccggccacccuccugguguggcacacauggcagaaacagacccaacggaguggaguucuuugggauguaccuucucccccagaaacacagaaggcagagcuggaagaggguguguauagaaucaaacagcagggcauuuucgggaagacucaagucggagugggcguucagaaggaggguguguuucauaccauguggcacgucacgaggggggccguguugacauacaacggaaaacgacuagaacccaauugggcuuccguaaagaaagaccugaucagcuauggcggcggguggcgccucucggcccaguggcaaaagggagaggaaguccaggugauugcaguugagccugguaaaaacccaaagaauuuccagacuaugcccggcaccuuccagacaaccacuggggaaaucggagcuauagcccuggauuuuaagccuggcaccucagguucuccgaucauuaaccgggaggggaaaguggucggacuuuacggcaauggcgugguuacaaagaacgggggauaugugagugguaucgcgcaaacgaaugccgagccagacggccccacuccugaauuagaggaagagauguucaaaaagagaaaccugaccauuauggaucuccacccaggguccggaaaaacaaggaaguacuugcccgcaaucguccgugaagcuauaaagcgccggcugagaacccucauucuggccccuacuagggugguagcugcagagauggaggaagcccuuaaaggccugccgauccgauaucagacaaccgccacgaagagcgagcauacuggucgggaaaucguggacuugaugugccacgcuacauuuaccaugcgccuacugucucccguuagagucccaaauuacaaccucauuaucauggaugaggcgcauuucaccgacccugcaagcauagccgcuaggggguacauuuccacucgggugggaaugggcgaagccgcagccaucuuuaugacagcuacccccccaggcacagcggaugccuucccucagucaaaugcacccauucaggacgaggagcgagacaucccagaaagaaguuggaacagcgggaaugaguggauaacugauuuugcuggaaaaacggugugguucgucccgucuauuaaggccgguaacgacaucgcaaacuguuuacgcaaaaauggcaagaagguaauccaacuguccaggaaaaccuuugauacagaauaucagaagacuaaacuuaacgacugggauuucgugguuaccacagacauuucagagaugggggccaauuuuaaggcugaucgugugaucgacccucggagaugccugaaacccgucauucucaccgauggaccagagagggugauauuggccggccccaugccuguuacugcggcaagugccgcucagcgccgagguagaguggggcggaacccacagaaggaaaaugaccaauacaucuucacgggccagccccugaacaaugaugaggaccacgcccauuggaccgaagcuaagaugcuccuggacaacauuaauacaccugagggaaucaucccggcacuuuucgaaccagagagggagaaaagcgccgcuauugauggcgaauaucgccuaaagggggagucccguaaaacuuuugucgaacugaugagacggggagacuugcccgugugguuagcccacaagguagcaucugaggguauaaaauacgcggauaggaaguggugcuucgacggccagcgcaacaaucagauccuggaagagaacauggauguggagauuuggaccaaagaaggggagaagaagaaacuccgaccuagauggcuggacgcccggacauauucggauccccuugcucugaaggaauuuaaagacuucgccgcaggaaggaagagcaucgcucucgauuugguuaccgagauuggccgcgucccaucacaccuggcccauagaacuaggaaugcacuagacaaccuggugaugcuccacacauccgaacauggugggaaagccuaccggcacgcuguggaggagcuuccugaaacgauggagacccuguuauugcugggccucaugauccugcuuacuggaggcgcgaugcuguuucucauaagugggaagggaaucgguaagacaucuauuggcuugaucugugucauugccagcuccgggaugcuguggauggcagaaauccccuuacaauggauagcuucagccauuguucuagaguucuuuaugauggugcugcucaucccagagccugaaaaacagcguaccccgcaggauaaucaacuugccuauguagugauuggaauccugaccuuggcagcuauaaucgccgcgaacgagaugggccugcucgaaacaacuaagcgcgaccuggguaugucuaaagagcccggggucgugagcaguacguccuaccuugauguugaccuccacccagcuagcgccuggacccuguacgcaguggccacaacugucauuaccccuauguugcgacauacaaucgaaaauucuaccgcuaacguaucacuggcagccauugcgaaccaggcugugguuuuaaugggccuagacaagggauggcccaucuccaaaauggaucugggcgugccacuccuugcccuggggugcuauagucaggucaauccuuugacucugacggcagccgugcuccugcuuauaacacacuacgcuauuaucggacccggcuuacaggccaaggcaaccagagaggcucaaaagaggacugccgcggguaucaugaaaaacccgaccgucgacgggauuaugacaaucgaucuggacccagugauauaugauagcaaguucgagaaacagcucggacagguuauguugcuggugcuaugugccguacagcugcuccuuaugcggacuucgugggcacugugcgaagcuuugacccuggccacaggcccuauuacgacccucugggaggguucucccggcaaguuuuggaauacuacaaucgcaguguccauggcuaacauuuuccgcgggagcuaccuggccggagccggcuuagcguuuucaaucaugaaaagugucgggaccggaaagagaggcacugguucucaaggggaaacacuuggagagaaguggaaaaagaaacugaaucagcucuccaggaaggaauucgaccuauauaaaaagagcggcauaaccgagguugaucggacggaggcuaaagaaggucugaagcgaggcgagaucacccaucacgcagugucaagagggagugccaaguugcagugguuugucgaacgcaacauggugauuccagagggaaggguaaucgaccugggcugugggcggggaggcuggagcuacuauugcgcuggucucaaaaaggugacagaaguucguggguacacuaaaggaggccccggccaugaggagccugugccgauguccaccuacggguggaauauugucaagcuuaugucuggaaaagauguguucuaucugcccccagaaaagugugacacauugcugugcgauaucggugagagcuccccuucacccacugucgaagagucuagaaccauuagggugcucaagaugguugagccuugguuaaaaaacaaucaguucuguaucaagguacugaacccauacaugcccacagugauagaacaccuugagcgccugcaacggaaacacggcgggaugcuaguccgaaauccucucaguagaaacucgacccaugaaauguauuggauuagcaauggaacuggcaacaucguggccuccguuaauauggugucuaggcuguugcugaaccgcuuuacgaugacacaccggagaccaaccaucgagaaggacgucgaucucggugcagggacucgucaugugaacgccgaacccgagaccccgaauauggacguaauuggagagaggauaaaacggaucaaggaagagcacaacucaacauggcacuacgacgaugaaaauccuuauaagacgugggcuuaccauggcagcuaugaggugaaagcgaccggcuccgccaguucuaugauuaacgggguugucaagcuucugacuaaaccaugggacguggugcccauggucacacagauggcaaugaccgauacuacaccuuucggacagcaacgcguuuuuaaggaaaaaguggacacccgaacaccaagaagcaugcccgguacuaggcggguaaugggcaucaccgcugagugguuauggcgcacgcuggggagaaauaagaagccgagguugugcacccgagaggaauucacaaaaaaggugcggacuaacgccgcaaugggagccgucuuuaccgaggaaaaucagugggauucagcuaaagccgcgguggaggacgaagauuucuggaagcucguugaccgugagagagagcugcacaaacuaggcaagugugguuccugcguguacaacaugauggggaaacgcgaaaagaagcuuggagaguuuggcaaagcaaagggcaguagggccauuugguacauguggcugggggcucgguaucucgaauucgaggcccugggauuuuugaaugaggaucauugguucagcagagaaaacucuuacuccggugucgagggcgaagggcugcacaaacucggauauauccuucgcgacauaucaaagaucccuggcggugcaauguacgcugaugacacagccgggugggacacuaggauuaccgaggaugaccugcauaaugaagagaaaaucacgcagcagauggaucccgagcaccgacaauuagcuaacgccauuuuuaagcugacauaucagaauaaggugguaaaaguucagcggccaaccccuacuggaacagugauggacaucauaagcagaaaggaucagaggggcucgggccaagucgggaccuacucuuugaacacuuucaccaauauggaagcacagcucauucgccagauggagggagaaggugugcugaguaaagcggaccuagagaacccccaccuuccagaaaagaaaaucacacaguggcuggagacgaagggcguggagcgucucaagcggauggccaucuccggggaugacugcgucguuaaacccauugaugacagauuugcuaacgcccuguuggcauuaaaugauaugggaaaggugaggaaagacauaccucaauggcagccaagcaagggcuggcaugauuggcagcagguaccguucuguucacaccauuuccacgaacugaucaugaaagacggucgcaagcucgugguccccugccgaccucaagacgagcuuauugggcgggcuagaaucucccagggagccggcuggucucugagggaaaccgcaugucuaggcaaggccuaugcgcagauguggagccugauguacuuucaccgcagagaucuccgguuggcuaguaacgccauuugcuccgcagugccaguucauugggugcccacuagcaggacaaccuggucuauccacgcccaucaccaauggaugacuacagaggacaugcugaccgucuggaaucguguguggauagaagauaacccuuggauggaggacaaaacgccaguaacaaccugggagaauguucccuaccuugggaagcgagaagaucagugguguggaucacugaucggucucacuagucgcgcuaccugggcccagaacauuccuacagcaauccagcaagugagauccuuaauuggcaaugaggaauuccuggacuauaugccgagcaugaaacgguuuaggaaggaggaggaaucugagggggcuaucugguga

SEQ ID NO: 15466 - RNA, 9873 nt, Artificial Sequence
  derived and/or modified CDS sequence (opt3) from DENV-3__FJ547082__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauugcugaaguugagccggaagacaucgauugcugguguaaccugacuaguaccugggugacauaugggaccugcaaucaggccggagagcaccgccgagacaagcguagcguagcacuugccccccaugugggcaugggucuggauacuagaacacaaaccuggauguccgcugagggggcauggaggcaggucgaaaaaguggagacgugggccuugcggcacccuggauucacuauucucgcucuguuucuggcccauuacaucggcaccucucucacacagaagguugugauauucaucuuacugaugcuugucacuccaucgaugaccaugcgcugugugggcguagggaacagagacuuuguugaaggauugucaggugcgacauggguggaugucgugcuggagcacggcgggugcgugaccacgauggcaaagaauaaacccacucuagacauugagcuccagaagacagaagccacccaacuggcuacucuuaggaaacuguguaucgagggaaagauuacaaacaucaccacggauagccggugcccuacccagggcgaagccgucuugccagaggaacaggaccagaauuauguuuguaaacacacauacguggaucgcgguugggggaacggaugcggccucuucggcaaggggagucugguaacuugcgcaaaguuucaauguuuagagcccauagagggaaaagugguccaguaugaaaaucugaaguacaccgugauuaucacaguucauacuggugaccagcaccaggugggcaacgagacccaaggggucacagcugaaauuaccccucaggccuccacuacggaggcgauccucccagaauauggaacacuuggccuggagugcucuccgcgaaccgguuuggacuucaaugagaugauccuacugacuaugaaaaacaaggccuggauggugcauagacagugguuuuucgaucucccccugccuuggaccagcggggcaacaaccgaaacuccaacauggaauaggaaagagcuucugguaacguuuaagaacgcucacgccaaaaagcaagaaguuguggucuugggcucccaggagggagcuaugcacaccgcccucacuggcgcaacagaaauucagaauucagggggaaccaguauauucgccggucaucugaagugucgguuaaaaauggacaagcuggagcuaaaaggcaugagcuacgcuaugugcacaaacacuuuugugcucaagaaagaggucucugaaacccagcacgggacgauccugauuaagguggaguacaagggagaagauguucccuguaaaaucccuuucuccaccgaggacggccaagguaaggcgcauaacgggcgucuuauaacagcaaauccagugguaacuaaaaaggaggaacccgucaacauugaggccgaaccgccuuucggcgagucaaauaucgugaucggaauuggcgauaacgcuuugaaaaucaauugguauaagaaggggagcaguauuggaaaaauguuugaagccaccgcacgcggugccagaaggauggcuauacugggcgacacagccugggauuucgggucuguuggaggcgugcucaacucccuggguaagaugguccaccagaucuuugggagcgcauacacugcgcuuuucucgggcgugucuuggguaaugaaaauuggaaucggcgugcuguugaccuggaucgggcucaauuccaagaacacgucaaugaguuuuagcugcauugcuauaggaaucauuacacuguauuuaggcgccguuguccaggcagacaccgguugugugaucaauuggaaagggaaggagcugaagugcggauccggcauuuucgugacuaacgagguccauacauggaccgaacaguacaaauuucaagccgauucucccaagcggcuagcuacugccaucgcaggugcuugggagaauggcguuugugggauacgaagcaccacacgcauggaaaaccuccuguggaaacagaucgccaaugagcuuaacuauauuuugugggaaaauaacaucaagcugacgguggugguaggagacauuaucggcguccucgagcaggggaaaagaacccugacuccacagccuauggaguuaaaguacucauggaaaauguggggaaaggcgaagauagugacagccgaaacccaaaacaguuccuucauuaucgauggccccaauacaccagagugccccagcgcuucuagggcauggaacguuugggaaguggaggacuaugguuuuggggucuucacuaccaauauuuggcugaaacuucgggaaguguacacgcaguugugugaccaccgccucaugucagccgcuguuaaggaugagagagccgugcacgcagacaugggauacuggaucgagagucagaaaaacggcagcuggaagcuggaaaaagcgucccuaauagagguaaagacaugcaccuggccuaagucucauacucuguggucgaaugguguccucgaaagcgauaugaucauuccaaaaucccuggccggcccgaucucacagcacaacuauaggcccggguaccauacccaaacagcuggaccuuggcaccuuggcaaguuggagcuggacuuuaauuauugcgaggggacuaccguggugauuacagaaaacuguggaacgcguggcccaaguuuacggaccacuacagucucugguaaacucauccacgaguggugcugucgaagcugcacccugcccccucuuagauacaugggggaagauggauguugguauggcauggagauaaggccaauuuccgaaaaggaggagaauaugguuaaaucacuggugagcgccgguucuggcaagguagacaacuucacuauggggguguugugccucgcaauccuguuugaagaggucaugcgcggaaaguucggcaaaaagcauaugaucgcugggguguucuuuacauucguucuacugcucuccggacagauuaccuggcgggauauggcccacacgcugaucaugauuggcaguaaugcaagcgacagaauggguaugggggugacuuaccuugccuugauagcuaccuuuaaaauccagcccuuccuggcguuaggauuuuuccucaggaagcugacaucucgcgaaaaccuucugcuaggcgucggccucgccauggcaaccacucugcaauugccggaggauauugaacagauggcuaaugggaucgcccugggauuaauggcccucaaacugauuacacaguuugagaccuaucagcuuuggacagcucugaucuccuugacuuguucaaacaccauauucacgcucacaguggcauggcgaaccgccacucugauccuagcggguguuagucugcuuccugugugccaaagcucguccaugcggaagucugacuggcucccaaugaccgucgcugccaugggcguacccccucugcccuuguuuauuuucagccugaaggauacauuaaaacguagaucauggccacucaaugagggggugauggcaguuggacuggugaguauccuugccuccucucuguugaggaacgacgucccuauggcuggcccccucguggcaggugggcugcuaauugccuguuacguaaucacuggaaccagcgcggaucugacgguggaaaaggcugccgacgucacaugggaggaagaggcagaacagaccggcguuucccauaaccuuaugauaacuguggacgaugacggcacaaugcgcauuaaagaugacgagaccgagaauauccucacugugcuguugaagacagccuuacugaucgucucagggauuuuuccauacagcauaccggcuacccuccugguguggcacacguggcagaaacagacucggagaaguggaguucuuugggauguaccuucucccccagaaacccaaaaggccgagcuggaagaggguguguauaggaucaaacagcagggcauuuucgggaagacacaggucggagugggcguucaaaaggaggguguguuucauaccauguggcacgucacacgaggggcaguguugacuuacaacggaaaacgccuagaacccaauugggcuuccguaaagaaagaccugaucagcuauggcggcggguggcggcucucggcccaguggcagaagggagaggaaguccaagugauugcgguugagccugguaaaaacccaaagaauuuccagaccaugcccggcacguuccagacaacuaccggggaaaucggagccauagcacuggauuuuaagccuggcacaucagguucuccgaucauuaacagagaggggaaaguggucggacuuuacggcaauggcgugguuaccaagaacgggggauaugugagugguaucgcucagacuaaugccgagccagacggccccaccccugaauuagaggaagagauguucaaaaagaggaaccugacaauuauggaucuccacccaggguccggaaaaacgcguaaguacuugcccgcuaucguccgcgaagcaauaaagcggagacugaggacucucauucuggccccuacccgagugguagccgcugagauggaggaagcgcuuaaaggccugccgauccgguaucaaacaaccgcaacuaagagcgagcauacaggucgcgaaaucguggacuugaugugccacgccaccuuuacgaugagacuacugucucccguuagggucccaaauuacaaccucauuaucauggaugaggcucauuucacugacccugccagcauagcagcccggggguacauuuccacacgagugggaaugggcgaagcugcggccaucuuuaugaccgcaacccccccaggcacugcugaugccuucccucagucaaaugcacccauucaggacgaggagagagacaucccagaacgcaguuggaacagcgggaaugaguggauaacagauuuugccggaaaaaccgugugguucgucccgucuauuaaggcugguaacgacaucgccaacuguuuaaggaaaaauggcaagaagguaauccagcugucccguaaaacauuugauacugaauaucaaaagacgaaacuuaacgacugggauuucgugguuaccacagacauuucagagaugggggcgaauuuuaaggcagaucgggugaucgacccuagaaggugccugaaacccgucauucucacugauggaccagagcgcgugauauuggccggccccaugccuguuaccgcugccagugcugcacagcgaagaggucggguggggaggaacccacagaaggaaaaugaccaguacaucuucacaggccaaccccugaacaaugaugaggaccacgcccauuggaccgaagcuaagaugcuccuggacaacauuaauacuccugagggaaucaucccggcccuuuucgaaccagagcgcgagaaaagcgcagcgauugauggcgaauaucgucuaaagggggaguccagaaaaacguuugucgaacugaugcggaggggagacuugcccgugugguuagcccacaagguagcuucugaggguauaaaauacaccgaucgcaaguggugcuucgacggccagcgaaacaaucagauccuggaagagaacauggauguggagauuuggacaaaagaaggggagaagaagaaacucagaccucgguggcuggacgccaggacuuauucggauccccuugcacugaaggaauuuaaagacuucgcugccggacgcaagagcaucgcacucgauuugguuaccgagauuggcagagucccaucacaccuggcccauaggacacggaaugcucuagacaaccuggugaugcuccacaccuccgaacauggugggaaagcguaccgucacgccguggaggagcuuccugaaacuauggagacacuguuauugcugggccucaugauccugcuuacgggaggcgcaaugcuguuucucauaagugggaagggaaucgguaagaccucuauuggcuugaucugugucauugcuagcuccgggaugcuguggauggccgaaauccccuuacaguggauagccucagcaauuguucuagaguucuuuaugauggugcugcucaucccagagccugaaaaacaacgcacuccgcaggauaaucagcuugcuuauguagugauuggaauccugacauuggccgcgauaaucgcugccaacgagaugggccugcucgaaaccaccaagcgagaccuggguaugucuaaagagcccggggucgugagcccaacaaguuaccuugauguugaccuccacccugcauccgccuggacucuguacgcuguggcaacgaccgucauuacacccauguugagacauacuaucgaaaauagcaccgccaacguaucucuggcggcuauugccaaccaagcagugguuuuaaugggccuagacaagggauggccaaucucaaaaauggaucugggcgugccucuccuugcccuggggugcuauucccaggucaaucccuugacacugaccgcugccgugcuccugcuuauaacucacuacgcaauuaucggaccgggcuuacaggcuaaggccacgagggaggcgcagaagcggacagccgcagguaucaugaaaaacccaaccgucgacgggauuaugacuaucgaucuggacccugugauauaugauaguaaguucgagaaacaacucggacagguuauguugcuggugcuaugugcuguacagcugcuccuuaugcgcaccagcugggcccugugcgaagcauugacacuggcuacuggccccauuaccacacucugggaggguucgccaggcaaguuuuggaauacgaccaucgccgugucuauggccaacauuuucagaggguccuaccuggcgggagcuggcuuagcauuuagcaucaugaaaucagucgggacuggaaagaggggcacagguagucagggggaaacccuuggagagaaguggaaaaagaaacugaaucaacucucucggaaggaauucgaccuauauaaaaaguccggcauaacugagguugaucgaacagaggccaaagaaggucugaagagaggcgagaucacccaucacgcugugagccgcgggucagccaaguugcagugguuugucgaaaggaacauggugauucccgagggacggguaaucgaccugggcugugggcguggaggcuggaguuacuauugcgcaggucucaaaaaggugacggaaguuagaggguacaccaaaggaggcccuggccaugaggagccggugcccaugagcacauacggguggaauauugucaagcuuauguccggaaaagauguguucuaucugccaccugaaaagugugacacuuugcugugcgauaucggugagucuagccccuccccuaccgucgaagagucaaggacaauucgcgugcucaagaugguugagccaugguuaaaaaacaaucaguucuguaucaagguacugaaccccuacaugccuacugugauagaacaccuugagcggcugcagcgaaaacacggcgggaugcuagucagaaauccacucucuaggaacaguacccaugaaauguauuggauuucgaauggaacaggcaacaucguggccagcguuaauauggugucccgccuguugcugaaccgguuuaccaugacucacagacgucccacgaucgagaaggacgucgaucucggugcugggacaaggcaugugaacgcggaaccggagaccccuaauauggacguaauuggagagcggauaaaacgcaucaaggaagagcacaacucuacuuggcacuacgacgaugaaaauccauauaagaccugggccuaccauggcucauaugaggugaaagcaacaggcagcgcuuccaguaugauuaacgggguugucaagcuucugacgaaacccugggacguggugccuauggucacccaaauggccaugacugauacaaccccauucggacagcagcgaguuuuuaaggaaaaaguggacacuagaacacccaggucuaugccggguacccggcgcguaaugggcaucacagcagagugguuauggagaacucuggggaggaauaagaagccucgauugugcacccgggaggaauucacgaaaaaggugcguaccaacgccgcuaugggagccgucuuuacagaggaaaaucaaugggauagcgcgaaagcagccguggaggacgaagauuucuggaagcucguugacagagagcgcgagcugcacaaacuaggcaagugugguucaugcguguacaacaugauggggaaaagggaaaagaagcuuggagaguuuggcaaagcuaagggcucccgggccauuugguacauguggcugggggcaagauaucucgaauucgaggcucugggauuuuugaaugaggaucauugguucagucgcgaaaacagcuacucuggugucgagggcgaagggcugcacaaacucggauauauccuuagggacauauccaagauccccggcggugccauguacgcugaugacacugccgggugggacacccgaauuacagaggaugaccugcauaaugaagagaaaaucacucagcagauggauccagagcaccggcaguuagcaaacgcgauuuuuaagcugaccuaucaaaauaaggugguaaaaguucagagaccuacgcccacaggaaccgugauggacaucauaucaaggaaggaucagcgcggcagcggccaggucgggacuuacggauugaacacauucaccaauauggaagcccaacucauucgucagauggagggugaaggcgugcugucgaaagcugaccuagagaacccacaccuuucugaaaagaaaaucacucaguggcuggagaccaaggggguggagcggcucaagagaauggccaucaguggagaugacugcgucguuaaacccauugaugacagguuugcaaacgcucuguuggccuuaaaugauaugggcaaggugcgcaaagacauaccucaguggcaaccauccaaggguuggcaugauuggcagcagguaccguucuguagccaccauuuccacgaacugaucaugaaagacgggcgaaagcucgugguccccugccggccucaggacgagcuuauuggaagagcaaggaucucacaaggcgccggcuggucccugcgcgaaacagcgugucuagggaaggcuuaugcccagauguggucucugauguacuuucacagacgggaucucagguuggcaagcaacgccauuugcagugcugugccaguucauugggugcccacgucccguaccacuuggagcauccacgcccaucaccaguggaugacaaccgaggacaugcugacugucuggaaucgaguguggauagaagauaacccuuggauggaggacaaaacaccaguaaccacgugggagaauguucccuaccuuggaaagcgcgaagaucaauggugugguucucugaucggccucacaucaagagcaaccugggcucagaacauuccuacugccauccagcaggugcggaguuuaauugggaaugaggaauuccuggacuauaugccguccaugaaaagguuucgcaaggaggaggaaagcgagggagcgaucugguga

SEQ ID NO: 15467 - RNA, 9873 nt, Artificial Sequence
  derived and/or modified CDS sequence (opt3) from DENV-3__FJ547083__SS-prME
accagccugugccucaugaugauccuucccgcagcucuggcauuccacuugacauccagagacggcgaaccuaggaugauuguggggaagaacgaacggggaaaaucuuuacuguuuaagacugccucagguauaaauauguguacgcuaaucgcgauggaucucggcgaaaugugcgacgauaccgucacauacaaauguccacauauuacugaaguugaaccggaagacaucgauugcugguguaaccugaccaguacaugggugaccuaugggacuugcaaucaggcuggagaacgccgacgugacaagagauccgucgcccuugcaccccacgugggcaugggucuggauacaaggacccagacguggauguccgccgaaggggcuuggcggcaggucgaaaaaguggaaacuugggcauugcgccauccuggauucaccauucucgcccuguuucuggcucacuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcauggcgggugcgugacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcugucuugccagaggaacaggaccagaguuauguuuguaaacacacuuacguggaucgagguugggggaauggaugcggccucuucggcaaggggucccugguaaccugcgccaaguuucaauguuuagagcccauagagggaaaagugguccaguaugaaaaccugaaguacacagugauuaucacuguucacaccggugaccagcaucaggugggcaaugagacacaaggggucaccgcagaaauuacuccucaggcuucuacgacagaggccauccucccagaauauggaacccuuggccuggagugcagcccgagaacugguuuggacuucaacgagaugauccuacugaccaugaaaaauaaggcguggauggugcacaggcagugguuuuucgaucucccccugccuuggacauccggggccaccacugaaacaccaacguggaaccggaaagagcuucugguaaccuuuaagaaugcacaugcuaaaaagcaagaaguuguggucuugggcucacaggagggagccaugcacacugcucucacaggcgccaccgaaauucagaacagugggggaacaagcauauucgcaggucaccugaagugucguuuaaaaauggacaagcuggagcuaaaaggcaugucuuacgccaugugcacuaauaccuuugugcucaagaaagaggucuccgaaacgcagcaugggaccauccugauuaagguggaguacaagggagaagaugcucccuguaaaaucccuuucucaacagaggacggccaagguaaggcgcacaacgggcgccuuauaacugcaaacccaguugugaccaaaaaggaggaacccguaaauauugaggccgaaccgccuuucggcgagagcaacaucgucaucggaauuggcgauaaugcuuugaaaaucaacugguauaagaaggggaguucuauuggaaaaauguuugaagccacagcaagaggugccaggcggauggcuauacugggcgacacugccugggauuucggguccgugggaggcguucucaauagccuggguaagauggugcaucagaucuuugggucggcauacaccgcgcuuuucucuggcgucuccugggugaugaaaauuggaaucggcguacuguugacguggaucgggcucaacucaaagaauacaaguaugagcuuuuccugcauugcuauaggaaucauuacccuguauuuaggcgccgugguucaggcagacauggguugugucaucaacuggaaagggaaggagcugaagugcggaucuggcauuuucgugacuaaugaggugcacacauggaccgaacaguacaaauuucaagccgauagccccaagcgacuagcuacugccaucgccggugcuugggagaacggcgucugugggauacgcucaaccacaagaauggaaaaucuccuguggaaacagaucgccaacgagcuuaauuauauuuugugggaaaacaauaucaagcugacgguuguggugggagacaccauuggcguacucgagcaggggaaaaggacucugacaccacagccuauggaguuaaaguacaguuggaaaaccuggggaaaggcgaagaucgucacagccgaaacucaaaacuccagcuucauaauugauggccccaacaccccagagugccccucugcuucacgggcauggaaugugugggaaguugaggacuaugguuuugggguguucacgacaaacaucuggcugaaacuucgcgaagucuacacccaguugugugaccauagacucaugagugccgcugugaaggaugagagggccguucacgcagacaugggauacuggauugagagccagaaaaauggcuccuggaagcuggaaaaagcgucucuaaucgaggugaagacuugcaccuggccuaagucgcacacacuguggagcaacgguguacucgaauccgauaugauaaucccaaaaucacuggccggcccgauuagucagcauaaucaccgucccggguaucauacucaaaccgcuggaccuuggcaccuuggcaaguuggagcuggacuuuaacuacugcgaggggacaacggucgugaucaccgaaaauuguggaacucggggcccaucuuuacgaacaaccacugugagcgguaaacucauucacgaguggugcuguagauccugcacacugcccccucuuagguauaugggggaagauggauguugguacggcauggagauccgcccaauaucagaaaaggaggagaacauggucaaaagccugguuucugccgguuccggcaagguggacaauuucaccauggggguauugugccucgcaauucuguuugaagaggugaugcggggaaaguucggcaaaaagcauaugaucgcuggggucuucuuuacguucgugcuacugcucaguggacagaucacuuggagagauauggcccacacccugauuaugaucggcagcucugcauccgacaggauggguauggggguuacauaucuugccuugauugcuaccuuuaaaauacagcccuuccuggcguuaggauuuuuccuccgcaagcugacuucacgagaaaaccuucugcuaggcgugggccucgccauggcaacaacccugcaauugccggaggauaucgaacagauggcuaaugggauugcccugggauuaauggcccucaaacugaucacacaguuugagacuuaccagcuuuggaccgcucugauuaguuugacguguagcaacacaauguucacccucacugucgcauggcggaccgccacacugauccuagcgggugugucgcugcuuccuguuugccaauccucuagcaugcguaagacugacuggcucccaauggcuguggccgcaaugggcguacccccucugcccuuguuuauauucucacugaaggauaccuuaaaaagaaggaguuggccacucaaugaggggguaauggccgugggacugguuuccauccuugcuucuagccuguugcgcaacgacgugccuauggcaggcccccucgucgccggugggcugcuaauugcguguuaugugaucacgggaacauccgcugaucugaccguagaaaaggccgcagacauuacuugggaggaagaggccgaacagacaggcgugucacauaaucuuaugaucaccgucgacgaugacggcacuaugcggauaaaagaugacgagacagagaacauucucaccguucuguugaagacggcuuuacugaucgugagcgggguguuuccauacaguaucccggccacucuccuggucuggcacaccuggcagaaacagacacaaagaucuggagugcuuugggauguuccuucgcccccagaaacccagaaggcagagcuggaagaggguguauacaggauuaaacagcagggcauauucgggaagacacaagugggagucggcgugcagaaggaggguguuuuucauacuauguggcacgugacccgaggggcugucuugacguauaacggaaaacgccuagaacccaauugggccagcgugaagaaagaccugaucagcuacggcggcggguggcggcucucagcgcaguggcaaaagggagaggaaguacaggucauugccguggagccugguaaaaacccaaagaauuuccagacaaugcccggcacuuuccagaccacaaccggggaaaucggagcaauugcucuggauuuuaagccuggcacuucugguaguccgaucauaaacagagaggggaaaguugugggacuuuauggcaauggcgucgugaccaagaacgggggauacguuuccgguaucgcccaaacaaaugcugagccagacggccccacgccugaauuagaggaagagauguucaaaaagaggaaccugacuauuauggaucuccacccagggagcggaaaaacccguaaguauuugcccgcaaucgugcgcgaagccauuaagcggagacugaggacacucauccuggccccuacccgagucguggcugcggagauggaggaagcacuuaaaggccugccgauacgguaccagacuacagccaccaagucugagcauacgggucgcgaaauuguagacuugaugugccacgcuacuuuuacaaugagacuacugagccccgugaggguuccaaauuauaaccucaucaucauggaugaggcccauuucaccgacccugcauccauugccgcucggggguacaucucaacccgagucggaaugggcgaagcggccgcaauauuuaugacugcuacacccccaggcaccgccgaugcauucccucagaguaaugcccccauucaggacgaggagagagacaucccagaacgcagcuggaacucugggaaugaguggauuacagauuuugcuggaaaaacugugugguucgugccguccaucaaggccgguaacgacauagcgaauuguuuaaggaaaaacggcaagaaggucauucaacugucacguaaaacguuugauaccgaauaccagaagacaaaacuuaacgacugggauuucguagugacuaccgacaucagugagaugggggcaaauuuuaaggccgaucggguuaucgacccuagaaggugccugaaacccgugauucucacagauggaccagagcgcgucaucuuggcuggccccaugccugugaccgccgcuagcgcagcccagcgaagaggucggguugggaggaacccacagaaggaaaaugaccaauauauuuucacuggccagccccugaacaaugaugaggaccacgcucauuggacggaagccaagaugcuccuggacaacauaaauaccccugagggaaucauuccggcacuuuucgaaccagagcgcgagaaauccgcggccaucgauggcgaauaccgucuaaagggggagucuagaaaaacauuuguggaacugaugcggaggggagacuugcccgucugguuagcucacaagguggccucggaggguaucaaauauacugaucgcaaguggugcuucgacggccagcgaaacaaucagauucuggaagagaacauggauguagagauauggaccaaagaaggggagaagaagaaacucagaccucgguggcuggacgcaaggacauacagcgauccccuugcucugaaggaauuuaaagacuucgccgcaggacgcaagucaaucgcccucgauuuggugaccgagauuggcagaguuccaucccaccuggcucauaggacucggaaugcgcuagacaaccuggucaugcuccacacaagugaacauggugggcgugccuaucgccacgcaguggaggagcuuccugaaacgauggagacccuguuauugcugggccucaugauccugcuuacuggaggcgcuaugcuguuucucauuucugggaaaggaaucgguaagacaagcauaggcuugaucugugugauugccuccucagggaugcuguggauggccgaaauccccuuacaauggauugcaucugcuaucguccuagaguucuuuaugaugguucugcucauaccagagccugaaaagcagcgaaccccgcaggauaaucaacuugccuacgugguaauuggaauccugaccuuggcggcuauuaucgccgcaaacgagaugggccugcucgaaacaacuaaaagagaccuggguaugagcaaggagcccgggguggucaguccaacguccuaucuugauguggaccuccacccugccagcgcuuggacccuguacgcaguugccacaacugugauaacccccauguugaggcauacaaucgaaaauucuaccgcgaacgucucacuggcugccauugcaaaucaggccguaguguuaaugggccuagacaaaggauggccaaucuccaagauggaucugggcguuccucuccuugcucuggggugcuacagucaggugaaccccuugacucugacggccgcaguccuccugcuuauuacacacuaugcuaucauaggaccgggcuuacaggccaaagcgacccgggaggcccaaaagcgcacugcagcugguauuaugaagaacccaaccguggacgggaucaugacaaucgaucuggacccugucauuuacgauagcaaauucgagaagcagcucggacaggugauguugcugguucuaugugccgugcagcugcuccuuaugagaacuucgugggcacugugcgaggcuuugacccuggccacaggccccaucacgacccucugggaggguucuccaggcaaauuuuggaauacuacaauagccguauccauggcgaacauuuucagggggagcuaucuggcuggagcaggcuuagccuuuucaaucaugaagaguguggggaccggaaaacggggcacugguucucaaggggaaacacuuggagagaaguggaagaaaaagcugaaucagcucucccgaaaagaguucgaccuauacaagaaaagcggcauuaccgaggucgauagaacggaggcuaaggaaggucugaaacgcggcgagaucacccaucacgccguuucaagggggagugcaaaguugcagugguuuguggaacggaacauggucauacccgagggacgugugaucgaccugggcugugggagaggaggcuggagcuauuacugcgccggucucaagaaaguaacagaagugaggggguauacuaagggaggcccuggccaugaggagccgguucccauguccaccuacggguggaauauugugaaacuuaugucuggaaaggaugucuucuaccugccaccugaaaaaugugacacauugcugugcgauaucggugagagcucccccucaccuacuguggaagagucucgcaccauucggguccucaagaugguggagccaugguuaaagaacaaucaguucuguaucaaaguucugaaccccuauaugccuacaguaauugaacaccuugagcgacugcaaagaaagcacggcgggaugcuagugaggaauccacucagucgcaacucgacccaugaaauguacuggaucagcaauggaacuggcaacauagucgcuuccgugaauaugguuucucggcuguugcugaacagauuuacgaugacacaccguaggcccaccauugagaaagacguggaucucggugcggggacucggcaugucaaugccgaaccggagaccccuaacauggacgugaucggagagcgcaucaagcgaauuaaagaagaacacaacucaacauggcacuaugacgaugaaaauccauacaagacgugggcauaucauggcagcuacgagguaaaggcuaccggcuccgccaguucuaugauaaacggggugguuaaacuucugacuaagcccugggacgucgugccuauggugacacagauggcaaugaccgauacuacaccauucggacagcaaagagucuuuaaagaaaagguugacaccaggacaccccggagcaugccggguacucgcagagugaugggcaucaccgccgagugguuauggaggacgcuggggcgaaauaaaaagccucgguugugcacccgugaggaguucacaaagaaaguaagaacuaacgcugccaugggagcgguguuuaccgaggaaaaucagugggauucagcaaaggccgcugucgaggacgaagauuucuggaaacucguggaccgcgagagggagcugcacaagcuaggcaaaugugguuccugcguuuauaacaugauggggaagcgggagaagaaacuuggagaguuuggcaaggccaaaggcaguagagcaauuugguacauguggcugggggcucgcuaccucgaguucgaggcccugggauuuuugaaugaggaucauugguucagcagggaaaacucuuauuccgguguggagggcgaagggcugcacaagcucggauacauccuucgagacauuucaaaaauccccggcggugcuauguaugccgaugacacagcagggugggacacucggauaaccgaggaugaccugcauaaugaagagaagaucacgcagcagauggauccagagcacagacaauuagcgaacgccauuuuuaaacugacauaccagaauaaggucgugaagguacagaggccuacccccacuggaacaguuauggacaucauuagccgcaaagaucagcguggcucgggccaaguggggaccuauggauugaacacuuucaccaauauggaagcucagcucauccggcagauggagggugaaggcguccugucuaaggccgaccuagagaacccacaccuucccgagaaaaagauaacacaguggcuggagacgaaagggguggagagacucaagaggauggcaauuaguggagaugacugcguggucaagccuaucgaugaccgcuuugcuaaugcccuguuggcauuaaacgauaugggcaaaguucgaaaggacaucccacaauggcagccguccaaagguuggcaugauuggcaacaggugcccuucuguagccaccauuuccacgaacugauuaugaaggacgggcggaaacucguagugccuugcagaccacaagacgagcuuauaggaagggcccgcaucucacagggcgcgggcuggucccugagagaaaccgcuugucuagggaaggccuacgcacagauguggucucugauguauuuucaccggagggaucuccguuuggccagcaacgcuauuugcagugccguccccgugcauuggguuccuacuucccgaacaaccuggagcauccacgcacaucaccaauggaugacuacagaggacaugcugaccguguggaaucgcgucuggauugaagauaacccauggauggaggacaagacgcccgugacaaccugggagaauguaccuuaccuuggaaaaagagaagaucaguggugugguucucugaucggccucacuucacgggcuaccugggcccagaacauaccgacagcgauccagcaaguuaggaguuuaauugggaaugaggaguuccuggacuacaugccauccaugaagcgcuuuagaaaagaggaggaaagcgagggagcuaucugguga

SEQ ID NO: 15468 - RNA, 9873 nt, Artificial Sequence
  derived and/or modified CDS sequence (opt3) from DENV-3__FJ547084__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagcgcgggagcaguauuggaaagauguuugaagcuacagccagaggugcaaggcggauggccauacugggcgacacugcuugggauuucgggucuguuggaggcgugcucaacucccuggguaaaaugguccaccagaucuuugggagcgccuacaccgcacuuuucucgggcgugucuuggguaaugaagauuggaaucggcgugcuguugacguggaucgggcucaauuccaaaaacacaucaaugaguuuuagcugcauugcgauaggaaucauuacccuguauuuaggcgcuguuguccaggccgacauggguugugugaucaauuggaaggggaaagagcugaagugcggauccggcauuuucgugacuaacgagguccauacauggaccgaacaguacaaguuucaagcagauucucccaaacgacuagccacugcuaucgccggugcaugggagaauggcguuugugggauacgcagcaccacaagaauggaaaaccuccuguggaagcagaucgcuaaugagcuuaacuauauuuugugggaaaauaacaucaaacugacgguggugguaggagacaccauuggcguccucgagcaggggaagaggacucugacaccacagccuauggaguuaaaauacucauggaagaccuggggaaaagccaagaucgugacagcggaaacucaaaacaguuccuucauaauugauggccccaauaccccagagugccccagcgccucucgggcuuggaacguuugggaaguggaggacuaugguuuuggggucuucacgacaaauaucuggcugaagcuucgcgaaguguacacccaguugugugaccacagacucaugucagcagccguuaaagaugagagggcugugcacgccgacaugggauacuggauugagagucagaagaacggcagcuggaaacuggaaaaggcaucccuaaucgagguaaaaacuugcaccuggccuaagucucauacacuguggucgaaugguguccucgaaagcgauaugauaaucccaaagucccuggcgggcccgauuucacagcacaacuaucgucccggguaccauacucaaaccgccggaccuuggcaccuuggcaaauuggagcuggacuuuaauuauugcgaggggacaacgguggugaucaccgaaaacuguggaacucggggcccaaguuuacgaacaaccacugucucugguaagcucauucacgaguggugcuguagaagcugcacacugcccccucuuagguacaugggggaagauggauguugguauggcauggagauccgcccaauauccgaaaaagaggagaauaugguuaagucacuggugagcgcugguucuggcaaaguagacaacuucaccauggggguguugugccucgccauucuguuugaagaggucaugcggggaaaguucggcaagaaacauaugaucguggggguuuucuuuacguucgugcuacugcucuccggacagaucacuuggagagauauggcacacacccugauuaugaucggcaguaaugcuagcgacaggauggguaugggggucacauaccuugccuugauugcaaccuuuaagauacagcccuuccuggccuuaggauuuuuccuccgcaaacugacuucucgagaaaaccuucugcuaggcgugggccucgcuauggcgacaacccugcaauugccggaggauaucgaacagauggccaaugggauugcacugggauuaauggcucucaagcugacaacucaguuugagaccuaucagcuuuggacggcccugaucuccuugacauguucaaacaccauuuucacucucaccguugccuggcggacagcuacucugauccuagcaggugugagucugcuuccugucugccaaagcucguccaugcguaaaaccgacuggcucccaaugacgguagccgcgaugggcgugcccccucugcccuuguuuauauucucucugaaggauacauuaaagagaaggagcuggccacucaaugaggggguuauggcugugggacuggucucaauccuugccaguucccuguugcgcaacgacgugccuauggcaggcccccucguagccggugggcugcuaauugcuuguuacgugaucaccggaacuucugcagaucugacagucgaaaaagccgcggacguuaccugggaggaagaggcugaacagacuggcgugagccauaaccuuaugauuacaguggacgaugacggcaccaugcggaucaaggaugacgagacggagaauauacucacuguccuguugaaaaccgccuuacugauuguguccgggaucuuuccauacucaaucccggcaacacuccugguuuggcacaccuggcagaagcagacacaaagaagcggaguacuuugggaugugccuagucccccagaaacucagaaagccgagcuggaagagggugucuauaggauuaagcagcagggcauauucgggaaaacccaagugggaguuggcgugcagaaggagggugucuuucauacgauguggcacgugacacgaggggcuguauugacuuacaacggaaagcgccuagaacccaauugggccucugucaaaaaggaccugaucuccuauggcggcggguggcggcucagcgcacaguggcaaaaaggagaggaagugcagguuauugcuguggagccugguaagaacccaaaaaauuuccagaccaugcccggcacauuccagaccacuaccggggaaaucggagccauugcgcuggauuuuaagccuggcacaucggguucaccgaucauaaacagagaggggaaggucgugggacuuuacggcaauggcguugugacgaaaaacgggggauaugucucugguaucgcccaaacuaaugcagagccagacggccccaccccugaauuagaggaagagauguucaagaaaaggaaccugacaauuauggaucuccacccagggaguggaaagacccguaaauacuugcccgcuaucgugcgcgaagccauuaagcggagacugaggacucucauccuggcuccuacacgaguaguggcagccgagauggaggaagcccuuaagggccugccgauacgguaucagaccacggcuacuaaauccgagcauacaggucgcgaaauuguugacuugaugugccacgcgaccuuuaccaugagacuacugagccccgucagggugccaaauuacaaccucaucaucauggaugaggcacauuucacugacccugccucuauugcugcccggggguacaucagcacacgagugggaaugggcgaagcagccgcuauauuuaugaccgcgacacccccaggcacugccgaugcauucccucaguccaaugcucccauucaggacgaggagagagacaucccagaacgcucauggaacagugggaaugaguggauuacggauuuugccggaaagaccgucugguucguaccgagcaucaaagcagguaacgacauagccaacuguuuaaggaagaauggcaaaaaggugauucaacugucucguaagacauuugauacugaauaucagaaaaccaagcuuaacgacugggauuucguugugacaaccgacaucuccgagaugggggcuaauuuuaaagccgaucgggucaucgacccuagaaggugccugaagcccgugauucucacugauggaccagagcgcguuaucuuggcgggccccaugccugugacggcagccucagcugcccagcgaagaggucgggucgggaggaacccacagaaagaaaaugaccaauacauuuucaccggccagccccugaacaaugaugaggaccacgcucauuggacagaagcaaagaugcuccuggacaacauaaauacuccugagggaaucauuccggcccuuuucgaaccagagcgcgagaagagugcugccaucgauggcgaauaucgucuaaaaggggagagcagaaagaccuuuguggaacugaugcggaggggagacuugcccguaugguuagcacacaaaguggcguccgaggguaucaaguacacagaucgcaaauggugcuucgacggccagcgaaacaaucagauucuggaagagaacauggauguugagauauggaccaaggaaggggagaaaaagaagcucagaccucgguggcuggacgccaggacuuauucugauccccuugcucugaaagaauuuaaggacuucgccgcaggacgcaaaucgaucgcucucgauuuggucacagagauuggcagagugccaagccaccuggcccauaggacgcggaaugcacuagacaaccuggugaugcuccacaccucagaacauggugggaaggccuaccgucacgcugucgaggagcuuccugaaacuauggagacacuguuauugcugggccucaugauccugcuuaccggaggcgcgaugcuguuucucauuuccgggaaaggaaucgguaagaccaguauaggcuugaucuguguuauugccucuagcgggaugcuguggauggcagaaauccccuuacaauggauugcuuccgccaucgugcuagaguucuuuaugaugguacugcucauaccagagccugaaaagcagcgcacaccgcaggauaaucaacuugccuauguggucauuggaauccugacuuuggcagcuauuaucgccgcgaacgagaugggccugcucgaaacgaccaaacgagaccuggguaugucaaaggagcccggggugguuucuccaacaagcuaccuugauguggaccuccacccugcuagugccuggacucuguacgcagucgccaccacaguaauaacccccauguugagacauacuaucgaaaauuccacggcuaacgugagccuggcagccauugcgaaccaggcuguuguguuaaugggccuagacaaaggauggccaaucucuaagauggaucugggcgucccucuccuugcccuggggugcuauucacaggugaaucccuugacacugaccgcagccguccuccugcuuauuacucacuacgcuaucauaggaccgggcuuacaggccaaagcaaccagggaggcucaaaagcggacagccgcggguauuaugaagaacccaacuguggacgggaucaugaccaucgaucuggacccuguuauuuaugauuccaaauucgagaagcagcucggacaggugauguugcugguacuaugugccgugcagcugcuccuuaugcgcacaaguugggcacugugcgaagcuuugacgcuggccaccggccccaucacuacacucugggaggguagcccaggcaaauuuuggaauaccacuauagcagucucgauggcuaacauuuucagagggucuuaccuggccggagccggcuuagcguuuuccaucaugaagagcguugggacaggaaaaaggggcaccgguucacaaggggaaacgcuuggagagaaguggaagaaaaagcugaaucagcucagucggaaagaauucgaccuauauaagaaaucuggcauuaccgagguggaucgaacagaggcuaaggaaggucugaaaagaggcgagaucacucaucacgcagucucccgcgggagcgccaaguugcagugguuuguggaaaggaacaugguaauacccgagggacgggugaucgaccugggcugugggcguggaggcuggucauacuauugcgcuggucucaagaaaguuaccgaagugagaggguacacaaagggaggcccuggccaugaggagccgguccccaugaguacuuacggguggaauauugugaaacuuaugagcggaaaggaugucuucuaucugccaccugaaaaaugugacaccuugcugugcgauaucggugaguccucucccagcccuacaguggaagaguccaggaccauucgcguucucaagaugguagagccaugguuaaagaacaaucaguucuguaucaaagugcugaaccccuacaugccuacugucauugaacaccuugagcggcugcaacgaaagcacggcgggaugcuagugagaaauccacucucaaggaacucuacgcaugaaauguauuggaucaguaauggaacaggcaacauaguugccucggugaauauggucagccgccuguugcugaaccgguuuaccaugacucacagacgucccaccauugagaaagacguggaucucggugcagggacaaggcauguaaacgccgaaccggagacgccuaauauggacgugaucggagagcggaucaagcgcauuaaagaagagcacaacuccaccuggcacuacgacgaugaaaauccauauaagacuugggcuuaccauggcucuuaugagguuaaggcgacaggcucagccagcuccaugauaaacggggucgugaaacuucugaccaagcccugggacguggucccuaugguuacucagauggcaaugacagauaccacaccauucggacagcaacgaguguuuaaagaaaagguagacacuagaacccccaggaguaugccggguacgcggcgcgugaugggcaucaccgcugagugguuauggagaacacuggggaggaauaaaaagccucgauugugcacucgggaggaauucaccaagaaaguccguacaaacgccgcaaugggagccguguuuacugaggaaaaucagugggauucugcuaaggccgcgguugaggacgaagauuucuggaaacucguggacagagagcgcgagcugcacaagcuaggcaaaugugguagcugcgucuacaacaugauggggaagagggaaaaaaagcuuggagaguuuggcaaggcaaaaggcucacgggccauuugguacauguggcugggggcuagauaucucgaauucgaggcccugggauuuuugaaugaggaucauugguucucccgcgaaaacaguuacagcgguguggagggcgaagggcugcacaagcucggauauauccuuagggacauuucuaaaauccccggcggugcaauguacgcugaugacaccgccgggugggacacgcgaauaacagaggaugaccugcauaaugaagagaagaucacccagcagauggauccagagcaccggcaauuagcuaacgccauuuuuaaacugacuuaucagaauaagguaguuaaggugcagagaccuacacccaccggaacugucauggacaucauuuccaggaaagaucagcgcggcucaggccaaguggggaccuacggauugaacacauucacgaauauggaagcacagcucauccgucagauggagggugaaggcgugcugagcaaggcggaccuagagaacccacaccuucccgaaaaaaagauaacccaguggcuggagacuaaaggggucgagcggcucaagagaauggccauuucgggagaugacugcguugugaagccuaucgaugacagguuugcuaacgcccuguuggcauuaaaugauaugggcaaaguacgcaaggacaucccacaauggcagccgucuaaagguuggcaugauuggcagcaggugcccuucuguagucaccauuuccacgaacugauuaugaaggacgggcgaaaacucgucgugccuugccggccacaagacgagcuuauaggaagagcuaggaucucccagggcgccggcuggagccugcgcgaaacagcaugucuagggaaggccuaugcgcagauguggucacugauguacuuucacagacgggaucucagguuggcuuccaacgccauuugcucugcaguucccgugcauugggucccuaccagccguacuacauggaguauccacgcccaucaccaauggaugaccacggaggacaugcugacaguguggaaucgaguauggauugaagauaacccauggauggaggacaagacccccguuacuaccugggagaaugugccuuaccuuggaaaacgcgaagaucaguggugugguucccugaucggccucacaagcagagcuacuugggcccagaacauaccgaccgcaauccagcaaguccggucuuuaauugggaaugaggaauuccuggacuauaugccaucaaugaagagguuucgcaaagaggaggaaagugagggagcuaucugguga

SEQ ID NO: 15469 - RNA, 9873 nt, Artificial Sequence
  derived and/or modified CDS sequence (opt3) from DENV-3__FJ478456__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauugcugaaguugagccggaagacaucgauugcugguguaaccugacuaguaccugggugacauaugggaccugcaaucaggccggagagcaccgccgagacaagcguagcguagcacuugccccccaugugggcaugggucuggauacuagaacacaaaccuggauguccgcugagggggcauggaggcaggucgaaaaaguggagacgugggccuugcggcacccuggauucacuauucucgcucuguuucuggcccauuacaucggcaccucucucacacagaagguugugauauucaucuuacugaugcuugucacuccaucgaugaccaugcgcugugugggcguagggaacagagacuuuguugaaggauugucaggugcgacauggguggaugucgugcuggagcacggcgggugcgugaccacgauggcaaagaauaaacccacucuagacauugagcuccagaagacagaagccacccaacuggcuacucuuaggaaacuguguaucgagggaaagauuacaaacaucaccacggauagccggugcccuacccagggcgaagccgucuugccagaggaacaggaccagaauuauguuuguaaacacacauacguggaucgcgguugggggaacggaugcggccucuucggcaaggggagucugguaacuugcgcaaaguuucaauguuuagagcccauagagggaaaagugguccaguaugaaaaucugaaguacaccgugauuaucacaguucauacuggugaccagcaccaggugggcaacgagacccaaggggucacagcugaaauuaccccucaggccuccacuacggaggcgauccucccagaauauggaacacuuggccuggagugcucuccgcgaaccgguuuggacuucaaugagaugauccuacugacuaugaaaaacaaggccuggauggugcauagacagugguuuuucgaucucccccugccuuggaccagcggggcaacaaccgaaacuccaacauggaauaggaaagagcuucugguaacguuuaagaacgcucacgccaaaaagcaagaaguuguggucuugggcucccaggagggagcuaugcacaccgcccucacuggcgcaacagaaauucagaauucagggggaaccaguauauucgccggucaucugaagugucgguuaaaaauggacaagcuggagcuaaaaggcaugagcuacgcuaugugcacaaacacuuuugugcucaagaaagaggucucugaaacccagcacgggacgauccugauuaagguggaguacaagggagaagauguucccuguaaaaucccuuucuccaccgaggacggccaagguaaggcgcauaacgggcgucuuauaacagcaaauccagugguaacuaaaaaggaggaacccgucaacauugaggccgaaccgccuuucggcgagucaaauaucgugaucggaauuggcgauaacgcuuugaaaaucaauugguauaagaaggggagcaguauuggaaaaauguuugaagccaccgcacgcggugccagaaggauggcuauacugggcgacacagccugggauuucgggucuguuggaggcgugcucaacucccuggguaagaugguccaccagaucuuugggagcgcauacacugcgcuuuucucgggcgugucuuggguaaugaaaauuggaaucggcgugcuguugaccuggaucgggcucaauuccaagaacacgucaaugaguuuuagcugcauugcuauaggaaucauuacacuguauuuaggcgccguuguccaggcagacaccgguugugugaucaauuggaaagggaaggagcugaagugcggauccggcauuuucgugacuaacgagguccauacauggaccgaacaguacaaauuucaagccgauucucccaagcggcuagcuacugccaucgcaggugcuugggagaauggcguuugugggauacgaagcaccacacgcauggaaaaccuccuguggaaacagaucgccaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggcgaagauagugaccgccgaaacacaaaacaguuccuucauuaucgauggccccaauacuccagagugccccagcgcuucuagggcauggaacguuugggaaguggaggacuaugguuuuggggucuucaccacgaauauuuggcugaaacuucgggaaguguacacacaguugugugaccaccgccucaugucagccgcuguuaaggaugagagagccgugcacgcagacaugggauacuggaucgagagucagaaaaacggcagcuggaagcuggaaaaagcgucccuaauagagguaaagaccugcacuuggccuaagucucauacccuguggucgaaugguguccucgaaagcgauaugaucauuccaaaaucccuggccggcccgaucucacagcacaacuauaggcccggguaccauacacaaacugcuggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgccgguucuggcaagguagacaacuucacaauggggguguugugccucgcaauccuguuugaagaggucaugcgcggaaaguucggcaaaaagcauaugaucgcugggguguucuuuaccuucguucuacugcucuccggacagauuacguggcgggauauggcccacacucugaucaugauuggcaguaaugcaagcgacagaauggguaugggggugaccuaccuugccuugauagcuacauuuaaaauccagcccuuccuggcguuaggauuuuuccucaggaagcugaccucucgcgaaaaccuucugcuaggcgucggccucgccauggcaacuacacugcaauugccggaggauauugaacagauggcuaaugggaucgcccugggauuaauggcccucaaacugauuacccaguuugagacauaucagcuuuggacugcucugaucuccuugaccuguucaaacacgauauucacacucaccguggcauggcgaacugccacccugauccuagcggguguuaguauucugccugugugccaaagcucguccaugcggaagucugacuggcuuccaaugacagucgcugccaugggcguacccccucucccccuguuuaucuucagcuugaaggauacucugaaacguagaucauggccauuaaaugagggggugauggcaguuggacucgugaguauucuggccuccucucuucugaggaacgacgucccuauggcuggccccuugguggcaggugggcuccugaucgccuguuacguaauaaccggaacgagcgcggaucuaacaguggaaaaggcugccgacgucaccugggaggaagaggcagaacagacuggcguuucccauaaccugaugauuacaguggacgaugacggcaccaugcgcaucaaagaugacgagacugagaauauccuuacagugcuccugaagaccgccuuguuaauugucucagggauauuuccauacagcaucccggcuacgcugcucguguggcacacuuggcagaaacagacccggagaaguggaguucugugggauguaccuucucccccagaaacacaaaaggccgagcuugaagaggguguguauaggauuaaacagcagggcaucuucgggaagacccaggucggagugggcguucaaaaggaggguguguuucauacaauguggcacgucacucgaggggcagugcugaccuacaacggaaaacgcuuggaacccaauugggcuuccguaaagaaagaccuaauuagcuauggcggcggguggcggcugucggcccaguggcagaagggagaggaaguccaagugaucgcgguugagccugguaaaaacccaaagaauuuccagacgaugcccggcacauuccagacuaccacaggggaaauaggagccaucgcacucgauuuuaagccuggcaccucagguucuccgauuaucaacagagaggggaaaguggucggacuguacggcaauggcgugguuacuaagaacgggggauaugugagugguauugcucagaccaaugccgagccagacggccccacaccugaacuugaggaagagauguucaaaaagaggaacuuaacgaucauggaucugcacccaggguccggaaaaacucguaaguaccuccccgcuauaguccgcgaagcaauuaagcggagauugaggacccugauccucgccccuacacgagugguagccgcugagauggaggaagcgcugaaaggccuuccgauccgguaucaaaccacugcaacaaagagcgagcauaccggucgcgaaauuguggaccugaugugccacgccacguuuacuaugagauugcuaucucccguuagggucccaaauuacaaccugaucauaauggaugaggcucauuucacagacccugccagcauugcagcccggggguacaucuccacccgagugggaaugggcgaagcugcggccauuuuuaugaccgcaacucccccaggcacagcugaugccuucccucagucaaaugcacccauccaggacgaggagagagacauaccagaacgcaguuggaacagcgggaaugaguggauuaccgauuuugccggaaaaacagugugguucgucccgucuaucaaggcugguaacgacaucgccaacugucucaggaaaaauggcaagaagguaauucaguuaucccguaaaacuuuugauacggaauaucaaaagaccaaacugaacgacugggauuucgugguuacaacugacaucucagagaugggggcgaauuuuaaggcagaucgggugauugacccuagaaggugccuuaaacccgucauacugaccgauggaccagagcgcgugauccucgccggccccaugccuguuacagcugccagugcugcacagcgaagaggucggguggggaggaacccacagaaggaaaaugaccaguacauuuucaccggccaacccuugaacaaugaugaggaccacgcccauuggacugaagcuaagaugcugcucgacaacaucaauacgccugagggaaucauuccggcccuguucgaaccagagcgcgagaaaagcgcagcgauagauggcgaauaucgucuuaagggggaguccagaaaaaccuuugucgaacuaaugcggaggggagaccugcccgugugguuggcccacaagguagcuucugaggguaucaaauacacagaucgcaaguggugcuucgacggccagcgaaacaaucagauuuuagaagagaacauggauguggagaucuggacuaaagaaggggagaagaagaaacugagaccucgguggcucgacgccaggaccuauucggauccccuggcacuuaaggaauuuaaagacuucgcugccggacgcaagagcauugcacuggaucucguuacagagaucggcagagucccaucacacuuggcccauaggacccggaaugcucuggacaaccuagugaugcugcacacuuccgaacauggugggaaagcguaccgucacgccguggaggagcucccugaaacaauggagacgcuucuguuauugggccugaugauacuccugaccggaggcgcaaugcuuuuucugaucagugggaagggaauugguaagacuucuaucggccucauuugugucaucgcuagcuccgggauguuguggauggccgaaauaccccugcaguggauugccucagcaaucguuuuagaguucuuuaugauggugcuacugauuccagagccugaaaaacaacgcacaccgcaggauaaucagcucgcuuauguagugaucggaauacuuacccuggccgcgaucauugcugccaacgagaugggcuugcuggaaaccacaaagcgagaccucgguaugucuaaagagcccggggucgugagcccaacuaguuaccuggauguugaccuucacccugcauccgccuggacgcucuacgcuguggcaaccacagucaucacucccaugcugagacauaccauugaaaauagcacagccaacguaucuuuggcggcuaucgccaaccaagcagugguucugaugggcuuagacaagggauggccaauaucaaaaauggaucuaggcgugccucugcucgcccuugggugcuauucccaggucaauccccugaccuugacugcugccgugcugcuccugauuacgcacuacgcaaucaucggaccgggccuucaggcuaaggccacaagggaggcgcagaagcggaccgccgcagguauuaugaaaaacccaacugucgacgggaucaugaccauagauuuagacccugugauuuaugauaguaaguucgagaaacaacugggacagguuaugcucuuggugcugugugcuguacagcuacugcucaugcgcacaagcugggcccuuugcgaagcacugacuuuggcuaccggccccaucacaacgcugugggaggguucgccaggcaaguuuuggaauaccacuauugccgugucuauggccaacaucuucagaggguccuaccucgcgggagcuggccuggcauuuagcauaaugaaaucagucgggacaggaaagaggggcaccgguagucagggggaaacuuuaggagagaaguggaaaaagaaacuuaaucaacugucucggaaggaauucgaccucuauaaaaaguccggcaucacagagguugaucgaaccgaggccaaagaaggucuaaagagaggcgagauuacgcaucacgcugugagccgcgggucagccaagcugcagugguuugucgaaaggaacauggugauccccgagggacggguaauugacuugggcugugggcguggaggcuggaguuacuauugcgcaggucugaaaaaggugaccgaaguuagaggguacacaaaaggaggcccuggccaugaggagccggugcccaugagcacuuacggguggaauaucgucaagcucauguccggaaaagauguguucuaucuuccaccugaaaagugugacacccuguugugcgauauuggugagucuagccccuccccuacagucgaagagucaaggacuauccgcgugcugaagaugguugagccauggcucaaaaacaaucaguucuguauaaagguauuaaaccccuacaugccuaccgugauugaacaccuggagcggcuucagcgaaaacacggcgggaugcuggucagaaauccacuaucuaggaacaguacacaugaaauguauuggaucucgaauggaaccggcaacaucguggccagcguuaauauggugucccgccuccuguugaaccgguuuacuaugacgcacagacgucccacaauugagaaggacgucgaucugggugcugggaccaggcaugugaacgcggaaccggagacuccuaauauggacguaauaggagagcggaucaaacgcauuaaggaagagcacaacucuaccuggcacuacgacgaugaaaauccauauaagacaugggccuaccauggcucauaugaggugaaagcaacgggcagcgcuuccaguaugaucaacgggguugucaagcuccuuaccaaacccugggacguggugccuauggucacucaaauggccaugacagauaccacuccauucggacagcagcgaguuuuuaaggaaaaaguggacacaagaacccccaggucuaugccggguacacggcgcguaaugggcauuacugcagaguggcuguggagaaccuuagggaggaauaagaagccucgacugugcacgcgggaggaauucaccaaaaaggugcguacaaacgccgcuaugggagccgucuuuacugaggaaaaucaaugggauagcgcgaaagcagccguggaggacgaagauuucuggaaguugguugacagagagcgcgagcuccacaaacugggcaagugugguucaugcguguacaacaugauggggaaaagggaaaagaagcuaggagaguuuggcaaagcuaagggcucccgggccaucugguacauguggcuuggggcaagauaucuggaauucgaggcucucggauuucugaaugaggaucauugguucagucgcgaaaacagcuacucuggugucgagggcgaaggguugcacaaacugggauauauacucagggacaucuccaagauucccggcggugccauguacgcugaugacaccgccgggugggacacacgaaucacugaggaugaccuucauaaugaagagaaaauuacccagcagauggauccagagcaccggcagcuggcaaacgcgaucuuuaaguuaacguaucaaaauaaggugguaaaaguucagagaccuacacccaccggaacugugauggacauaauuucaaggaaggaucagcgcggcagcggccaggucgggacauacggacugaacaccuucacuaauauggaagcccaauugauccgucagauggagggugaaggcgugcucucgaaagcugaccuggagaacccacaccuaucugaaaagaaaaucacccaguggcuugagacaaaggggguggagcggcugaagagaauggccauuaguggagaugacugcgucguuaaacccauagaugacagguuugcaaacgcucuccuggccuugaaugauaugggcaaggugcgcaaagacaucccucaguggcaaccauccaaggguuggcaugauuggcagcagguaccguucuguagccaccauuuccacgaauuaauuaugaaagacgggcgaaagcuggugguccccugccggccucaggacgagcucaucggaagagcaaggauuucacaaggcgccggcuggucccuucgcgaaacggcgugucuggggaaggcuuaugcccagauguggucucuaauguacuuucacagacgggaucugaggcucgcaagcaacgccaucugcagugcugugccaguucauugggugcccaccucccguacuacauggagcauacacgcccaucaccaguggaugaccacugaggacauguugacagucuggaaucgaguguggaucgaagauaacccuuggauggaggacaaaaccccaguaacgacaugggagaauguucccuaccugggaaagcgcgaagaucaauggugugguucucuuauuggccugaccucaagagcaacuugggcucagaacaucccuaccgccauucagcaggugcggagucucaucgggaaugaggaauucuuagacuauaugccguccaugaaaagguuucgcaaggaggaggaaagcgagggagcgauuugguga

SEQ ID NO: 15470 - RNA, 9873 nt, Artificial Sequence
  derived and/or modified CDS sequence (opt3) from DENV-3__FJ547085__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacacugguugugugaucaauuggaaagggaaggagcugaagugcggauccggcauuuucgugacaaacgagguccauaccuggacugaacaguacaaauuucaagcagauucucccaagcggcuagccaccgcuaucgccggugcaugggagaauggcguuugugggauacgaagcacaacgcgcauggaaaaccuccuguggaaacagaucgcuaaugagcuuaacuauauuuugugggaaaauaacaucaagcugaccguggugguaggagacauuaucggcguccucgagcaggggaaaagaacucugacaccacagccuauggaguuaaaguacucauggaaaaccuggggaaaggccaggauagugacagcggaaacucaaaacaguuccuucauuaucgauggccccaauaccccagagugccccaacacgagccgggccuggaauguuugggaaguggaggacuaugguuuuggggucuucacaaccaacauuuggcugaagcuucgcgaaguguacacucaguugugugaccacagacucaugucugcugcaguuaaagaugagagggccgugcacgcugacaugggauacuggaucgagucacagaagaauggcaguuggaaacuggaaaaggccagccuaauagagguaaaaaccugcacauggccuaagucccauacucuguggucuaacgguguccucgaaucggauaugaucauuccaaagagccuggcaggcccgaucucccagcacaauuaucgucccggguaccauacccaaacagcgggaccuuggcaccuuggcaaauuggagcuggacuuuaacuauugcgaggggacgaccguggugauuacugaaaauuguggaacacggggcccaucauuacgaaccacuacagucagugguaagcucauccacgaguggugcuguagaucuugcacccugcccccucuuagguacaugggggaagauggauguugguauggcauggagauacgcccaauuagcgaaaaagaggagaacaugguuaagucccuggugucagccgguagcggcgaaguagacaauuucacgauggggguguugugccucgcuauccuguuugaggaagucaugcggggaaaauucggcaagaagcauaugaucgccgggguguucuuuacuuucguucuacugcucucuggacagauuaccuggagagauauggcacacacacugaucaugauuggcuccaacgcuaccgacaggauggguaugggggugacuuaccuugccuugauagcaacauuuaaaauccagcccuuccuggccuuaggauuuuuccuccgcaagcugaccagucgagagaaucuucugcuaggcgucggccucgcuauggcgacaacucugcaauugccggaagauauugagcagauggccaacgggaucgcacugggauuaauggcucucaaacugauuacccaguuugagacguaucagcuuuggacagcccugaucagcuugaccuguucuaauacuauauucacccucacaguggccuggcggacugcuacccugauccuagcagguguuucccugcuuccugugugccaaucaaguagcaugcguaagacggacuggcucccaaugacagucgccgcgaugggcguacccccucugcccuuguuuauuuucucgcugaaagauaccuuaaagagaagguccuggccacucaacgaaggggugauggcuguuggacuggugucuauccuugccagcucacuguugcgcaacgacgucccuauggcaggcccccucguggccggugggcugcuaauugcuuguuacguaaucacuggaacaagugcagaucugaccguggagaaggccgcggacgucacuugggaagaggaagcugagcagacaggcguuucccauaaucuuaugauaaccguggacgaugacggcacgaugcggauuaaagaugacgagacugaaaacauccucaccgugcuguugaagacagccuuacugaucgucucugggauuuuuccauacagcauaccggcaacccuccugguguggcacacauggcagaaacagacucaaagauccggaguucuuugggauguaccuucacccccagagacccagaaggccgaacuggaggaggguguguauaggaucaaacagcagggcauuuucgggaagacgcaagucggagugggcguucagaaagaagguguguuucauacaauguggcacgucacucgaggggcuguguugaccuacaauggaaagcgccuagagcccaacugggccagcguaaagaaagaccugaucaguuauggcggcggguggcggcucucugcacaguggcaaaagggagaagagguccaggugauugcuguugaaccugguaaaaauccaaagaacuuccagacaaugcccggcaccuuccagacuaccacaggggagaucggagccauagcgcuggauuuuaaaccuggcacguccgguagcccgaucauuaauagagaggggaagguggucggacuuuacggcaacggcgugguuacuaagaaugggggauaugugucggguaucgcccaaaccaacgcagaaccagacggccccacaccugaguuagaagaggaaauguucaaaaagaggaaucugaccauuauggaucuccacccagggucaggaaaaacucguaaguacuugcccgcuaucguccgcgaggccauaaaacggagacugaggacacucauucuggcuccuacccgagugguagcagccgagauggaagaggcccuuaagggccugccgauccgguaucagacgacugcuacaaagucugaacauaccggucgcgagaucguggacuugaugugccacgcgaccuuuacuaugagacuacugagucccguuagggucccaaacuacaaucucauuaucauggaugaagcacauuucacagacccugccuccauagcugcccggggguacauuagcacccgagugggaaugggcgaggcagccgcuaucuuuaugacagcgacucccccaggcacggccgaugcauucccucagucuaacgcucccauucaggacgaggaaagagacaucccagagcgcagcuggaauuccgggaacgaauggauaaccgauuuugccggaaaaacagugugguucgucccgucaauuaaggcagguaacgacaucgccaauuguuuaaggaaaaacggcaagaaaguaauccaacugagucguaagacuuuugauaccgaguaucagaagacaaaacuuaaugacugggauuucgugguuaccacugacauuagcgagaugggggcuaacuuuaaggccgaucgggugaucgacccuagaaggugccugaaacccgucauucucacggauggaccagaacgcgugauauuggcgggccccaugccuguuaccgcagccucugcugcccagcgaagaggucggguggggaggaauccacagaaggagaacgaccaauacaucuucacaggccagccccugaauaacgaugaagaccacgcucauuggacugaggcaaaaaugcuccuggacaauauuaacaccccugaaggaaucaucccggcccuuuucgagccagagcgcgaaaaguccgcugccauugauggcgaguaucgucuaaagggggaaucaagaaaaacauuugucgagcugaugcggaggggagacuugcccgugugguuagcacacaagguagcgagugaagguauaaaauacaccgaucgcaaguggugcuucgacggccagcgaaauaaccagauccuggaggagaauauggauguggaaauuuggacuaaagagggggaaaagaaaaagcucagaccucgguggcuggacgccaggacauauagcgauccccuugcucugaaggaguuuaaagacuucgccgcaggacgcaaguccaucgcucucgauuugguuacggaaauuggcagagucccaacccaccuggcccauaggacucggaacgcacuagacaaucuggugaugcuccacacaucugagcauggugggaaagccuaccgucacgcuguggaggaacuuccugagaccauggaaacccuguuauugcugggccucaugauccugcuuacaggaggcgcgaugcuguuucucauaucggggaagggaaucgguaaaacuagcauuggcuugaucugugucauugccucauccgggaugcuguggauggcagagauccccuuacaauggauagcuagugccauuguucuagaguucuuuaugauggugcugcucaucccagaaccugagaagcagcgcacgccgcaggauaaccaacuugccuauguagugauuggaauccugaccuuggcagcuauaaucgccgcgaaugaaaugggccugcucgagacaacuaagcgagaccuggguaugucuaaagaacccggggucgugagcccaaccuccuaccuugauguugaccuccacccugcuucagccuggacacuguacgcaguggccaccacugucauuacgcccauguugagacauacaaucgagaacucuaccgcuaacguaagccuggcagccauugcgaaucaggcugugguuuuaaugggccuagacaagggauggccaaucaguaaaauggaucugggcgugccucuccuugcccuggggugcuauucccaggucaaccccuugacucugaccgcagccgugcuccugcuuauaacacacuacgcuauuaucggaccgggcuuacaggccaaggcaacuagggaggcucaaaaacggaccgccgcggguaucaugaagaauccaacagucgacgggauuaugacgaucgaucuggacccugugauauaugauagcaaguucgaaaaacagcucggacagguuauguugcuggugcuaugugccguacagcugcuccuuaugcgcaccucuugggcacugugcgaggcuuugacucuggccacaggccccauuaccacucucugggaagguucaccaggcaaguuuuggaacacaaccaucgcaguguccauggcuaauauuuucagagggaguuaccuggccggagccggcuuagcguuuagcaucaugaaaucggucgggacgggaaagaggggcaccgguucucaaggggagacacuuggagaaaaauggaagaagaaacugaaccagcucucccggaaggaguucgaccuauauaaaaagagcggcauaacugagguugaucgaaccgaagcuaaagagggucugaagagaggcgaaaucacacaucacgcagugucacgcgggacugccaaauugcagugguuugucgagaggaauauggugauucccgaaggacggguaaucgaccugggcugugggcguggaggcuggaguuacuauugcgcuggucucaagaaggugaccgagguuagaggguacacaaaaggaggcccuggccaugaggaaccggugcccaugucuaccuacggguggaacauugucaagcuuauguccggaaaagauguguucuaucugccaccugagaagugugacacuuugcugugcgauaucggugaaagcucacccaguccuacggucgaggagagcaggacaauucgcgugcucaaaaugguugaaccaugguuaaagaauaaccaguucuguaucaagguacugaaucccuacaugccugccgugauagagcaccuugaacggcugcaacgaaaacacggcgggaugcuagucagaaacccacucuccaggaauucuacccaugagauguauuggauuagcaacggaacuggcaauaucguggcauccguuaacauggugucacgccuguugcugaaccgguuuaccaugacacacagacgucccacgaucgaaaaggacgucgaucucggugccgggaccaggcaugugaaugcugagccggagacuccuaacauggacguaauuggagaacggauaaaacgcaucaaggaggaacacaauucuacauggcacuacgacgaugagaacccauauaaaaccugggcguaccauggcaguuaugaagugaaggccacuggcucggcaagcuccaugauuaaugggguugucaagcuucugacaaaacccugggacguggugccuauggucacccagauggcuaugacagauacuaccccauucggacagcaacgaguuuuuaaggagaaaguggacacgagaacccccaggucuaugccggguacacggcgcguaauggagaucacugccgaaugguuauggagaacccugggcaggaacaagaaaccucgauugugcacacgggaggaauucacuaagaaggugcguaccaaugcagccaugggggcugucuuuacggaggaaaaccagugggauucagccaaagcggcaguggaggacgaggauuucuggaagcucguugacagagaacgcgagcugcacaaacuaggaaaguguggcagcugcguguacaauaugauggguaaaagggaaaagaaacuuggggaguuuggaaaggccaagggcucccgggcuauuugguacauguggcugggcgccagauaucucgaguucgaagcacugggguuuuugaacgaggaucauugguucagucgcgaaaauucuuacagcggagucgagggugaaggccugcacaaacucggguauauccuuagggacauaucaaagauccccggaggcgcuauguacgccgaugacacagcugguugggacacccgaauuacugaggaugaccugcauaacgaggaaaaaaucacacagcagauggauccagagcaccggcaauuagccaaugcaauuuuuaagcugaccuaucagaacaaagugguaaagguucagagaccuacucccaccgggacagugauggacaucauauccaggaaggaucagcgcggaaguggccaagucggcacguacggguugaauaccuucacuaacauggaagcgcagcucauucgucagauggagggagaaggugugcugagcaaagccgaccuagagaacccacaccuucccgagaagaaaaucacacaguggcuggaaaccaagggcguggagcggcucaaaagaauggcuaucucuggggaugacugcgucguuaagccuauugaugacagguuugccaaugcacuguuggcuuuaaacgauaugggaaaggugcgcaaagacauaccacaauggcagccguccaagggcuggcaugauuggcagcagguacccuucuguucacaccauuuccacgaacugaucaugaaagacggucgaaagcucguggucccuugccggccacaagacgagcuuauugggagagccaggaucagccagggagcaggcuggucgcugcgcgaaacugccugucuaggcaaagcguaugcucagauguggucucugauguacuuucacagacgggaucucagguuggccaguaaugcaauuugcuccgccgugcccguucauugggugccuacaagccguaccacguggucaauccacgcucaucaccaauggaugacaaccgaggacaugcugacugucuggaaccgaguguggauagaggauaauccauggauggaagacaagacccccguaacaacuugggagaacguuccuuaccuugggaagcgcgaagaucagugguguggaucccugaucggucucaccucuagagccacaugggcacagaauauuccgacggcuauccagcaagugcggagcuuaauuggcaacgaggaguuccuggacuauaugccaaguaugaaaagguuucgcaaggaagaggaauccgagggggccaucugguga

SEQ ID NO: 15471 - RNA, 9873 nt, Artificial Sequence
  derived and/or modified CDS sequence (opt3) from DENV-3__EU482595__SS-prME
accagccugugccucaugaugaugcuucccgccgcucuggcauuccacuugacauccagagacggcgagccuaggaugaucguggggaagaacgaacggggaaaaucuuuacuguuuaagacugccucagguauuaauauguguacgcuaauagcgauggaucucggcgagaugugcgacgauaccgucacauacaaauguccacauaucacugaaguugagccggaagacauugauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauccucgcccuguuucuggcucauuacguuggcacaucucucacucagaagguggucauuuucaucuuacugaugcuugugaccccaucgaugacaaugcgcuguguaggcguugggaacagagacuuuguggaaggauugucaggugccaccugggucgauguggugcuggagcacggcgggugcgucacgacuauggcgaagaauaaacccacacuagacauagagcuccagaagaccgaagcaacucaacuggccacacuuaggaaacuguguaucgagggaaagauuaccaacaucacgaccgauagccggugcccuacacagggcgaagcuguuuugccagaggaacaggaccagaauuauguguguaaacacacuuacguagaucgcgguugggggaacggaugcggccucuucggcaaggggagucuggugaccugcgccaaguuucaauguuuagagcccauugagggaaaagucgugcaguaugaaaaucugaaguacacaguuaucauaacugugcauaccggugaccagcaccaggucggcaacgagacacaaggggugaccgcagaaauuacuccucaggcuuccacgacagaggccauccucccagaauauggaacccuuggccuggagugcucuccgcgaacugguuuggacuucaaugagaugauucuacugaccaugaaaaacaaggcguggaugguacauagacagugguuuuucgaucucccccugccuuggacaagcggggccaccacugaaacaccaacguggaauaggaaagagcuucugguuaccuuuaagaacgcacacgcuaaaaagcaagaaguggucguguugggcucccaggagggagccaugcacacugcucucacaggcgccaccgaaauccagaauucagggggaacaaguaucuucgcaggucaucugaagugucgguuaaaaauggacaagcuggagcuaaaaggcaugagcuacgccaugugcacuaacaccuuuguccucaagaaagaggugucugaaacgcagcacgggaccauucugauaaagguugaguacaagggagaagaugugcccuguaaaguaccuuucuccacagaggacggccaagguaaggcucauaacgggcgucuuaucacugcgaauccagucgugaccaaaaaggaggaacccguuaacauugaggcagaaccgccuuucggcgagucaaauaucgugauaggaauuggcgauaacgccuugaaaaucaauugguauaagaaggggagcaguaucggaaaaauguuugaagcuacagcccgcggugcaagaaggauggccauucugggcgacacugcuugggauuucgggucugucggaggcgugcucaacucccuggguaagaugguacaccagaucuuugggagcgccuacaccgcacuuuucucgggcgugucuuggguuaugaaaauuggaauaggcguccuguugacguggaucgggcucaauuccaagaacacaucaaugaguuuuagcugcauugugaucggaaucauuacccuguauuuaggcgcggugguccaggcugacauggguuguguuauaaauuggaaagggaaggagcugaagugcggauccggcaucuucgugacuaacgaggugcauacauggaccgaacaguacaaauuucaagccgauucucccaagcggcuagcaacugccauugcuggugccugggagaauggcguaugugggauccgaagcaccacacgcauggaaaaccuccuguggaaacagauugcaaaugagcuuaacuauaucuugugggaaaauaacauaaagcugacggucgugguuggagacaucauuggcgugcucgagcaggggaaaagaauccugaccccacagccuauggaguuaaaguacucauggaaaacuuggggaaaggcuaagauugucacagccgaaacccaaaacaguuccuucaucauagauggccccaauacaccagagugccccagcgcgucuagggccuggaacgugugggaaguugaggacuaugguuuugggguguucucaacuaauauuuggcugaaacuucgggaaguauacacccaguugugugaccaccgccucaugagugcugcagucaaggaugagagagccgugcacgcugacaugggauacuggaucgagagccagaaaaacggcuccuggaagcuggaaaaagccucucuaauugaggugaagacgugcacauggccuaagucgcauacccuguggagcaaugguguccucgaauccgauaugaucauaccaaaaucacuggcaggcccgaucagucagcacaacuauaggcccggguaccauacucaaaccgcgggaccuuggcaccuuggcaaguuggagcuggacuuuaauuauugcgaggggacaacuguugugauuaccgaaaacuguggaacacguggcccaucuuuacggacgaccacuguaagcgguaaacucauccacgaguggugcugucgauccugcacacugcccccucuuagauacaugggggaagauggauguugguauggcauggagauuaggccaaucucagaaaaggaggagaauauggugaaaagccuggucucugccgguuccggcaagguggacaacuucaccauggggguuuugugccucgcuauacuguuugaagaggugaugcgcggaaaguucggcaaaaagcauaugauugccggggucuucuuuacuuucgugcuacugcucaguggacagaucacauggcgggauauggcacacacccugaucaugauuggcagcaaugcuucugacagaauggguauggggguuacguaccuugccuugaucgcaacuuuuaaaauucagcccuuccuggccuuaggauuuuuccucaggaagcugaccucccgcgaaaaccuucugcuaggcgugggccucgcuauggcgacaacccugcaauugccggaggauauagaacagauggccaaugggaucgcacugggauuaauggcucucaaacugauuacucaguuugagacauaucagcuuuggaccgcccugaucucauugacauguaguaacacuauuuucacccucacggucgccuggcgaacagcuacccugauccuagcagguguaagccugcuuccugugugccaaucguccucuaugcggaagacugacuggcucccaaugaccguugccgcgaugggcgugcccccucugcccuuguuuauauucagccugaaggauacauuaaaacguagaucauggccacucaaugagggggucauggcugugggacugguaaguauccuugccuccucucuguugaggaacgacgugccuauggcaggcccccucgucgccggugggcugcuaauugcuuguuacguuaucacuggaaccagcgcagaucugacgguggaaaaggccgcggacgugacaugggaggaagaggcugaacagaccggcgucucccauaaccuuaugauuacuguggacgaugacggcacaaugcgcaucaaagaugacgagaccgagaauauacucacuguucuguugaagacagccuuacugauuguaucagggaucuuuccauacagcaucccggcaacccuccugguguggcacacguggcagaaacagacucaacggaguggaguccuuugggaugugccuucucccccagaaacccagaaggccgagcuggaagaggguguuuauagaauuaaacagcagggcauauucgggaagacacaagugggagucggcgugcagaaggaggguguauuucauaccauguggcacgucacaaggggggcuguguugacuuacaacggaaaacgacuagaacccaauugggccuccguuaagaaagaccugaucagcuauggcggcggguggcgccucucggcacaguggcaaaagggagaggaagugcaggucauugcuguggagccugguaaaaacccaaagaauuuccagaccaugcccggcacguuccagacaacuaccggggaaaucggagccauugcgcuggauuuuaagccuggcacaucagguucuccgaucauaaaccgggaggggaaaguugugggacuuuacggcaauggcgucgugaccaagaacgggggauauguaagugguaucgcccaaacuaaugcagagccagacggccccgcuccugaauuagaggaagagauguucaaaaagagaaaccugaccauuauggaucuccacccaggguccggaaaaacaaggaaguacuugcccgccaucgugcgugaagcuauuaagcgccggcugagaacgcucauccuggcaccuacuaggguugucgccgccgagauggaggaagcucuuaaaggccugccgauacgauaucagaccacagcgaccaagagcgagcauacuggucgggaaauuguggacuugaugugccacgcaacauuuaccaugcgccuacugucucccgugagagucccaaauuacaaccucaucaucauggaugaggcccauuucacggacccugcuagcauugccgcaaggggguacaucuccacucggguaggaaugggcgaagccgcugcgauauuuaugacagccacccccccaggcaccgcagaugcuuucccucagucaaaugcccccauucaggacgaggagcgagacaucccagaaagaaguuggaacagcgggaaugaguggauuacugauuuugcaggaaaaacagugugguucguuccgucuaucaaggccgguaacgacauagcuaacuguuuacgcaaaaauggcaagaaggugauucaacuguccaggaaaaccuuugauacagaauaucagaagacuaaacuuaacgacugggauuucgucgugacgaccgacaucucagagaugggggccaauuuuaaggcggaucguguuaucgacccucggagaugccugaaacccgugauucucacagauggaccagagagggucaucuuggcaggccccaugccugugacugccgcuagugccgcucagcgccgagguagaguagggcggaacccacagaaggaaaaugaccaauacauuuucaccggccagccccugaacaaugaugaggaccacgcacauuggacagaagccaagaugcuccuggacaacauaaauaccccugagggaaucauuccggcucuuuucgaaccagagagggagaaaagcgccgcaaucgauggcgaauaucgccuaaagggggagucccguaaaacuuuuguggaacugaugagacggggagacuugcccguuugguuagcgcacaaggucgccucugaggguaucaaauacacggauaggaaguggugcuucgacggccagcgcaacaaucagauucuggaagagaacauggauguggagauauggaccaaagaaggggagaagaagaaacuccgaccuagauggcuggacgcucggacauauucggauccccuugcccugaaggaauuuaaagacuucgcagcuggaaggaagagcaucgcccucgauuuggugacugagauuggccgcgucccaucacaccuggcacauagaaccaggaaugcccuagacaaccugguuaugcuccacacauccgaacauggugggaaagcuuaccggcacgcgguggaggagcuuccugaaaccauggagacucuguuauugcugggccucaugauccugcuuacaggaggcgccaugcuguuucucauuagugggaagggaaucgguaagacgucuauaggcuugaucuguguaauugcaagcuccgggaugcuguggauggcugaaauccccuuacaauggauugccucagccaucgugcuagaguucuuuaugaugguccugcucauaccagagccugaaaaacagcguaccccgcaggauaaucaacuugcauaugugguuauuggaauccugacuuuggcugccauuaucgcggcuaacgagaugggccugcucgaaacaaccaagcgcgaccuggguaugucuaaagagcccgggguggucagcccaaccaguuaccuugauguagaccuccacccugccuccgcauggacacuguacgccguggcuacuacgguuauaacccccauguugcgacauacaaucgaaaauagcacugcaaacgugucucuggccgcgauugcuaaccaggccgucguguuaaugggccuagacaagggauggccaaucucaaaaauggaucugggcgucccucuccuugcacuggggugcuauucccaggugaaucccuugacccugacagccgcuguucuccugcuuauuacccacuacgccaucauaggaccgggcuuacaggcaaaggcuacuagagaggcccaaaagaggacggcggccgguauuaugaaaaacccaacaguggacgggaucaugaccaucgaucuggacccuguaauuuaugauaguaaguucgagaaacagcucggacaggugauguugcugguccuaugugcaguucagcugcuccuuaugcggacuagcugggcucugugcgaagccuugacccuggcaacaggccccaucacuacccucugggaggguucgccaggcaaguuuuggaauacaacgauagcugugucuauggccaacauuuuccgcggguccuaccuggccggagcgggcuuagcuuuuagcaucaugaaaucagucgggaccggaaagagaggcacugguagucaaggggaaacacuuggagagaaguggaaaaagaaacugaaucagcucucuaggaaggaauucgaccuauauaaaaaguccggcauuaccgagguggaucggacugaggcaaaagaaggucugaagcgaggcgagaucacacaucacgccguaagcagagggucagcuaaguugcagugguuuguggaacgcaacaugguuauacccgagggaagggugaucgaccugggcugugggcggggaggcuggaguuacuauugcgccggucucaaaaaggucaccgaagugcguggguacacgaaaggaggcccuggccaugaggagccgguccccaugagcaccuacggguggaauauugugaagcuuauguccggaaaagauguuuucuaucugccaccugaaaagugugacacauugcugugcgauaucggugagucuagccccuccccuacuguagaagagucaagaaccauuagggugcucaagauggucgagccaugguuaaaaaacaaucaguucuguaucaaggugcugaaccccuacaugccuacaguuauugaacaccuugagcgccugcaacggaaacacggcgggaugcuagugcgaaauccacucucuagaaacaguacucaugaaauguauuggaucucgaauggaaccggcaacauagucgcaagcgugaauaugguauccaggcuguugcugaaccgcuuuacaaugacccaccggagacccacuauugagaaggacguggaucucggugccgggacgcgucauguuaacgcugaaccggagacaccuaauauggacgucaucggagagaggaucaaacggauuaaggaagagcacaacucuaccuggcacuacgacgaugaaaauccauauaagacuugggcguaccauggcucauaugaggugaaagccaccggcagcgcauccaguaugauaaacgggguggucaagcuucugacaaaacccugggacguugugccuaugguaacgcagauggcuaugaccgauacuacaccauucggacagcaacgcguguuuaaggaaaaagucgacacccgaacucccagaucuaugccggguacaaggcgggugaugggcaucaccgccgagugguuauggcgcacacuggggagaaauaagaagccuagguugugcacucgagaggaauucaccaaaaagguucggacgaacgcagccaugggagcuguguuuaccgaggaaaaucagugggauagcgccaaagcggcagucgaggacgaagauuucuggauucucguggaccgugagagagagcugcacaagcuaggcaaaugugguucaugcguauacaacaugauggggaagcgcgaaaaaaagcuuggagaguuuggcaaggccaaaggcuccagggcuaucugguacauguggcugggggcccgguaucucgaauucgaggcacugggauuuuugaaugaggaucauugguucaguagagaaaacagcuacucugguguugagggcgaagggcugcacaagcucggauauauucuucgcgacaucuccaaaauacccggcggugcuauguacgccgaugacacagcugggugggacacuaggaucaccgaggaugaccugcauaaugaagagaagauuacacagcagauggauccagagcaccgacaauuagccaacgcaaucuuuaaacugacuuaucagaauaagguggucaaggugcagcggccuacccccacgggaacagugauggacauuaucucaagaaaagaucagaggggcagcggccaagucgggaccuacggauugaacacuuucacaaauauggaagcgcagcucauacgccagauggagggugaaggcguucugucgaaggccgaccuagagaacccacaccuucccgaaaaaaagauuacccaguggcuggagacuaaagggguggagcgucucaagcggauggcuaucucuggagaugacugcguagugaagccuaucgaugacagauuugccaacgcacuguuggcuuuaaaugauaugggcaaagucaggaaggacauuccacaauggcagccgaguaaagguuggcaugauuggcagcaggugcccuucuguucccaccauuuccacgaacugauaaugaaggacgggcgcaaacucguugugccuugccgaccacaagacgagcuuaucggacgggccagaauuagccagggcgcaggcuggucacugagggaaaccgccugucuagggaaggcguaugcucagauguggucccugauguacuuucaccgcagagaucuccgguuggccucuaacgcaaucugcagcgccguccccgugcauuggguaccuacaaguaggacgaccugguccauucacgcucaucaccaauggaugacuacagaggacaugcugaccguuuggaaucguguguggaucgaagauaacccauggauggaggacaagacucccgucacaaccugggagaaugugccuuaccuuggaaaacgagaagaucaguggugugguagccugauaggccucacgucucgcgccacaugggcacagaacaucccgaccgcuauucagcaaguuagaucauuaaucgggaaugaggaauuccuggacuauaugccaaguaugaagcgguuuaggaaagaggaggaauccgagggagccauuugguga

SEQ ID NO: 15472 - RNA, 9873 nt, Artificial Sequence
  derived and/or modified CDS sequence (opt3) from DENV-3__EU482596__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcaagguagacaacuucacaauggggguguugugccucgccauccuguuugaagaggucaugcgcggaaaguucggcaaaaagcauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaaaauccagcccuuccuggcuuuaggauuuuuccucaggaagcugaccucucgcgaaaaccuucugcuaggcgucggccucgcgauggccacuacacugcaauugccggaggauauugaacagauggcaaaugggaucgcucugggauuaauggcccucaaacugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaagacagacuggcucccaaugacugucgcggcuaugggcguacccccucugcccuuguuuauuuucucucugaaggauaccuuaaaacguagaagcuggccacucaaugagggggugauggccguuggacuggugucaauccuugcaaguucccuguugaggaacgacgucccuauggccggcccccucguggcuggugggcugcuaauugcauguuacguaaucacgggaacaucugccgaucugaccguggaaaaggcggcugacgucacuugggaggaagaggccgaacagacaggcguuagccauaaccuuaugauaaccguggacgaugacggcacuaugcgcauuaaagaugacgagacagagaauauccucaccgugcuguugaagacggcauuacugaucgucuccgggauuuuuccauacucaauaccggccacucuccugguguggcacaccuggcagaaacagacacaacggagcggaguucuuugggauguaccuagucccccagaaacccagaaggcugagcuggaagaggguguguauagaaucaaacagcagggcauuuucgggaagacacaagucggagugggcguucagaaggaggguguguuucauacuauguggcacgucaccaggggggccguguugacguacaacggaaaacgacuagaacccaauugggcaucuguaaagaaagaccugaucuccuauggcggcggguggcgccucagcgcucaguggcaaaagggagaggaaguccaggugauugccguugagccugguaaaaacccaaagaauuuccagacaaugcccggcacuuuccagaccacaaccggggaaaucggagcgauagcccuggauuuuaagccuggcacuucggguucaccgaucauuaaccgggaggggaaaguggucggacuuuacggcaauggcgugguuaccaagaacgggggauaugugucugguaucgcacaaacaaaugcugagccagacggccccacgccugaauuagaggaagagauguucaaaaagagaaaccugacuauuauggaucuccacccagggaguggaaaaaccaggaaguacuugcccgccaucguccgugaagcuauaaagcgccggcugagaacacucauucuggcaccuaccagggugguagccgccgagauggaggaagcucuuaaaggccugccgauccgauaucagacuacagcgaccaaguccgagcauacgggucgggaaaucguggacuugaugugccacgcaacuuuuacaaugcgccuacugagccccguuagagucccaaauuacaaccucauuaucauggaugaggcccauuucaccgacccugcuucuauagccgcaaggggguacauuagcacccgggugggaaugggcgaagccgcugcgaucuuuaugacugccacacccccaggcaccgcagaugcuuucccucaguccaaugcccccauucaggacgaggagcgagacaucccagaaagaucauggaacagugggaaugaguggauaacagauuuugcaggaaaaacugugugguucgucccgagcauuaaggccgguaacgacaucgcuaacuguuuacgcaaaaauggcaagaagguaauccaacugucuaggaaaacguuugauaccgaauaucagaagacaaaacuuaacgacugggauuucgugguuacuaccgacauuuccgagaugggggccaauuuuaaggcggaucgugugaucgacccucggagaugccugaaacccgucauucucacagauggaccagagagggugauauuggcaggccccaugccuguuaccgccgcuucagccgcucagcgccgagguagaguggggcggaacccacagaaggaaaaugaccaauacaucuucacuggccagccccugaacaaugaugaggaccacgcacauuggacggaagccaagaugcuccuggacaacauuaauaccccugagggaaucaucccggcucuuuucgaaccagagagggagaaaagugccgcaauugauggcgaauaucgccuaaagggggagagccguaaaacauuugucgaacugaugagacggggagacuugcccgugugguuagcgcacaagguagccuccgaggguauaaaauacacugauaggaaguggugcuucgacggccagcgcaacaaucagauccuggaagagaacauggauguggagauuuggaccaaagaaggggagaagaagaaacuccgaccuagauggcuggacgcucggacauauucugauccccuugcccugaaggaauuuaaagacuucgcagcuggaaggaagucgaucgcccucgauuugguuaccgagauuggccgcgucccaagccaccuggcacauagaacuaggaaugcccuagacaaccuggugaugcuccacacaucagaacauggugggaaagcuuaccggcacgcgguggaggagcuuccugaaacgauggagacccuguuauugcugggccucaugauccugcuuacuggaggcgccaugcuguuucucauauccgggaagggaaucgguaagacaaguauuggcuugaucugugucauugcaucuagcgggaugcuguggauggcugaaauccccuuacaauggauagccuccgccauuguucuagaguucuuuaugauggugcugcucaucccagagccugaaaaacagcguaccccgcaggauaaucaacuugcauauguagugauuggaauccugaccuuggcugccauaaucgcggcuaacgagaugggccugcucgaaacaacuaagcgcgaccuggguaugucaaaagagcccggggucgugucuccaacgagcuaccuugauguugaccuccacccugccagugcauggacccuguacgccguggcuacaacugucauuacccccauguugcgacauacaaucgaaaauuccaccgcaaacguaagccuggccgcgauugcuaaccaggccgugguuuuaaugggccuagacaagggauggccaaucucuaaaauggaucugggcgugccucuccuugcacuggggugcuauucacaggucaaucccuugacucugacggccgcugugcuccugcuuauaacacacuacgccauuaucggaccgggcuuacaggcaaaggcuaccagagaggcccaaaagaggacugcggccgguaucaugaaaaacccaaccgucgacgggauuaugacaaucgaucuggacccugugauauaugauuccaaguucgagaaacagcucggacagguuauguugcuggugcuaugugcaguacagcugcuccuuaugcggacuaguugggcucugugcgaagccuugacccuggcaacaggccccauuacgacccucugggaggguagcccaggcaaguuuuggaauacuacaaucgcugugucgauggccaacauuuuccgcgggucuuaccuggccggagcgggcuuagcuuuuuccaucaugaaaagcgucgggaccggaaagagaggcacugguucacaaggggaaacacuuggagagaaguggaaaaagaaacugaaucagcucaguaggaaggaauucgaccuauauaaaaagucuggcauaaccgagguugaucggacggaggcaaaagaaggucugaagcgaggcgagaucacccaucacgccguguccagagggagcgcuaaguugcagugguuugucgaacgcaacauggugauucccgagggaaggguaaucgaccugggcugugggcggggaggcuggucauacuauugcgccggucucaaaaaggugacagaaguucguggguacacuaaaggaggcccuggccaugaggagccggugcccaugaguaccuacggguggaauauugucaagcuuaugagcggaaaagauguguucuaucugccaccugaaaagugugacacauugcugugcgauaucggugaguccucucccagcccuacugucgaagaguccagaaccauuagggugcucaagaugguugagccaugguuaaaaaacaaucaguucuguaucaagguacugaaccccuacaugccuacagugauagaacaccuugagcgccugcaacggaaacacggcgggaugcuaguccgaaauccacucucaagaaacucuacccaugaaauguauuggauuaguaauggaacuggcaacaucguggcaucgguuaauauggugagcaggcuguugcugaaccgcuuuacgaugacacaccggagacccaccaucgagaaggacgucgaucucggugccgggacucgucaugugaacgcugaaccggagaccccuaauauggacguaauuggagagaggauaaaacggaucaaggaagagcacaacuccacauggcacuacgacgaugaaaauccauauaagacgugggcguaccauggcucuuaugaggugaaagccaccggcucagcaagcuccaugauuaacgggguugucaagcuucugacuaaacccugggacguggugccuauggucacacagauggcuaugaccgauacuacaccauucggacagcaacgcguuuuuaaggaaaaaguggacacccgaacacccagaaguaugccggguacuaggcggguaaugggcaucaccgccgagugguuauggcgcacgcuggggagaaauaagaagccuagguugugcacccgagaggaauucacaaaaaaggugcggacuaacgcagccaugggagcugucuuuaccgaggaaaaucagugggauucugccaaagcggcaguggaggacgaagauuucuggaagcucguugaccgugagagagagcugcacaaacuaggcaagugugguagcugcguguacaacaugauggggaaacgcgaaaagaagcuuggagaguuuggcaaagccaagggcucaagggcuauuugguacauguggcugggggcccgguaucucgaauucgaggcacugggauuuuugaaugaggaucauugguucuccagagaaaacaguuacagcggugucgagggcgaagggcugcacaaacucggauauauccuucgcgacauaucuaagauccccggcggugcuauguacgccgaugacacagcugggugggacacuaggauuaccgaggaugaccugcauaaugaagagaaaaucacgcagcagauggauccagagcaccgacaauuagccaacgcaauuuuuaagcugacauaucagaauaaggugguaaaaguucagcggccuacccccacuggaacagugauggacaucauauccagaaaggaucagaggggcucaggccaagucgggaccuacggauugaacacuuucaccaauauggaagcgcagcucauucgccagauggagggugaaggcgugcugagcaaagccgaccuagagaacccacaccuucccgaaaagaaaaucacacaguggcuggagacgaaggggguggagcgucucaagcggauggcuaucucgggagaugacugcgucguuaaaccuauugaugacagauuugccaacgcacuguuggcuuuaaaugauaugggcaaggugaggaaagacauaccacaauggcagccgucuaaggguuggcaugauuggcagcagguacccuucuguagucaccauuuccacgaacugaucaugaaagacgggcgcaagcucguggucccuugccgaccacaagacgagcuuauuggacgggccagaaucucccagggcgcaggcuggagccugagggaaaccgccugucuagggaaggcguaugcucagauguggucacugauguacuuucaccgcagagaucuccgguuggccuccaacgcaauuugcucugccgugcccguucauugggugccuacuagcaggacaaccuggaguauccacgcucaucaccaauggaugacuacagaggacaugcugaccgucuggaaucguguguggauagaagauaacccauggauggaggacaaaacgcccguaacaaccugggagaauguuccuuaccuuggaaagcgagaagaucaguggugugguucccugaucggccucacuagccgcgccaccugggcacagaacauuccgacagcuauccagcaagugagaucuuuaauugggaaugaggaauuccuggacuauaugccaucaaugaaacgguuuaggaaggaggaggaaagugagggagccaucugguga

SEQ ID NO: 15473 - RNA, 9873 nt, Artificial Sequence
  derived and/or modified CDS sequence (opt3) from DENV-3__JQ922554__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacauaucaccgaacuggagccggaagacauugauugcugguguaaccuuacaaguaccuggguuacuuaugggacaugcaaucaggcgggagagcaccgccgagacaagcguagcguggcucuggccccccauguaggcauggguuuggauaccagaacgcaaacuuggauguccgcagagggggccuggaggcagguggaaaaagucgagaccugggcucuccggcacccuggauucacaauccuggcacuguuucucgcccauuacauuggcacuucuuuaacccagaaggugguuaucuucauacugcuuauguuggugacaccaucgaugaccaugcgcugugucggcguggggaacagagacuuuguagaaggacugucaggugcuacguggguugaugugguccuagagcacggcgggugcgugacuacaauggccaagaauaaacccacccucgacaucgagcugcagaagacugaagcgacacaacuugcaacccugaggaaauuguguauugagggaaagaucacgaacauuaccacagauagccggugcccuacucagggcgaagccauccucccagaggaacaggaccagaauuauguguguaaacacaccuacgucgaucgcgguugggggaacggaugcggccuguucggcaaggggaguuuaguuacaugcgcuaaguuucaaugucuggaguccauagagggaaaagugguacagcaugaaaaucucaaguauacugugauuaucaccguccacacaggugaccagcaucaggugggcaacgagacccaagggguuacugccgaaauuacgucucaggcaagcacagcugaggccauccuucccgaauacggaacccugggcuuggagugcuccccucgaacuggucuagacuucaaugagaugauccugcucaccaugaaaaacaaggcguggauggugcacagacagugguuuuucgaucugccacuuccguggacaucaggggccaccacuaaaacacccacguggaauaggaaggaacuguuggucaccuuuaaaaacgcacacgcuaagaagcaagaggugguaguucucggcagucaggaaggagccaugcauacugcucugacaggcgccaccgagauucagacaagcgggggaacuucuauauucgcaggucacuuaaaaugucggcugaagauggacaaacuagaacucaagggcauguccuaugccaugugccugaauaccuuugugcuuaaaaaggaggucucagagacgcagcaugggaccaucuugauuaagguggaauacaaaggagaggaugcuccuuguaagaucccauucagcacagaagacggccaagguaaagcgcacaacgggcgucugauaacugcaaaccccgucgugaccaagaaagaggagccuguuaauauugaagccgagccacccuucggcgaaaguaacaucgugaucggaauuggcgauaaggcucucaagaucaauugguaccgcaaagggucuuccauuggaaagauguuugaggccacagcaagaggugccaggcggauggcuauacugggcgacacugccugggauuucgggagcguaggaggcguccuuaacucgcuggguaaaauggugcaucagaucuuugggucugcauauaccgcguuguucuccggcguuucauggauuaugaagaucggaaucggcgugcuccugacguggauuggguuaaauaguaaaaacacaagcauggcuuuuuccugcauagccaucggaauuaucacccuguacgucggcgugguagugcaggcagacauggguuguguuauuaauuggaaggggaaggaacuaaaaugcggaucuggcaucuucgucacuaacgaggugcacacauggaccgagcaguauaaguuucaagccgauagcccgaaacgacucgcuacugccauagcaggugcuugggaaaauggcgugugugggauccgcucaaccacaagaauggagaaccugcuuuggaagcagauugccaaugaauugaacuacauccugugggagaauaacauuaaacucacggucguugugggagacaucaccggcgugcuggaacagggggagaggacuuuaacaccucagcccauggagcugaaguauaguuggaaaaccuggggaaaggcgaagauaguaacagccgaaacucaaaauuccagcuucauuaucgauggcccaucuaccccugagugccccucagcuagucgggcauggaacgucugggaaguggaggacuacgguuuugggguuuucacgacaaacauuuggcuuaaauugcgcgaaguguauacccagcucugugaccacagacugaugagcgccgcugucaaggaugagagggccgugcaugcagacaugggauacuggaucgagucccagaaaaauggcucuuggaagcuagaaaaagcgucgcugauagagguuaagacuugcaccuggccaaagagccacacacucugguccaacggugugcuggaaucagauaugaucauucccaaaagucuugccggcccuaucucucagcauaaucaccguccaggguaccacacucaaaccgcuggaccguggcauuugggcaagcuggaguuagacuuuaacuauugcgaggggacaacgguagucauuagcgaaaauuguggaacccggggccccucccuccgaacuacaaccgugucagguaaacugauccacgaguggugcuguagaagcugcacucuuccuccacugagguacaugggggaagauggauguugguauggcauggagauacgccccauuaacgaaaaggaggagaauauggugaaaucuuuggccuccgcagguaguggcaaggucgacaacuucacaauggggguucucugccuggcuauccuauuugaagaggugaugcggggaaaguucagaaaaaagcauaugaucgccggcguacuguucaccuuugugcuccugcuuagcgggcagauuacguggagggauauggcacacacuuugaucaugauuggaucuaaugccuccgaccgcaugggcaugggugucaccuaccuggcuuuaauagcgacauucaaaauccagccuuuucucgcccugggguucuuucuucgaaagcugaccucacgggaaaaccuacuccugggagugggcuuggcaauggcugccacucugcguuuaccagaggauauugaacaaauggccaauggcaucgcucucgggcugauggcacuuaaacugauuacacaguucgagaccuaucaguuguggacagcccucguuagucugacuuguagcaacaccaucuuuacgcuaacaguggcguggagaaccgcuacucugauacuugccggaaucucgcuccugcccgucugccaguccucuagcaugaggaagaccgacugguugccgaugacaguggcagccauggguguuccuccacugcccuuauucauuuuuucacucaaggauacucugaaacgccggaguuggccucuuaaugagggcgugauggcugucgggcugguauccaucuuggcaucuagccuccugagaaacgacgugcccauggccggaccacuaguugcgggcggucugcuuauugcuuguuacgugaucaccgggacguccgccgaucucacagucgaaaaggcagccgacgugaccugggaggaagaggcugaacaaacuggaguaucacauaaucugaugauaacaguggacgaugacggcaccaugaggauuaaagaugacgagacugagaacaucuugacagucuuacugaagaccgcccuccugaucguuagcggcauuuucccuuauaguauacccgcaacgcuucugguguggcacacuuggcagaaacagacccagcgaucugggguguugugggaugucccauccccgccugaaacacaaaaggcugagcuagaagagggaguguaccgcaucaaacagcaggguauuuuuggcaagacccagguugggguaggagugcaaaaggagggcgucuuccacacaauguggcaugugacucggggugccguucugacccacaacgggaaaagacucgaacccaauugggcgagcgugaagaaagaccugaucucguacggaggcggcuggaggcuuucagcccagugggcaaaggggggagagacgcaggucauugcuguggaaccagguaaaaaccccaagaauuuucaaacaaugccuggcaucuuccagacuaccacaggggagauaggagccaucgcuuuagauuucaagccaggcaccucugguagucccauuaucaaccgugaagggaaaguagucggacuguauggcaauggcgugguuacuaagaacgggggauacguguccgguauugcacagaccaaugccgagcucgacggcccuacaccggaguuggaagaggaaauguuuaaaaagcgcaaccugacgaucauggaucuccauccagggagcggaaaaacucggaaguaucugcccgccauagucagagaggcuauuaagaggcgacuucggacccugaucuuggcgccuacacgcgugguugcagccgaaauggaggaggcucuaaaaggccugccaaucagauaccagaccacugccacaaagucugaacacaccgguagggagauuguggaccucaugugccaugcaacguucacuaugcgguuacugagccccguccgaggguccaauuauaaccuuaucauaauggaugaagcccacuuuacagacccugcuucaauugcggccaucggauacauuaguaccagagugggcaugggcgaggcagcugccaucuucaugaccgcaacuccgcccgggacaguagaugccuuuccacaaagcauaccucccauucaggacgaagagcgcgacaucccagagaggucuuggaauuccggaaacgaauggaucaccgauuucguggguaaaacaguuugguuugucccuucaauuaaggcuggcaaugacaucgccaacugucugcguaaaaaugggaagaaggugauucagcucagucggaaaacuuucgauacggaguaucagaagaccaaauugaacgacugggauuuuguggucacaacugacauaagcgaaaugggagcgaacuucaaggcagauagaguaaucuaccugaggcgcugccucaaacccgugauucugaccaauggcccagagcgaguuauccuugccgguccgaugccugugacagucgcuuccgccgcucaaagacgggggagggugggccgcaacccccagaaggagaaugaccaguacaucuuuaugggacagccacuaaacaaugaugaagaccacgcacauuggaccgaggccaagaugcuguuggauaacauuaauacucccgaaggcauaaucccugcuuuauucgagccagaacgugagaaaucugccgcaauugacggggaguauagacugaagggagaaucgcggaaaacguucguugagcucaugaggcgcggugaccugcccguguggcuugcgcacaaggucgccagcgaaggcaucaaauacaccgaucgaaaguggugcuuugacggggagagaaacaaucaaauucuggaagagaacauggauguggagaucuggacaaaagaaggagagaagaagaauuggcggccuagguggcucgacgcucgcacuuauucagauccguuggcccugaaagaauucaaggacuuugcagcuggcagaaaauccauagcccuagaucugguaaccgagaucgguagggugccaagucaucucgcacacacaguucggaacgcccuugacaaucuggucauguuacacaccucugaacaugggggccgugcuuaccgccacgcgguggaggaguugcccgaaacuauggagacacugcuccugcuuggacugaugauucucuugacgggcggggccaugcuguucuuaaucagcggaaaggguauuggcaaaaccuccaucgggcuaauaugugugauugcaucaucuggaaugcuguggauggcugaugucccucuccaguggaucgccagcgccauuguucuugaauuuuucaugauggugcuguugauccccgagccagagaagcagcgaacuccucaggacaaccaacuggcauauguagugauaggcauccucacacuggcugccauugucgcggcuaaugaaaugggucuucucgagaccaccaagagagaucuggggaugaguaaagaacccggcgugguuuccccaacaagcuacuuggacguggaucugcauccugccucugcauggacuuuauaugccgucgcuacgccgguaaucacccccaugcuaaggcacacaauugagaacucaacugcaaaugugucccuggccgcgaucgcuaaccaggccguugugcucaugggacuugacaagggcuggccaauaaguaaaauggaccugggggucccuuugcuggcacucggaugcuacagccaggugaacccccugacccuugccgcugccgucuuacugcucgugacacauuacgcaauuaucggcccagguuugcaagcuaaggccacccgggaagcgcagaaacgcacugccgcagggaucaugaagaauccuacgguugauggaauuaugacaaucgaccuggaucccgugauauaugacucgaaguuugagaaacagcuaggccagguaaugcugcucgugcuuugugcuguccaacuguugcugaugagaaccucuuggccgcucugcgagguucuggccuuagcaacugguccaauuaccacacuuugggaaggcuccccugggaaguucuggaacacuaccaucgcugugagcauggccaauauuuuuaggggaucauaccuggccggcgcggggcucgcuuucaguaucaugaaaucugucggaacaggcaagcgggguacggggucccagggagagacccuaggcgaaaaauggaagaagaaacugaaccaguugagccgaaaggaguuugaucuguauaaaaagucagguauaacugaaguggacagaacagaggcaaaagagggccucaagcgcggggaaaucacccaccacgccguaaguaggggaagcgcuaaacuucagugguucguggagcggaauaugguuuuucccgaaggccgugugauugaucugggguguggaagaggcgguugguccuacuauugcgccggguugaagaaggucacugaggugaggggauacacaaaaggcggcccagggcaugaagagcccgucccuaugucuaccuauggauggaacaucgugaagcugaugagcgguaaagacguuuucuaccucccgcccgagaagugugauacguuacugugcgacauuggcgaauccucaccaucuccuaccguagaggaaagucgcacaauccgggugcuuaaaauggucgagcccugggugaagaauaaccaauucuguauuaagguucugaauccuuacaugccaucggugaucgagcaccuagaaaaccuccagcgaaaacaugggggaauacuggucagaaaucccuugagcaggaacuccacucacgagauguauuggauuucuaauggcaccgguaacaucgugucaagcguaaauauggugucccgccugcuccuuaaccgguuuacaaugacucacagacguccuaccaucgaaaaggauguugaccugggggcaggaacaaggcaugucaacgccgagccagaaacccccaauauggaugugauuggcgagcggauaaaacgcaucaaggaggaacacaguucuacuuggcauuacgacgacgagaacccguauaaaacgugggcuuaccacggcagcuaugaagugaaggcgacagggucagccuccaguaugauuaauggagucguuaaguuacugaccaaaccuugggaugugguaccaauggugacucagauggcaaugaccgacacaacgcccuucggucagcaacgagucuuuaaggagaaaguggauaccagaacuccuaggccaaugcccggcacacggaagguuauggaaaucaccgcugagugguuguggcgcacucucgggagaaacaaaaggccgcgacugugcacacgggaggaauucaccaagaaggugcguacaaaugccgcaaugggagccgucuuuacugaggaaaaccagugggacagcgcuagagccgcgguggaggaugaagaguucuggaaacuaguagaccgcgagagggaacuucauaagcugggcaaaugugguucuugcguuuacaauaugauggggaagcgggagaaaaagcucggagaauuuggcaaagcaaaggauuccagagccauuugguauauguggcugggcgcucgcuacuuggaguucgaggcccugggguuucucaacgaagaccacugguucucaagggagaauagcuacucgggaguggaaggugagggccuucacaagcugggguauaucuuacgagauauaucuaaaaucccuggaggcgcaauguacgcugacgauaccgccgguugggacacgcggauuaccgaagacgaucugcauaacgaggagaagaucacacagcaaauggcuagagaacacaggcaguuggccaaugcaauuuuuaaacucacuuaucagaacaaggucgugaaagugcagcgccccaccccaaaggggacagucauggacaucauaagucguaaggaucaacggggauccggccagguuggcacuuacgggcugaauaccuucacgaacauggaggcgcagcuaauuagacagauggaaggagagggugugcuuagcaaagccgaccuggaaaauccucauccccucgagaagaaaaucacacaauggcuggagaccaagggcguagaaagguugaaacgcauggcuaucucaggggaugacugcguggucaagccaauugaugaccgauuugccaacgcauuacuggcucucaacgauaugggaaaggugcggaaagacauaccccaguggcagccuuccaagggcuggcacgauuggcagcaaguuccauucuguucucaccauuuccacgagcuuaucaugaaagacgguagaaagcugguggucccgugcaggccccaggaugaacuacuggggaaagcccgcauuagccagggagcaggcuggagucucagagagacugccuguuugggcaaggcguaugcucagauguggacacugauguacuuucaucggagggaccuucgucuggccuccaaugcaaucugcagcgccgugccuguacacuggguuccaaccucucgaacuaccuggucaauucaugcucaccaccaauggaugacaacggaagacaugcucaccguguggaaccgcgucuggaucgaggauaaucccuggauggaggacaagacuccugugacaaccugggaagauguuccauauuuagggaaaagagaggaccagugguguggaagucugauagguuugacuucccgggccacaugggcacagaacauccugaccgcuauucaacaggugaggagccucaucggcaaugaagaguuccuugauuacaugcccucuaugaagcgcuuuagaaaagaggaagagucggaaggggccauuugguga

SEQ ID NO: 15474 - RNA, 9873 nt, Artificial Sequence
  derived and/or modified CDS sequence (opt3) from DENV-3__EU529683__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacacugguugugugaucaauuggaaagggaaggagcugaagugcggauccggcauuuucgugacaaacgagguccauaccuggacugaacaguacaaauuucaagcagauucucccaagcggcuagccaccgcuaucgccggugcaugggagaauggcguuugugggauacgaagcacaacgcgcauggaaaaccuccuguggaaacagaucgcuaaugagcuuaacuauauuuugugggaaaauaacaucaagcugaccguggugguaggagacauuaucggcguccucgagcaggggaaaagaacucugacaccacagccuauggaguuaaaguacucauggaaaaccuggggaaaggccaggauagugacagcggaaacucaaaacaguuccuucauuaucgauggccccaauaccccagagugccccaacacgagccgggccuggaauguuugggaaguggaggacuaugguuuuggggucuucacaaccaacauuuggcugaagcuucgcgaaguguacacucaguugugugaccacagacucaugucugcugcaguuaaagaugagagggccgugcacgcugacaugggauacuggaucgagucacagaagaauggcaguuggaaacuggaaaaggccagccuaauagagguaaaaaccugcacauggccuaagucccauacucuguggucuaacgguguccucgaaucggauaugaucauuccaaagagccuggcaggcccgaucucccagcacaauuaucgucccggguaccauacccaaacagcgggaccuuggcaccuuggcaaauuggagcuggacuuuaacuauugcgaggggacgaccguggugauuacugaaaauuguggaacacggggcccaucauuacgaaccacuacagucagugguaagcucauccacgaguggugcuguagaucuugcacccugcccccucuuagguacaugggggaagauggauguugguauggcauggagauacgcccaauuagcgaaaaagaggagaacaugguuaagucccuggugucagccgguagcggcgaaguagacaauuucacgauggggguguugugccucgcuauccuguuugaggaagucaugcggggaaaauucggcaagaagcauaugaucgccgggguguucuuuacuuucguucuacugcucucuggacagauuaccuggagagauauggcacacacacugaucaugauuggcuccaacgcuaccgacaggauggguaugggggugacuuaccuugccuugauagcaacauuuaaaauccagcccuuccuggccuuaggauuuuuccuccgcaagcugaccagucgagagaaucuucugcuaggcgucggccucgcuauggcgacaacucugcaauugccggaagauauugagcagauggccaacgggaucgcacugggauuaauggcucucaaacugauuacccaguuugagacguaucagcuuuggacagcccugaucagcuugaccuguucuaauacuauauucacccucacaguggccuggcggacugcuacccugauccuagcagguguuucccugcuuccugugugccaaucaaguagcaugcguaagacggacuggcucccaaugacagucgccgcgaugggcguacccccucugcccuuguuuauuuucucgcugaaagauaccuuaaagagaagguccuggccacucaacgaaggggugauggcuguuggacuggugucuauccuugccagcucacuguugcgcaacgacgucccuauggcaggcccccucguggccggugggcugcuaauugcuuguuacguaaucacuggaacaagugcagaucugaccguggagaaggccgcggacgucacuugggaagaggaagcugagcagacaggcguuucccauaaucuuaugauaaccguggacgaugacggcacgaugcggauuaaagaugacgagacugaaaacauccucaccgugcuguugaagacagccuuacugaucgucucugggauuuuuccauacagcauaccggcaacccuccugguguggcacacauggcagaaacagacucaaagauccggaguucuuugggauguaccuucacccccagagacccagaaggccgaacuggaggaggguguguauaggaucaaacagcagggcauuuucgggaagacgcaagucggagugggcguucagaaagaagguguguuucauacaauguggcacgucacucgaggggcuguguugaccuacaauggaaagcgccuagagcccaacugggccagcguaaagaaagaccugaucaguuauggcggcggguggcggcucucugcacaguggcaaaagggagaagagguccaggugauugcuguugaaccugguaaaaauccaaagaacuuccagacaaugcccggcaccuuccagacuaccacaggggagaucggagccauagcgcuggauuuuaaaccuggcacguccgguagcccgaucauuaauagagaggggaagguggucggacuuuacggcaacggcgugguuacuaagaaugggggauaugugucggguaucgcccaaaccaacgcagaaccagacggccccacaccugaguuagaagaggaaauguucaaaaagaggaaucugaccauuauggaucuccacccagggucaggaaaaacucguaaguacuugcccgcuaucguccgcgaggccauaaaacggagacugaggacacucauucuggcuccuacccgagugguagcagccgagauggaagaggcccuuaagggccugccgauccgguaucagacgacugcuacaaagucugaacauaccggucgcgagaucguggacuugaugugccacgcgaccuuuacuaugagacuacugagucccguuagggucccaaacuacaaucucauuaucauggaugaagcacauuucacagacccugccuccauagcugcccggggguacauuagcacccgagugggaaugggcgaggcagccgcuaucuuuaugacagcgacucccccaggcacggccgaugcauucccucagucuaacgcucccauucaggacgaggaaagagacaucccagagcgcagcuggaauuccgggaacgaauggauaaccgauuuugccggaaaaacagugugguucgucccgucaauuaaggcagguaacgacaucgccaauuguuuaaggaaaaacggcaagaaaguaauccaacugagucguaagacuuuugauaccgaguaucagaagacaaaacuuaaugacugggauuucgugguuaccacugacauuagcgagaugggggcuaacuuuaaggccgaucgggugaucgacccuagaaggugccugaaacccgucauucucacggauggaccagaacgcgugauauuggcgggccccaugccuguuaccgcagccucugcugcccagcgaagaggucggguggggaggaauccacagaaggagaacgaccaauacaucuucacaggccagccccugaauaacgaugaagaccacgcucauuggacugaggcaaaaaugcuccuggacaauauuaacaccccugaaggaaucaucccggcccuuuucgagccagagcgcgaaaaguccgcugccauugauggcgaguaucgucuaaagggggaaucaagaaaaacauuugucgagcugaugcggaggggagacuugcccgugugguuagcacacaagguagcgagugaagguauaaaauacaccgaucgcaaguggugcuucgacggccagcgaaauaaccagauccuggaggagaauauggauguggaaauuuggacuaaagagggggaaaagaaaaagcucagaccucgguggcuggacgccaggacauauagcgauccccuugcucugaaggaguuuaaagacuucgccgcaggacgcaaguccaucgcucucgauuugguuacggaaauuggcagagucccaacccaccuggcccauaggacucggaacgcacuagacaaucuggugaugcuccacacaucugagcauggugggaaagccuaccgucacgcuguggaggaacuuccugagaccauggaaacccuguuauugcugggccucaugauccugcuuacaggaggcgcgaugcuguuucucauaucggggaagggaaucgguaaaacuagcauuggcuugaucugugucauugccucauccgggaugcuguggauggcagagauccccuuacaauggauagcuagugccauuguucuagaguucuuuaugauggugcugcucaucccagaaccugagaagcagcgcacgccgcaggauaaccaacuugccuauguagugauuggaauccugaccuuggcagcuauaaucgccgcgaaugaaaugggccugcucgagacaacuaagcgagaccuggguaugucuaaagaacccggggucgugagcccaaccuccuaccuugauguugaccuccacccugcuucagccuggacacuguacgcaguggccaccacugucauuacgcccauguugagacauacaaucgagaacucuaccgcuaacguaagccuggcagccauugcgaaucaggcugugguuuuaaugggccuagacaagggauggccaaucaguaaaauggaucugggcgugccucuccuugcccuggggugcuauucccaggucaaccccuugacucugaccgcagccgugcuccugcuuauaacacacuacgcuauuaucggaccgggcuuacaggccaaggcaacuagggaggcucaaaaacggaccgccgcggguaucaugaagaauccaacagucgacgggauuaugacgaucgaucuggacccugugauauaugauagcaaguucgaaaaacagcucggacagguuauguugcuggugcuaugugccguacagcugcuccuuaugcgcaccucuugggcacugugcgaggcuuugacucuggccacaggccccauuaccacucucugggaagguucaccaggcaaguuuuggaacacaaccaucgcaguguccauggcuaauauuuucagagggaguuaccuggccggagccggcuuagcguuuagcaucaugaaaucggucgggacgggaaagaggggcaccgguucucaaggggagacacuuggagaaaaauggaagaagaaacugaaccagcucucccggaaggaguucgaccuauauaaaaagagcggcauaacugagguugaucgaaccgaagcuaaagagggucugaagagaggcgaaaucacacaucacgcagugucacgcgggagugccaaauugcagugguuugucgagaggaauauggugauucccgaaggacggguaaucgaccugggcugugggcguggaggcuggucuuacuauugcgcuggucucaagaaggugacugagguuagaggguacaccaaaggaggcccuggccaugaggaaccggugcccauguccacauacggguggaacauugucaagcuuaugagcggaaaagauguguucuaucugccaccugagaagugugacaccuugcugugcgauaucggugaaucaagucccagcccuacugucgaggaguccaggacgauucgcgugcucaaaaugguugaaccaugguuaaagaauaaccaguucuguaucaagguacugaaucccuacaugccugccgugauagagcaccuugaacggcugcaacgaaaacacggcgggaugcuagucagaaacccacucucuaggaauagcacacaugagauguauuggauuuccaacggaaccggcaauaucguggcaucaguuaacauggugucucgccuguugcugaaccgguuuacuaugacccacagacgucccacaaucgaaaaggacgucgaucucggugccgggacgaggcaugugaaugcugagccggagaccccuaacauggacguaauuggagaacggauaaaacgcaucaaggaggaacacaauaguacuuggcacuacgacgaugagaacccauauaaaacaugggcguaccauggcucguaugaagugaaggccaccggcagcgcauccucuaugauuaaugggguugucaagcuucugacuaaacccugggacguggugccuauggucacacagauggcuaugaccgauacaacuccauucggacagcaacgaguuuuuaaggagaaaguggacaccagaacgcccaggucaaugccggguacccggcgcguaauggagaucacagccgaaugguuauggagaacucugggcaggaacaagaaaccucgauugugcacccgggaggaauucacaaagaaggugcguacuaaugcagccaugggggcugucuuuaccgaggaaaaccagugggauagcgccaaagcggcaguggaggacgaggauuucuggaagcucguugacagagaacgcgagcugcacaaacuaggaaaguguggcuccugcguguacaauaugauggguaaaagggaaaagaaacuuggggaguuuggaaaggccaagggcagucgggcuauuugguacauguggcugggcgccagauaucucgaguucgaagcacugggguuuuugaacgaggaucauugguucucucgcgaaaauagcuacucaggagucgagggugaaggccugcacaaacucggguauauccuuagggacauauccaagauccccggaggcgcuauguacgccgaugacacggcugguugggacacacgaauuaccgaggaugaccugcauaacgaggaaaaaaucacucagcagauggauccagagcaccggcaauuagccaaugcaauuuuuaagcugacauaucagaacaaagugguaaagguucagagaccuacccccacugggaccgugauggacaucauaaguaggaaggaucagcgcggaagcggccaagucggcacauacggguugaauacguucaccaacauggaagcgcagcucauucgucagauggagggagaaggugugcugucuaaagccgaccuagagaacccacaccuucccgagaagaaaaucacucaguggcuggaaacaaagggcguggagcggcucaaaagaauggcuaucuccggggaugacugcgucguuaagccuauugaugacagguuugccaaugcacuguuggcuuuaaacgauaugggaaaggugcgcaaagacauaccacaauggcagccgucaaagggcuggcaugauuggcagcagguacccuucuguagccaccauuuccacgaacugaucaugaaagacggucgaaagcucguggucccuugccggccacaagacgagcuuauugggagagccaggaucucgcagggagcaggcuggucucugcgcgaaaccgccugucuaggcaaagcguaugcucagauguggagucugauguacuuucacagacgggaucucagguuggccuccaaugcaauuugcagcgccgugcccguucauugggugccuacuucacguacaaccugguccauccacgcucaucaccaauggaugacgacagaggacaugcugaccgucuggaaccgaguguggauagaggauaauccauggauggaagacaagacucccguaaccacaugggagaacguuccuuaccuugggaagcgcgaagaucagugguguggaucucugaucggucucacuagcagagccaccugggcacagaauauuccgacagcuauccagcaagugcggaguuuaauuggcaacgaggaguuccuggacuauaugccauccaugaaaagguuucgcaaggaagaggaaagcgagggggccaucugguga

SEQ ID NO: 15475 - RNA, 9873 nt, Artificial Sequence
  derived and/or modified CDS sequence (opt3) from DENV-3__EU529684__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagaaacuagccacugcuaucgccggugcaugggagaauggcguuugugggauacggagcaccacacgaauggaaaaccuccuguggaagcagaucgcuaaugagcuuaacuauauuuugugggaaaauaacaucaaacugacgguggugguaggagacauuaucggcguccucgagcaggggaagcgcacccugacuccacagccuauggaguuaaaauacucauggaagacauggggaaaggccaaaauagugaccgcggaaacacaaaacaguuccuucauuaucgauggccccaauacuccagagugccccagcgccucuagagcuuggaacguuugggaaguggaggacuaugguuuuggggucuucaccacgaauauuuggcugaagcuuagggaaguguacacacaguugugugaccaccggcucaugucagcagccguuaaagaugagcgcgcugugcacgccgacaugggauacuggaucgagagucagaagaacggcagcuggaaacuggaaaaggcaucccuaauagagguaaagaccugcacuuggccuaaaucucauacccuguggucgaaugguguccucgaaagcgauaugaucauuccaaagucccuggcgggcccgaucucacagcacaacuauagacccggguaccauacacaaacugccggaccuuggcaccuuggcaaauuggagcuggacuuuaauuauugcgaggggaccacaguggugauuacggaaaacuguggaaccaggggcccaaguuuacguacuacaaccgucucugguaagcucauccacgaguggugcugucggagcugcacucugcccccucuucgauacaugggggaagauggauguugguauggcauggagauaagaccaauuuccgaaaaagaggagaauaugguuaagucacuggugagcgcugguucuggcgaaguagacaacuucacaauggggguguugugccucgccauccuguuugaggaagucaugaggggaaaguucggcaaaaagcauaugaucgcagggguguucuuuaccuucguucuacugcucuccggacagauuacguggcgcgauauggcucacacucugaucaugauuggcaguaaugccagcgaccggauggguaugggggugaccuaccuugcauugauagccacauuuaaaauccagcccuuccuggcuuuaggauuuuuccucagaaagcugaccucuagggagaaccuucugcuaggcgucggccucgcgauggccacuacacugcaauugccggaagauauugagcagauggcaaaugggaucgcucugggauuaauggcccucaaacugauuacccaguuugagacauaucagcuuuggacugcccugaucuccuugaccuguucaaacacgauauucacacucaccguggcuuggcgcacugcaacccugauccuagccgguguuagucugcuuccugugugccaaagcucguccaugcgaaagacagacuggcucccaaugacugucgcggcuaugggcguacccccucugcccuuguuuauuuucucucugaaggauaccuuaaaacggcguagcuggccacucaaugaaggggugauggccguuggacuggugucaauccuugcaaguucccuguugagaaacgacgucccuauggccggcccccucguggcuggugggcugcuaauugcauguuacguaaucacgggaacaucugccgaucugaccguggagaaggcggcugacgucacuugggaagaggaagccgagcagacaggcguuagccauaaccuuaugauaaccguggacgaugacggcacuaugaggauuaaagaugacgagacagaaaauauccucaccgugcuguugaagacggcauuacugaucgucuccgggauuuuuccauacucaauaccggccacucuccugguguggcacaccuggcagaaacagacacaacgcagcggaguucuuugggauguaccuagucccccagagacccagaaggcugaacuggaggaggguguguaucggaucaaacagcagggcauuuucgggaagacacaagucggagugggcguucagaaggaagguguguuucauacuauguggcacgucaccagaggggccguguugacguacaacggaaaaaggcuagagcccaauugggcaucuguaaagaaagaccugaucuccuauggcggcggguggcgacucagcgcucaguggcaaaagggagaagagguccaggugauugccguugaaccugguaaaaacccaaagaauuuccagacaaugcccggcacuuuccagaccacaaccggggagaucggagcgauagcccuggauuuuaagccuggcacuucggguucaccgaucauuaaccgcgaggggaaaaucgugggacuuuacggcaauggcgucgugaccaagaacgggggauauguuucugguauugcacaaacaaaugcugaaccagacggccccacgccugaguuagaagaggaaauguucaaaaagcggaaccugacuaucauggaucuccacccagggaguggaaaaaccagaaaguacuugcccgccauagugagggaggcuauuaagcgucgccugcggacacucauccuggcaccuaccagagucguggccgccgagauggaagaggcucuuaaaggccugccgaucagguaucagacuacagcgaccaaguccgaacauacgggucgagagauuguagacuugaugugccacgcaacuuuuacaaugcggcuacugagccccgugcgcguuccaaauuacaaccucaucauaauggaugaagcccauuucaccgacccugcuucuauugccgcaagaggguacaucagcaccagggucggaaugggcgaggccgcugcgauuuuuaugacugccacacccccaggcaccgcagaugcuuucccucaguccaaugcccccauccaggacgaggaacgggacauaccagagcgaucauggaacagugggaaugaauggauuacagauuuugcaggaaaaacugugugguucgugccgagcaucaaggccgguaacgacaucgcuaacuguuuaagaaaaaauggcaagaaggucauucaacugucucgcaaaacguuugauaccgaguaucagaagacaaaacuuaacgacugggauuucguagugacuaccgacaucuccgagaugggggccaauuuuaaggcggauaggguuauugacccucgucggugccugaaacccgugauacucacagauggaccagaaagagucaucuuggcaggccccaugccugugaccgccgcuucagccgcucagaggcgcggucgaguugggagaaacccacagaaggagaaugaccaauacauuuucacuggccagccccugaacaaugaugaagaccacgcacauuggacggaggccaagaugcuccuggacaacaucaauaccccugaaggaaucauuccggcucuuuucgagccagagcgggaaaaaagugccgcaauagauggcgaguauaggcuaaagggggaaagccgcaaaacauuuguggagcugaugcguagaggagacuugcccgucugguuagcgcacaagguggccuccgaagguaucaaauacacugaucggaaguggugcuucgacggccagaggaacaaucagauucuggaggagaacauggauguagaaaucuggaccaaagagggggaaaagaagaaacuccgcccucgauggcuggacgcuagaacauauucugauccccuugcccugaaggaguuuaaagacuucgcagcuggacggaagucgauugcccucgauuuggugaccgaaaucggcaggguuccaacucaccuggcacaucgcacaagaacggcccuagacaaucuggucaugcuccacaccagcgagcauggugggaaagcuuacaggcacgcgguggaggaacuuccugagacuauggaaacacuguuauugcugggccucaugauacugcuuaccggaggcgccaugcuguuucucaucucagggaagggaauugguaagaccuccaucggcuugauuugugugaucgcaaguucugggaugcuguggauggcugagauacccuuacaauggauugccagcgccaucguccuagaguucuuuaugaugguucugcucauuccagaaccugagaaacagcggacaccgcaggauaaccaacuugcauaugugguaaucggaauacugacuuuggcugccaucauugcggcuaaugaaaugggccugcucgagacgaccaagcgugaccuggguauguccaaagaacccgggguggucucaccaacaucuuaccuugauguggaccuccacccugccagcgcauggacucuguacgccguugcuaccacagugaucacccccauguugcgccauacuauugagaacaguacggcaaaugucucccuggccgcgaucgcuaaccaggccguaguguuaaugggccuagacaagggauggccaauaagcaaaauggaucugggcguuccucuccuugcacuggggugcuauucucaggugaaccccuugacacugaccgccgcuguccuccugcuuauuacucacuacgccaucaucggaccgggcuuacaggcaaaggcuacccgagaggcccaaaagagaacagcggccgguauuaugaaaaauccaacuguggacgggaucaugaccauagaucuggacccugucauuuaugauucaaaguucgaaaaacagcucggacaggugauguugcugguucuaugugcagugcagcugcuccuuaugaggacauccugggcucugugcgaggccuugacgcuggcaaccggccccaucacuacacucugggaagguaguccaggcaaguuuuggaacaccacuauugcuguaagcauggccaauaucuuccgggggucguaccuggccggagcgggcuuagcuuuuucuauaaugaaauccguggggacaggaaagcgcggcaccgguagccaaggggagacgcuuggagaaaaguggaaaaagaaacugaaccagcucucaagaaaggaguucgaccuauauaaaaagaguggcaucaccgaggucgauaggacagaagcaaaagagggucugaagcggggcgaaauuacucaucacgccguuucucgaggguccgcuaaguugcagugguuuguggagagaaauauggucauccccgaaggacgcgugauugaccugggcugugggaggggaggcuggagcuacuauugcgccggucucaaaaagguaaccgaggugcggggguacacaaaaggaggcccuggccaugaggaaccgguucccaugucaacuuacggguggaacaucgugaagcuuaugaguggaaaagaugucuucuaucugccaccugagaagugugacaccuugcugugcgauauuggugaaagcucccccucuccuacaguggaggagagccguaccaucagaguccucaagaugguggaaccaugguuaaaaaauaaccaguucuguauaaagguucugaaucccuacaugccuacuguaauugagcaccuugaaaggcugcaacgcaaacacggcgggaugcuagugcggaacccacucucccgaaauucaacgcaugagauguauuggaucucuaacggaacaggcaauaucgucgcaagugugaacaugguuucgagacuguugcugaauagguuuaccaugacucaccgccggcccaccauugaaaaggacguggaucucggugccgggacaagacaugucaacgcugagccggagacgccuaacauggacgugauaggagaacguaucaaaaggauuaaggacgagcacaauagcaccuggcacuacgaugacgaaaacccauauaagacuugggcguaccauggcuccuaugagguaaaagccacaggcucugcaucaagcaugaucaauggggugguuaagcuucugaccaaacccugggaugucgugccuauggugacucagauggcuaugacagacaccacaccauucggacagcaacgggucuuuaaggaaaaaguugauacucgcaccccccgauccaugccggguacgagaagggugaugggcauuaccgccgagugguuauggcggacacuggggcgcaacaagaagccuagauugugcacuagggaggaauucaccaaaaagguacgaacaaaugcagccaugggagcuguguuuacugaggaaaaccagugggacagugccaaagcggcagucgaggaugaagacuucuggaagcucguggaucgggagcgugagcugcacaaacuaggcaagugugguucuugcguuuacaauaugauggggaaaagagaaaagaagcuuggagaguuuggcaaagccaagggcagccgcgcuaucugguacauguggcugggggccagguaucucgaauucgaggcacugggauuuuugaacgaggaccauugguucucacgggaaaauuccuacagugguguggagggcgaagggcugcacaaacucggauauauacuuagagauaucagcaagauucccggcggugcuauguacgccgacgacaccgcugggugggauacgcgcaucacagaggacgaucugcauaacgaagagaaaauuacccagcagauggacccagagcacaggcaauuagccaaugcaaucuuuaagcugacuuaucagaacaaggucgugaaaguacagcgaccuacacccaccggaacuguuauggauauaauuucucggaaggaccagagaggcuccggccaaguggggaccuacggauugaauacauucacgaacauggaagcgcagcucaucaggcagauggagggugaaggcguccugucaaaagccgaucuagagaauccacaccuucccgaaaagaaaaucacccaguggcuggagacuaaggggguggagcgccucaagcguauggcuauuagcggagacgauugcguggucaaaccuauagacgaucgguuugccaacgcacuguuggcuuuaaacgacaugggcaagguuagaaaagauaucccacaauggcagccgucgaaggguuggcaugacuggcagcaggugcccuucuguucucaccauuuccacgaacugauuaugaaagacgggaggaagcucguagugccuugccgcccacaagaugagcuuaucggacgagcccggauuagucagggcgcaggcuggucccugagagaaacagccugucuagggaaggcguaugcucagauguggagccugauguacuuucacaggcgcgaccucagauuggccucaaaugcaaucugcuccgccguccccgugcauuggguuccuaccucucggacuacauggagcauacacgcucaucaccaauggaugaccacggaggauaugcugacaguguggaacagggucuggaucgaagacaauccauggauggaggauaaaacccccgugacuaccugggagaacguaccuuaccuuggaaagcgugaagaccaguggugugguagucugauuggccucacaucccgagccacuugggcacagaauaucccgaccgcuauucagcaaguucgcagcuuaaucgggaacgaggaauuccuggauuauaugccaucuaugaaaagauuucggaaggaggaggaaucagagggagccauuugguga

SEQ ID NO: 15476 - RNA, 9873 nt, Artificial Sequence
  derived and/or modified CDS sequence (opt3) from DENV-3__FJ182015__SS-prME
accagccugugccucaugaugauccuuccagccgcucuggcauuccacuugacauccagagacggcgagccuaggaugauuguggggaagaacgaacggggaaaaucuuuacuguuuaagacugccucagguauaaauauguguacgcuaaucgcgauggaucucggcgaaaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucucucugaaggauaccuuaaagcguagaagcuggccacucaaugaaggggugauggccguuggacuggugucaauccuugcaaguucccuguugaggaacgacgucccuauggccggcccccucguggcuggugggcugcuaauugcauguuacguaaucacgggaacaucugccgaucugaccguggagaaagcggcugacgucacuugggaagaggaagccgagcagacaggcguuagccauaaccuuaugauaaccguggacgaugacggcacuaugcgcauuaaggaugacgagacagaaaauauccucaccgugcuguugaaaacggcauuacugaucgucuccgggauuuuuccauacucaauaccggccacucuccugguguggcacaccuggcagaagcagacacaacggagcggaguucuuugggauguaccuagucccccagagacccagaaagcugaacuggaggaggguguguauagaaucaagcagcagggcauuuucgggaaaacacaagucggagugggcguucagaaggaagguguguuucauacuauguggcacgucaccagaggggccguguugacguacaacggaaagcgacuagagcccaauugggcaucugucaagaaggaccugaucuccuauggcggcggguggcgccucagcgcucaguggcaaaaaggagaagagguccaggugauugccguugaaccugguaagaaccccaagaauuuccagacaaugcccggcacuuuccagaccacaaccggggagaucggagcgauagcccuggauuuuaagccuggcacuucggguucaccgaucauuaaccgggaggggaagguggucggacuuuacggcaauggcgugguuaccaaaaacgggggauaugugucugguaucgcacaaacaaaugcugaaccagacggccccacgccugaguuagaagaggaaauguucaagaaaagaaaccugacuauuauggaucuccacccagggaguggaaagaccaggaaauacuugcccgccaucguccgugaggcuauaaagcgccggcugagaacacucauucuggcaccuaccagggugguagccgccgagauggaagaggcucuuaagggccugccgauccgauaucagacuacagcgaccaaauccgaacauacgggucgggagaucguggacuugaugugccacgcaacuuuuacaaugcgccuacugagccccguuagagucccaaauuacaaccucauuaucauggaugaagcccauuucaccgacccugcuucuauagccgcaaggggguacauuagcacccgggugggaaugggcgaggccgcugcgaucuuuaugacugccacacccccaggcaccgcagaugcuuucccucaguccaaugcccccauucaggacgaggaacgagacaucccagagagaucauggaacagugggaaugaauggauaacagauuuugcaggaaagacugugugguucgucccgagcauuaaagccgguaacgacaucgcuaacuguuuacgcaagaauggcaaaaagguaauccaacugucuaggaagacguuugauaccgaguaucagaaaacaaaacuuaacgacugggauuucgugguuacuaccgacauuuccgagaugggggccaauuuuaaagcggaucgugugaucgacccucggagaugccugaagcccgucauucucacagauggaccagaaagggugauauuggcaggccccaugccuguuaccgccgcuucagccgcucagcgccgagguagaguggggcggaacccacagaaagagaaugaccaauacaucuucacuggccagccccugaacaaugaugaagaccacgcacauuggacggaggccaagaugcuccuggacaacauuaauaccccugaaggaaucaucccggcucuuuucgagccagagagggaaaagagugccgcaauugauggcgaguaucgccuaaaaggggaaagccguaagacauuugucgagcugaugagacggggagacuugcccgugugguuagcgcacaaaguagccuccgaagguauaaaguacacugauaggaaauggugcuucgacggccagcgcaacaaucagauccuggaggagaacauggauguggaaauuuggaccaaggagggggagaaaaagaagcuccgaccuagauggcuggacgcucggacauauucugauccccuugcccugaaagaguuuaaggacuucgcagcuggaaggaaaucgaucgcccucgauuugguuaccgaaauuggccgcgucccaacucaccuggcacauagaacaaggaaugcccuagacaaccuggugaugcuccacacgagcgagcauggugggaaggcuuaccggcacgcgguggaggaacuuccugagaccauggaaacucuguuauugcugggccucaugauccugcuuacaggaggcgccaugcuguuucucauaucagggaaaggaaucgguaagaccuccauuggcuugaucugugucauugcaaguucugggaugcuguggauggcugagauccccuuacaauggauagccagcgccauuguucuagaguucuuuaugauggugcugcucaucccagaaccugagaagcagcguaccccgcaggauaaucaacuugcauauguagugauuggaauccugacauuggcugccauaaucgcggcuaacgaaaugggccugcucgagacuacgaaacgcgaccuggguauguccaaggaacccggggucgugucaccaaccucuuaccuugauguugaccuccacccugccagcgcauggacacuguacgccguggcuacuaccgucauuacacccauguugcgacauaccaucgagaauaguacugcaaacguaucccuggccgcgauugcuaaccaggccgugguuuuaaugggccuagacaaaggauggccaaucagcaagauggaucugggcgugccucuccuugcacuggggugcuauucucaggucaaucccuugacgcugacagccgcugugcuccugcuuauaacccacuacgccauuaucggaccgggcuuacaggcaaaagcuacuagagaggcccaaaagaggaccgcggccgguaucaugaagaacccaacagucgacgggauuaugacuaucgaucuggacccugugauauaugauucaaaauucgaaaagcagcucggacagguuauguugcuggugcuaugugcaguacagcugcuccuuaugcggaccuccugggcucugugcgaggccuugacacuggcaacgggccccauuaccacucucugggaagguaguccaggcaaauuuuggaauacaaccaucgcugugagcauggccaacauuuuccgcgggucguaccuggccggagcgggcuuagcuuuuucuaucaugaaguccgucgggacuggaaaaagaggcacagguagccaaggggagacccuuggagaaaaguggaagaaaaagcugaaucagcucucaaggaaagaguucgaccuauauaagaaaaguggcauaacggagguugaucggaccgaagcaaaggagggucugaaacgaggcgaaaucacacaucacgccgugucuagaggguccgcuaaguugcagugguuugucgagcgcaacauggugauucccgaaggaaggguaaucgaccugggcugugggcggggaggcuggagcuacuauugcgccggucucaagaaagugacugagguucguggguacaccaagggaggcccuggccaugaggaaccggugcccaugucaacauacggguggaauauugucaaacuuaugaguggaaaggauguguucuaucugccaccugagaaaugugacacuuugcugugcgauaucggugaaagcucccccucuccuaccgucgaggagagcagaacaauuagggugcucaagaugguugaaccaugguuaaagaacaaucaguucuguaucaaaguacugaaccccuacaugccuaccgugauagagcaccuugaacgccugcaacggaagcacggcgggaugcuaguccgaaauccacucuccagaaacucaacucaugagauguauuggauuucuaauggaacgggcaacaucguggcaaguguuaauauggugucgaggcuguugcugaaccgcuuuacaaugacccaccggagacccacuaucgaaaaagacgucgaucucggugccgggacccgucaugugaacgcugagccggagacaccuaauauggacguaauuggagaaaggauaaagcggaucaaagaggaacacaacagcacguggcacuacgacgaugagaauccauauaagaccugggcguaccauggcuccuaugaagugaaggccacuggcucugcaucaagcaugauuaacgggguugucaaacuucugacaaagcccugggacguggugccuauggucacccagauggcuaugacugauacaaccccauucggacagcaacgcguuuuuaaagagaagguggacacacgaacucccagauccaugccggguaccaggcggguaaugggcaucacggccgagugguuauggcgcacccuggggagaaauaaaaagccuagguugugcacacgagaagaguucacuaagaaagugcggaccaacgcagccaugggagcugucuuuacagaagagaaucagugggauagugccaaggcggcaguggaagacgaggauuucuggaaacucguugaccgugagagagaacugcacaagcuaggcaaaugugguucuugcguguacaacaugauggggaagcgcgagaagaaacuuggagaauuuggcaaagccaaaggcagcagggcuauuugguacauguggcugggggcccgguaucucgaguucgaggcacugggauuuuugaaugaagaucauugguucucaagagagaacuccuacaguggugucgaaggcgaggggcugcacaagcucggauauauccuucgcgacauaagcaaaauccccggcggugcuauguacgccgaugacacugcugggugggacaccaggauuacggaagaugaccugcauaaugaggagaagaucacacagcagauggauccagaacaccgacaauuagccaacgcaauuuuuaaacugaccuaucagaauaaggugguaaagguucagcggccuacucccacaggaaccgugauggacaucauaucuagaaaagaucagaggggcuccggccaagucgggacuuacggauugaacaccuucacaaauauggaggcgcagcucauucgccagauggaaggugagggcgugcugucaaaggccgaccuagaaaacccacaccuucccgagaaaaagaucacgcaguggcuggagaccaaagggguggaacgucucaagcggauggcuaucagcggagaugacugcgucguuaagccuauugaugacagauuugccaacgcacuguuggcuuuaaaugauaugggcaaagugaggaaggacauaccacaauggcagccgucgaaagguuggcaugauuggcagcagguacccuucuguucucaccauuuccacgagcugaucaugaaggacgggcgcaaacucguggucccuugccgaccacaagacgaacuuauuggacgggccagaaucagucagggcgcaggcuggucccugagggagacugccugucuagggaaggcguaugcucagauguggagccugauguacuuucaccgcagagaucuccgguuggccucaaacgcaauuugcuccgccgugcccguucauugggugccuacaucuaggaccacuuggagcauccacgcucaucaccaauggaugacaaccgaagacaugcugacggucuggaaucguguguggauagaggauaacccauggauggaggacaagacacccguaaccacuugggaaaauguuccuuaccuuggaaaacgagaggaucaguggugugguagucugaucggccucaccucccgcgccacaugggcacagaacauuccgacugcuauccagcaagugaggagcuuaauugggaaugaagaguuccuggacuauaugccaucuaugaagcgguuuaggaaagaggaagagucagaaggagccaucugguga

SEQ ID NO: 15477 - RNA, 9873 nt, Artificial Sequence
  derived and/or modified CDS sequence (opt3) from DENV-3__EU569688__SS-prME
accagccugugccucaugaugauccuucccgcagcucuggcauuccacuugaccuccagggacggagagccuaggaugauuguggggaagaacgaacggggaaaaucuuuacuguuuaagacugccucagguauaaauauguguacgcuaaucgcgauggaucucggcgaaaugugcgacgauaccgucacauacaaauguccacauauuacugaagcugagccggaagacaucgauugcugguguaaccugaccaguacauggguuaccuaugggacuugcaaucaggccggagagcaccgccgagacaagcguagcguggcacuugcaccacaugucggcaugggucuggauacaagaacccagacguggauguccgcugagggggcauggagacagguggaaaaagucgagacuugggccuugcggcacccuggauucaccauucucgcucuguuucuggcccauuacaucggcacaucucucacucagaaggugguuauauucaucuuacugaugcuugugaccccaucgaugacaaugcgcugugucggcguggggaacagagacuuuguagaaggauugucaggugcgaccuggguugaugugguccuggagcacggcgggugcgugacgacuauggcaaagaauaaacccacacuagacauugagcuccagaagaccgaagccacucagcuggcuacacuuaggaaacuguguaucgagggaaagauuaccaacaucacgaccgauagccggugcccuacacagggcgaagccguguugccagaggaacaggaccagaauuaugucuguaaacacacuuacguugaucgcgguugggggaacggaugcggccucuucggcaaggggagucuggugaccugcgcaaaguuucaauguuuagagcccauagagggaaaaguagugcaguaugaaaaucugaaguacacagucauuaucacugugcauaccggugaccagcaccagguuggcaacgagacacaaggggugaccgcugaaauuacuccucaggccuccacgacagaggcgauccucccagaauauggaacccuuggccuggagugcucuccgcgaacugguuuggacuucaaugagaugauccuacugaccaugaaaaacaaggccuggaugguccauagacagugguuuuucgaucucccccugccuuggacaagcggggcaaccacugaaacaccaacguggaauaggaaagagcuucuggugaccuuuaagaacgcucacgccaaaaagcaagaaguaguuguguugggcucccaggagggagcuaugcacacugcccucacaggcgcaaccgaaauucaaaauucagggggaacaaguauauucgccggucaucugaagugucgguuaaaaauggacaagcuggagcuaaaaggcaugagcuacgcuaugugcacuaacaccuuuguccucaagaaagaggugucugaaacgcagcacgggaccauccugauuaaggucgaguacaagggagaagaugugcccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgccggugcuugggagaauggcgucugugggauacgaagcaccacacgcauggaaaaccuccuguggaaacagaucgccaaugagcuuaacuauauuuugugggaaaauaacaucaagcugacgguuguggugggagacaccauuggcguacucgagcaggggaaaagaacucugacaccacagccuauggaguuaaaguacucauggaaaaccuggggaaaggcgaagaucgucacagccgaaacucaaaacaguuccuucauaauugauggccccaauaccccagagugccccagcgcuucuagggcauggaacgugugggaaguugaggacuaugguuuugggguguucacgacaaauaucuggcugaaacuucgggaagucuacacccaguugugugaccaccgccucaugucagccgcugugaaggaugagagagccguucacgcagacaugggauacuggauugagagucagaaaaacggcagcuggaagcuggaaaaagcgucccuaaucgaggugaagacuugcaccuggccuaagucucauacacuguggucgaaugguguacucgaaagcgauaugauaaucccaaaaucccuggccggcccgauuucacagcacaacuauaggcccggguaccauacucaaaccgcuggaccuuggcaccuuggcaaguuggagcuggacuuuaauuauugcgaggggacaacggucgugaucaccgaaaacuguggaacucguggcccaaguuuacggacaaccacugugucugguaaacucauucacgaguggugcugucgaagcugcacacugcccccucuuagauacaugggggaagauggauguugguauggcauggagaucaggccaauauccgaaaaggaggagaauauggucaaaucacugguuagcgccgguucuggcgaaguggacaacuucaccauggggguauugugccucgcaauucuguuugaggaagugaugcgcggaaaguucggcaagaaacauaugaucgcuggggucuucuuuacguucgugcuacugcucuccggacagaucacuuggcgggauauggcccacacccugauuaugaucggcaguaaugcaagcgacagaauggguauggggguuacauaccuugccuugauugcuaccuuuaagauacagcccuuccuggcguuaggauuuuuccucaggaaacugacuucucgcgagaaccuucugcuaggcgugggccucgccauggcaacaacccugcaauugccggaagauaucgagcagauggcuaaugggauugcccugggauuaauggcccucaagcugaucacacaguuugagacuuaucagcuuuggaccgcucugauuuccuugacguguucaaacacaaucuucacccucacugucgcauggcgaaccgccacacugauacuagcgggugugagucugcuuccuguuugccaaagcucguccaugcggaaaacugacuggcucccaaugaccguggcugccaugggcguacccccucugcccuuguuuaucuucucucugaaggauacguuaaagcguagaagcuggccacucaaugaagggguaauggcagugggacugguuucaauucuugccaguucccuguugaggaacgacgugccuauggcuggcccccucgucgccggugggcugcuaaucgccuguuacgugauuacaggaaccucugcggaucugacuguagagaaagcugccgacgugacaugggaagaggaagcagagcagaccggcgucagccauaaccuuaugaucacuguugacgaugacggcacaaugcgcauaaaggaugacgagaccgaaaauauucucacggugcuguugaaaacugccuuacugaucguguccgggaucuuuccauacucaauuccggcuacccuccuggucuggcacacauggcagaagcagacccaacggagcggagugcuuugggauguuccuagucccccagagacacagaaagccgaacuggaggaggguguauauagaauaaagcagcagggcaucuucgggaaaacucaagugggagucggcgugcagaaggaagguguuuuucauaccauguggcacgugacgagaggggcagucuugacauacaacggaaagcgacuagagcccaauugggcuucugugaaaaaggaccugauuuccuauggcggcggguggcgccucagcgcccaguggcaaaaaggagaagagguacaggucaucgcgguggaaccugguaagaaccccaagaauuuccagacuaugcccggcaccuuccagacaaccacuggggagauuggagccaucgcacuggauuuuaagccuggcaccucggguucaccgauaaucaaccgggaggggaagguugugggacuuuacggcaauggcgucgugaccaagaacgggggauauguuucugguauugcucaaacgaaugccgaaccagacggccccacuccugaguuagaagaggaaauguucaagaaaagaaaccugaccaucauggaucuccacccagggaguggaaagacaaggaaauacuugcccgcuauugugcgugaggcaaucaagcgccggcugagaacccucauacuggccccuacuagggucguggccgcugagauggaagaggcgcuuaagggccugccgauucgauaucagacaaccgcaacgaaauccgaacauacuggucgggagaucguagacuugaugugccacgccacauuuaccaugcgccuacugagccccgugagaguuccaaauuacaaccucaucauuauggaugaagcucauuucaccgacccugccucuaucgcagccaggggguacauaagcacucgggucggaaugggcgaggcugcggccauuuuuaugacagcaacacccccaggcacagcugaugccuucccucaguccaaugcacccauccaggacgaggaacgagacauuccagagagaucauggaacagugggaaugaauggaucacugauuuugccggaaagacggugugguucgugccgagcauaaaagcugguaacgacauugccaacuguuuacgcaagaauggcaaaaaggucauccaacugucuaggaagaccuuugauacagaguaucagaaaacuaaacuuaacgacugggauuucguagugaccacagacaucuccgagaugggggcgaauuuuaaagcagaucguguuauugacccucggagaugccugaagcccgugauccucaccgauggaccagaaagggucauuuuggccggccccaugccugugacugcugccucagcugcacagcgccgagguagaguugggcggaacccacagaaagagaaugaccaauacauauucacgggccagccccugaacaaugaugaagaccacgcccauuggaccgaggcuaagaugcuccuggacaacaucaauacaccugaaggaauuaucccggcccuuuucgagccagagagggaaaagagugcagcgaucgauggcgaguaucgccuaaaaggggaaagccguaagacuuuuguggagcugaugagacggggagacuugcccgucugguuagcccacaaaguggcuuccgaagguauuaaguacaccgauaggaaauggugcuucgacggccagcgcaacaaucagauacuggaggagaacauggauguagaaaucuggacaaaggagggggagaaaaagaaacuccgaccuagauggcuggacgcccggaccuauucugauccccuugcacugaaagaguuuaaggacuucgcugccggaaggaaaucgauugcacucgauuuggugacugaaaucggccgcguuccaacacaccuggcccauagaacgaggaaugcucuagacaaccuggucaugcuccacaccagcgagcauggugggaaggcguaccggcacgccguggaggaacuuccugagacuauggaaacacuguuauugcugggccucaugauucugcuuaccggaggcgcaaugcuguuucucaucucagggaaaggaauagguaagaccuccaucggcuugauuugugugaucgcuaguucugggaugcuguggauggccgagauucccuuacaauggaucgccagcgcaauaguccuagaguucuuuaugaugguucugcucauuccagaaccugagaagcagcguacaccgcaggauaaucaacuugcuuaugugguaaucggcauucugacuuuggccgcgaucauagcugccaacgaaaugggccugcucgagacgaccaaacgcgaccuggguauguccaaggaacccgggguggucucaccaacaucuuaccuugauguggaccuccacccugcaagcgccuggacucuguacgcuguugcaaccacagugaucacccccauguugcgacauacuauugagaauaguacggccaacgucucccuggcggcuaucgccaaccaggcaguaguguuaaugggccuagacaaaggauggccaauuagcaagauggaucugggcguuccucuccuugcccuggggugcuauucucaggugaaucccuugacacugaccgcugccguccuccugcuuaucacucacuacgcaauaauuggaccgggcuuacaggcuaaagccaccagagaggcgcaaaagaggacagccgcagguaucaugaagaacccaacuguggacgggaucaugaccauugaucuggacccugucaucuaugauucaaaauucgaaaagcagcucggacaggugauguugcugguucuaugugcugugcagcugcuccuuaugcggacauccugggcccugugcgaggcauugacgcuggcuaccggccccauaacuacacucugggaagguaguccaggcaaauuuuggaauaccacuauugccguaagcauggccaacaucuuccgcgggucguaccuggcgggagcuggcuuagcauuuucuauuaugaaguccguggggacaggaaaaagaggcaccgguagccaaggggagacgcuuggagaaaaguggaagaaaaagcugaaucagcucucaaggaaagaguucgaccuauauaagaaaaguggcaucaccgaggucgaucggacagaagccaaggagggucugaaacgaggcgaaauaacucaucacgcuguuucuagaggguccgccaaguugcagugguuuguggagcgcaacauggucauccccgaaggaagggugauugaccugggcugugggcggggaggcuggagcuacuauugcgcaggucucaagaaaguaaccgaggugcguggguacacaaagggaggcccuggccaugaggaaccgguucccaugucaacuuacggguggaauaucgugaaacuuaugaguggaaaggaugucuucuaucugccaccugagagaugugacaccuugcugugcgauauuggugaaagcucccccucuccuacaguggaggagagcaggaccauccgcguccucaaaaugguggaaccaugguuaaagaacaaucaguucuguauuaagguucugaaccccuacaugccuacuguaaucgagcaccuugaacggcugcaacgaaaacacggcgggaugcuagugagaaauccacucuccaggaacucaacgcaugagauguauuggauaucuaauggaacaggcaacauugucgccagugugaauaugguuucgcgccuguugcugaaccgguuuaccaugacucacagacgucccaccaucgaaaaggacguggaucucggugcugggacaaggcaugucaacgcggagccggagacgccuaauauggacgugaucggagaacggauuaaacgcauaaaggaggaacacaacagcaccuggcacuacgacgaugagaauccauauaaaacuugggccuaccauggcuccuaugaaguaaaggcaacaggcucugcuucaagcaugaucaacggggugguuaaacuucugaccaaacccugggacgucgugccuauggugacucagauggccaugacagauaccacaccauucggacagcaacgagucuuuaaggagaaaguugacacuagaacccccagguccaugccggguacgcggcgcgugaugggcauuaccgcagagugguuauggagaacacuggggaggaauaagaaaccucgauugugcacucgggaagaguucaccaagaagguacguacaaacgccgcuaugggagccguguuuacugaagagaaucagugggauagugcgaaagcagccgucgaagacgaggauuucuggaagcucguggacagagagcgcgaacugcacaaacuaggcaagugugguucuugcguuuacaacaugauggggaaaagggagaagaaacuuggagaauuuggcaaggcuaagggcagccgggccaucugguacauguggcugggggcaagauaucucgaguucgaggcucugggauuuuugaaugaagaucauugguucucacgcgagaacuccuacagugguguggaaggcgaggggcugcacaaacucggauauauucuuagggacaucagcaagauacccggcggugccauguacgcugaugacaccgccgggugggacacgcgaaucacagaagaugaccugcauaaugaggagaaaauuacccagcagauggauccagaacaccggcaauuagcaaacgcgaucuuuaagcugacuuaucagaauaaagucgugaagguacagagaccuacacccaccggaacuguuauggacauuaucucuaggaaggaucagcgcggcuccggccaaguggggaccuacggauugaacacauucacgaauauggaggcccagcucauacgucagauggaaggugagggcguccugucaaaagcugaccuagaaaacccacaccuucccgagaagaaaauuacccaguggcuggagacuaaggggguggaacggcucaaaagaauggccaucagcggagaugacugcguggucaagccuaucgaugacagguuugcaaacgcucuguuggccuuaaaugauaugggcaagguucgcaaagacauuccacaauggcagccgucgaaggguuggcaugauuggcaacaggugcccuucuguucucaccauuuccacgagcugauaaugaaagacgggcgaaagcucguagugccuugccggccacaagacgaacuuaucggaagggcaaggauuagucagggcgccggcuggucccugcgcgagacagcgugucuagggaaggcuuaugcccagauguggagccugauguacuuucacagacgggaucucagguuggcaucaaacgccaucugcuccgcuguccccgugcauuggguuccuaccucucguacuacauggagcauucacgcccaucaccaauggaugaccacggaagacaugcugacaguguggaaucgagucuggaucgaggauaacccauggauggaggacaagacccccgugacuaccugggaaaauguaccuuaccuuggaaagcgcgaggaucaguggugugguagucugauaggccucacauccagagcaacuugggcucagaacaucccgaccgccauucagcaaguucggagcuuaaucgggaaugaagaguuccuggacuauaugccaucuaugaaaagguuucgcaaggaggaagagucagaaggagcgauuugguga

SEQ ID NO: 15478 - RNA, 9873 nt, Artificial Sequence
  derived and/or modified CDS sequence (opt3) from DENV-3__EU529686__SS-prME
accagccugugccucaugaugauccuuccagccgcucuggcauuccacuugacauccagggacggcgaaccuaggaugauuguggggaagaacgaacggggaaaaucuuuacuguuuaagacugccucagguauaaauauguguacgcuaaucgcgauggaucucggcgagaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucucucugaaggauaccuuaaagcguagaagcuggccacucaaugaaggggugauggccguuggacuggugucaauccuugcaaguucccuguugaggaacgacgucccuauggccggcccccucguggcuggugggcugcuaauugcauguuacguaaucacgggaacaucugccgaucugaccguggagaaagcggcugacgucacuugggaagaggaagccgagcagacaggcguuagccauaaccuuaugauaaccguggacgaugacggcacuaugcgcauuaaggaugacgagacagaaaauauccucaccgugcuguugaaaacggcauuacugaucgucuccgggauuuuuccauacucaauaccggccacucuccugguguggcacaccuggcagaagcagacacaacggagcggaguucuuugggauguaccuagucccccagagacccagaaagcugaacuggaggaggguguguauagaaucaagcagcagggcauuuucgggaaaacacaagucggagugggcguucagaaggaagguguguuucauacuauguggcacgucaccagaggggccguguugacguacaacggaaagcgacuagagcccaauugggcaucugucaagaaggaccugaucuccuauggcggcggguggcgccucagcgcucaguggcaaaaaggagaagagguccaggugauugccguugaaccugguaagaaccccaagaauuuccagacaaugcccggcacuuuccagaccacaaccggggagaucggagcgauagcccuggauuuuaagccuggcacuucggguucaccgaucauuaaccgggaggggaagguggucggacuuuacggcaauggcgugguuaccaaaaacgggggauaugugucugguaucgcacaaacaaaugcugaaccagacggccccacgccugaguuagaagaggaaauguucaagaaaagaaaccugacuauuauggaucuccacccagggaguggaaagaccaggaaauacuugcccgccaucguccgugaggcuauaaagcgccggcugagaacacucauucuggcaccuaccagggugguagccgccgagauggaagaggcucuuaagggccugccgauccgauaucagacuacagcgaccaaauccgaacauacgggucgggagaucguggacuugaugugccacgcaacuuuuacaaugcgccuacugagccccguuagagucccaaauuacaaccucauuaucauggaugaagcccauuucaccgacccugcuucuauagccgcaaggggguacauuagcacccgggugggaaugggcgaggccgcugcgaucuuuaugacugccacacccccaggcaccgcagaugcuuucccucaguccaaugcccccauucaggacgaggaacgagacaucccagagagaucauggaacagugggaaugaauggauaacagauuuugcaggaaagacugugugguucgucccgagcauuaaagccgguaacgacaucgcuaacuguuuacgcaagaauggcaaaaagguaauccaacugucuaggaagacguuugauaccgaguaucagaaaacaaaacuuaacgacugggauuucgugguuacuaccgacauuuccgagaugggggccaauuuuaaagcggaucgugugaucgacccucggagaugccugaagcccgucauucucacagauggaccagaaagggugauauuggcaggccccaugccuguuaccgccgcuucagccgcucagcgccgagguagaguggggcggaacccacagaaagagaaugaccaauacaucuucacuggccagccccugaacaaugaugaagaccacgcacauuggacggaggccaagaugcuccuggacaacauuaauaccccugaaggaaucaucccggcucuuuucgagccagagagggaaaagagugccgcaauugauggcgaguaucgccuaaaaggggaaagccguaagacauuugucgagcugaugagacggggagacuugcccgugugguuagcgcacaaaguagccuccgaagguauaaaguacacugauaggaaauggugcuucgacggccagcgcaacaaucagauccuggaggagaacauggauguggaaauuuggaccaaggagggggagaaaaagaagcuccgaccuagauggcuggacgcucggacauauucugauccccuugcccugaaagaguuuaaggacuucgcagcuggaaggaaaucgaucgcccucgauuugguuaccgaaauuggccgcgucccaacucaccuggcacauagaacaaggaaugcccuagacaaccuggugaugcuccacacgagcgagcauggugggaaggcuuaccggcacgcgguggaggaacuuccugagaccauggaaacucuguuauugcugggccucaugauccugcuuacaggaggcgccaugcuguuucucauaucagggaaaggaaucgguaagaccuccauuggcuugaucugugucauugcaaguucugggaugcuguggauggcugagauccccuuacaauggauagccagcgccauuguucuagaguucuuuaugauggugcugcucaucccagaaccugagaagcagcguaccccgcaggauaaucaacuugcauauguagugauuggaauccugacauuggcugccauaaucgcggcuaacgaaaugggccugcucgagacuacgaaacgcgaccuggguauguccaaggaacccggggucgugucaccaaccucuuaccuugauguugaccuccacccugccagcgcauggacacuguacgccguggcuacuaccgucauuacacccauguugcgacauaccaucgagaauaguacugcaaacguaucccuggccgcgauugcuaaccaggccgugguuuuaaugggccuagacaaaggauggccaaucagcaagauggaucugggcgugccucuccuugcacuggggugcuauucucaggucaaucccuugacgcugacagccgcugugcuccugcuuauaacccacuacgccauuaucggaccgggcuuacaggcaaaagcuacuagagaggcccaaaagaggaccgcggccgguaucaugaagaacccaacagucgacgggauuaugacuaucgaucuggacccugugauauaugauucaaaauucgaaaagcagcucggacagguuauguugcuggugcuaugugcaguacagcugcuccuuaugcggaccuccugggcucugugcgaggccuugacacuggcaacgggccccauuaccacucucugggaagguaguccaggcaaauuuuggaauacaaccaucgcugugagcauggccaacauuuuccgcgggucguaccuggccggagcgggcuuagcuuuuucuaucaugaaguccgucgggacuggaaaaagaggcacagguagccaaggggagacccuuggagaaaaguggaagaaaaagcugaaucagcucucaaggaaagaguucgaccuauauaagaaaaguggcauaacggagguugaucggaccgaagcaaaggagggucugaaacgaggcgaaaucacacaucacgccgugucuagaggguccgcuaaguugcagugguuugucgagcgcaacauggugauucccgaaggaaggguaaucgaccugggcugugggcggggaggcuggagcuacuauugcgccggucucaagaaagugacugagguucguggguacaccaagggaggcccuggccaugaggaaccggugcccaugucaacauacggguggaauauugucaaacuuaugaguggaaaggauguguucuaucugccaccugagaaaugugacacuuugcugugcgauaucggugaaagcucccccucuccuaccgucgaggagagcagaacaauuagggugcucaagaugguugaaccaugguuaaagaacaaucaguucuguaucaaaguacugaaccccuacaugccuaccgugauagagcaccuugaacgccugcaacggaagcacggcgggaugcuaguccgaaauccacucuccagaaacucaacucaugagauguauuggauuucuaauggaacgggcaacaucguggcaaguguuaauauggugucgaggcuguugcugaaccgcuuuacaaugacccaccggagacccacuaucgaaaaagacgucgaucucggugccgggacccgucaugugaacgcugagccggagacaccuaauauggacguaauuggagaaaggauaaagcggaucaaagaggaacacaacagcacguggcacuacgacgaugagaauccauauaagaccugggcguaccauggcuccuaugaagugaaggccacuggcucugcaucaagcaugauuaacgggguugucaaacuucugacaaagcccugggacguggugccuauggucacccagauggcuaugacugauacaaccccauucggacagcaacgcguuuuuaaagagaagguggacacacgaacucccagauccaugccggguaccaggcggguaaugggcaucacggccgagugguuauggcgcacccuggggagaaauaaaaagccuagguugugcacacgagaagaguucacuaagaaagugcggaccaacgcagccaugggagcugucuuuacagaagagaaucagugggauagugccaaggcggcaguggaagacgagaacuucuggaaacucguugaucgugagagagaacugcacaagcuaggcaaaugugguucuugcguguacaauaugauggggaagcgcgagaagaaacuuggagaauuuggcaaagccaaaggcagcagggcuauuugguacauguggcugggggcccgguaucucgaguucgaggcacugggauuuuugaacgaagaccauugguucucaagagaaaauuccuacaguggugucgagggcgaggggcugcacaagcucggauauauccuucgcgauauaagcaaaauccccggcggugcuauguacgccgacgauacugcugggugggacaccaggauuacggaagacgaucugcauaacgaggagaagaucacacagcagauggacccagaacaccgacaauuagccaaugcaauuuuuaaacugaccuaucagaacaaggugguaaagguucagcggccuacucccacaggaaccgugauggauaucauaucuagaaaagaccagaggggcuccggccaagucgggacuuacggauugaauaccuucacaaacauggaggcgcagcucauucgccagauggaaggugagggcgugcugucaaaggccgaucuagaaaacagccaccuuccagagaaaaagaucacgcaguggcuggagaccaaagggguggaacgucucaagcggauggcuaucucgggagacgauugcgucguuaagcccauugacgauagauuugccaaugcacuguuggcuuuaaacgacaugggcaaagugaggaaggauauaccucaauggcagccaucuaaagguuggcaugacuggcagcagguaccguucuguagucaccauuuccacgagcugaucaugaaggaugggcgcaaacucgugguccccugccgaccucaagacgaacuuauuggacgggccagaaucucccagggcgcaggcuggagccugagggagacugccugucuagggaaggcguaugcucagauguggucacugauguacuuucaccgcagagaccuccgguuggccuccaaugcaauuugcucugccgugccaguucauugggugcccacaagcaggaccacuuggaguauccacgcucaucaccaauggaugacaaccgaagauaugcugacggucuggaaccguguguggauagaggacaauccuuggauggaggauaagacaccaguaaccacuugggaaaacguucccuaccuuggaaaacgagaggaccaguggugugguucccugaucggccucaccagccgcgccacaugggcacagaauauuccuacugcuauccagcaagugagaucuuuaauugggaacgaagaguuccuggauuauaugccgucaaugaagcgguuuaggaaagaggaagagagugaaggagccaucugguga

SEQ ID NO: 15479 - RNA, 9873 nt, Artificial Sequence
  derived and/or modified CDS sequence (opt3) from DENV-3__EU529687__SS-prME
accagccugugccucaugaugauccuuccagccgcucuggcauuccacuugacauccagagacggcgagccuaggaugauuguggggaagaacgaacggggaaaaucuuuacuguuuaagacugccucagguauaaauauguguacguuaaucgcgauggaucucggcgagaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucucucugaaggauaccuuaaagcguagaagcuggccacucaaugaaggggugauggccguuggacuggugucaauccuugcaaguucccuguugaggaacgacgucccuauggccggcccccucguggcuggugggcugcuaauugcauguuacguaaucacgggaacaucugccgaucugaccguggagaaagcggcugacgucacuugggaagaggaagccgagcagacaggcguuagccauaaccuuaugauaaccguggacgaugacggcacuaugcgcauuaaggaugacgagacagaaaauauccucaccgugcuguugaaaacggcauuacugaucgucuccgggauuuuuccauacucaauaccggccacucuccugguguggcacaccuggcagaagcagacacaacggagcggaguucuuugggauguaccuagucccccagagacccagaaagcugaacuggaggaggguguguauagaaucaagcagcagggcauuuucgggaaaacacaagucggagugggcguucagaaggaagguguguuucauacuauguggcacgucaccagaggggccguguugacguacaacggaaagcgacuagagcccaauugggcaucugucaagaaagaccugaucuccuauggcggcggguggcgccucagcgcucaguggcaaaaaggagaagagguccaggugauugccguugaaccugguaagaaccccaagaauuuccagacaaugcccggcacuuuccagaccacaaccggggagaucggagcgauagcccuggauuuuaagccuggcacuucggguucaccgaucauuaaccgggaggggaagguggucggacuuuacggcaauggcgugguuaccaaaaacgggggauaugugucugguaucgcacaaacaaaugcugaaccagacggccccacgccugaguuagaagaggaaauguucaagaaaagaaaccugacuauuauggaucuccacccagggaguggaaagaccaggaaauacuugcccgccaucguccgugaggcuauaaagcgccggcugagaacacucauucuggcaccuaccagggugguagccgccgagauggaagaggcucuuaagggccugccgauccgauaucagacuacagcgaccaaauccgaacauacgggucgggagaucguggacuugaugugccacgcaacuuuuacaaugcgccuacugagccccguuagagucccaaauuacaaccucauuaucauggaugaagcccauuucaccgacccugcuucuauagccgcaaggggguacauuagcacccgggugggaaugggcgaggccgcugcgaucuuuaugacugccacacccccaggcaccgcagaugcuuucccucaguccaaugcccccauucaggacgaggaaaaggacaucccagagcgaucauggaacagugggaaugaauggauaacagauuuugcaggaaaaacugugugguucgucccgagcauuaaggccgguaacgacaucgcuaacuguuuaaggaagaauggcaagaagguaauccaacugucucgcaaaacguuugauaccgaguaucagaagacaaaacuuaacgacugggauuucgugguuacuaccgacauuuccgagaugggggccaauuuuaaggcggauagggugaucgacccucgucggugccugaaacccgucauucucacagauggaccagaaagagugauauuggcaggccccaugccuguuaccgccgcuucagccgcucagaggcgcggucgaguggggagaaacccacagaaggagaaugaccaauacaucuucacuggccagccccugaacaaugaugaagaccacgcacauuggacggaggccaagaugcuccuggacaacauuaauaccccugaaggaaucaucccggcucuuuucgagccagagcgggagaaaagugccgcaauugauggcgaguauaggcuaaagggggaaagccgcaaaacauuugucgagcugaugcguagaggagacuugcccgugugguuagcgcacaagguagccuccgaagguauaaaauacacugaucggaaguggugcuucgacggccagaggaacaaucagauccuggaggagaacauggauguggaaauuuggaccaaagagggggaaaagaagaaacuccgcccucgauggcuggacgcuagaacauauucugauccccuugcccugaaggaguuuaaagacuucgcagcuggacggaagucgaucgcccucgauuugguuaccgaaauuggcagggucccaagccaccuggcacaucgcacuagaaaugcccuagacaaccuggugaugcuccacacaucagagcauggugggaaggcuuacaggcacgcgguggaggaacuuccugagacgauggaaacccuguuauugcugggccucaugauccugcuuacuggaggcgccaugcuguuucucauauccgggaagggaaucgguaagacaaguauuggcuugaucugugucauugcaucuagcgggaugcuguggauggcugagauccccuuacaauggauagccuccgccauuguucuagaguucuuuaugauggugcugcucaucccagaaccugagaaacagcggaccccgcaggauaaucaacuugcauauguagugauuggaauccugaccuuggcugccauaaucgcggcuaacgaaaugggccugcucgagacaacuaagcgugaccuggguaugucaaaagaacccggggucgugucuccaacgagcuaccuugauguugaccuccacccugccagugcauggacccuguacgccguggcuacaacugucauuacccccauguugcgccauacaaucgaaaauuccaccgcaaacguaagccuggccgcgauugcuaaccaggccgugguuuuaaugggccuagacaagggauggccaaucucuaaaauggaucugggcgugccucuccuugcacuggggugcuauucacaggucaaucccuugacucugacggccgcugugcuccugcuuauaacacacuacgccauuaucggaccgggcuuacaggcaaaggcuacccgagaggcccaaaagagaacugcggccgguaucaugaaaaacccaaccgucgacgggauuaugacaaucgaucuggacccugugauauaugauuccaaguucgaaaaacagcucggacagguuauguugcuggugcuaugugcaguacagcugcuccuuaugaggacaaguugggcucugugcgaggccuugacccuggcaacaggccccauuacgacccucugggaagguagcccaggcaaguuuuggaauacuacaaucgcugugucgauggccaacauuuuccgggggucuuaccuggccggagcgggcuuagcuuuuuccaucaugaaaagcgucgggaccggaaagcgcggcacugguucacaaggggagacacuuggagaaaaguggaaaaagaaacugaaucagcucaguagaaaggaguucgaccuauauaaaaagucuggcauaaccgagguugauaggacggaagcaaaagagggucugaagcggggcgaaaucacccaucacgccgugucccgagggagcgcuaaguugcagugguuugucgagagaaacauggugauucccgaaggacgcguaaucgaccugggcugugggaggggaggcuggucauacuauugcgccggucucaaaaaggugacagagguucggggguacacuaaaggaggcccuggccaugaggaaccggugcccaugaguaccuacggguggaauauugucaaacuuaugagcggaaaagauguguucuaucugccaccugagaagugugacacauugcugugcgauaucggugaauccucucccagcccuacugucgaggagucccguaccauuagagugcucaagaugguugaaccauggcugaaaaacaaucaguucuguaucaagguacuaaaccccuacaugccuacagugauagagcaccuugaaaggcugcaacgcaaacacggcgggaugcuaguccggaauccacucucacgaaacucuacccaugagauguauuggauuaguaauggaacuggcaacaucguggcaucgguuaauauggugagcagacuguugcugaacagguuuacgaugacacaccgccggcccaccaucgaaaaggacgucgaucucggugccgggacuagacaugugaacgcugagccggagaccccuaauauggacguaauuggagaacguauaaaaaggaucaaggaggaacacaacuccacauggcacuacgacgaugagaauccauauaagacgugggcguaccauggcucuuaugaagugaaagccaccggcucagcaagcuccaugauuaacgggguugucaaacuucugacuaaacccugggacguggugccuauggucacacagauggcuaugaccgauacuacaccauucggacagcaacggguuuuuaaggagaaaguggacacccgcacaccccgaaguaugccggguacuagaaggguaaugggcaucaccgccgagugguuauggcggacgcuggggcgcaauaagaagccuagauugugcaccagggaagaguucacuaaaaaggugcgaacuaacgcagccaugggagcugucuuuaccgaagagaaucagugggauucugccaaagcggcaguggaagacgaggauuucuggaagcucguugaccgggagcgugaacugcacaaacuaggcaagugugguagcugcguguacaacaugauggggaaaagagagaagaaacuuggagaauuuggcaaagccaagggcucacgcgcuauuugguacauguggcugggggccagguaucucgaguucgaggcacugggauuuuugaaugaagaucauugguucucccgggagaacaguuacagcggugucgaaggcgaggggcugcacaaacucggauauauccuuagagacauaucuaagauccccggcggugcuauguacgccgaugacacagcugggugggacacucgcauuaccgaagaugaccugcauaaugaggagaaaaucacgcagcagauggauccagaacacaggcaauuagccaacgcaauuuuuaagcugacauaucagaauaaggugguaaaaguucagcgaccuacccccacuggaacagugauggacaucauaucccggaaggaucagagaggcucaggccaagucgggaccuacggauugaacacuuucaccaauauggaggcgcagcucauuaggcagauggaaggugagggcgugcugagcaaagccgaccuagaaaacccacaccuucccgagaagaaaaucacacaguggcuggagacgaaggggguggaacgccucaagcguauggcuaucucgggagaugacugcgucguuaaaccuauugaugaccgguuugccaacgcacuguuggcuuuaaaugauaugggcaaggugagaaaagacauaccacaauggcagccgucuaaggguuggcaugauuggcagcagguacccuucuguagucaccauuuccacgagcugaucaugaaagacgggaggaagcucguggucccuugccgcccacaagacgaacuuauuggacgagcccggaucucccagggcgcaggcuggagccugagagagaccgccugucuagggaaggcguaugcucagauguggucacugauguacuuucacaggcgcgaucucagauuggccuccaacgcaauuugcucugccgugcccguucauugggugccuacuagccggacaaccuggaguauccacgcucaucaccaauggaugacuacagaagacaugcugaccgucuggaauaggguguggauagaggauaacccauggauggaggacaaaacgcccguaacaaccugggaaaauguuccuuaccuuggaaagcgugaggaucaguggugugguucccugaucggccucacuagccgagccaccugggcacagaacauuccgacagcuauccagcaagugcgcucuuuaauugggaaugaagaguuccuggacuauaugccaucaaugaaaagauuucggaaggaggaagagagugaaggagccaucugguga

SEQ ID NO: 15480 - RNA, 9873 nt, Artificial Sequence
  derived and/or modified CDS sequence (opt3) from DENV-3__KF955449__SS-prME
accagccugugccucaugaugauccuuccagccgcucuggcauuccacuugacuuccagggacggagaaccuaggaugauuguggggaagaacgaacggggaaagucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucgucuuacugaugcuugugaccccaucgaugacaaugcgcuguguaggcguugggaacagagacuuuguggaaggauugucaggugccaccugggucgauguggugcuggagcacggcgggugcgucacgacuauggcgaagaauaaacccacacuagacaucgagcuccagaagaccgaagcaacucagcuggccacacuuaggaaacuguguauugagggaaagaucaccaacauuacgaccgauagccggugcccuacacagggcgaagcuguuuugccagaggaacaggaccagaauuauguguguaaacacacuuacguagaucgcgguugggggaacggaugcggccucuucggcaaggggagucuggugaccugcgccaaguuucaauguuuagagcccaucgagggaaaagucgugcaguaugaaaaucugaaguacacaguuauaauuacugugcauaccggugaccagcaccaggucggcaacgagacacaaggggugaccgcagaaaucacuccucaggcuuccacgacagaggccauucucccagaauauggaacccuuggccuggagugcucuccgcgaacugguuuggacuucaaugagaugauccuacugaccaugaaaaacaaggcguggaugguacauagacagugguuuuucgaucucccccugccuuggacaagcggggccaccacugaaacaccaacguggaauaggaaagagcuucugguuaccuuuaagaacgcacacgcuaaaaagcaagaaguggucguguugggcucccaggagggagccaugcacacugcucucacaggcgccaccgaaauccaaaauucagggggaacaaguauuuucgcaggucaucugaagugucgguuaaaaauggacaagcuggagcuaaaaggcaugagcuacgccaugugcacuaacaccuuuguccucaagaaagaggugucugaaacgcagcacgggaccauacugaucaagguugaguacaagggagaagaugugcccuguaaaauuccuuucuccacagaggacggccaagguaaggcucauaacgggcgucuuaucacugcgaauccaguagucaccaaaaaggaggaacccgugaacauagaggcagaaccgccuuucggcgagucaaauauuguuaucggaaucggcgauaacgccuugaaaauuaauugguauaagaaggggagcaguaucggaaaaauguuugaagcuacagcccgcggugcaagaaggauggccauucugggcgacacugcuugggauuucgggucugugggaggcguccucaacucccuggguaagauggugcaccagauauuugggagcgccuacaccgcacuuuucucgggcguaucuugggugaugaaaaucggaauuggcguucuguugacguggaucgggcucaauuccaagaacacaucaaugaguuuuagcugcaucgcgauuggaauaaucacccuguauuuaggcgcugucgugcaggccgacauggguugugugauuaauuggaaagggaaggagcugaagugcggauccggcaucuucgucacuaacgagguucauacauggaccgaacaguacaaauuucaagcagauucucccaagcggcuagccacugcuauugccggugcaugggagaauggcgugugugggauccgaagcaccacacgcauggaaaaccuccuguggaaacagauagcuaaugagcuuaacuauaucuugugggaaaauaacauuaagcugacggugguagucggagacaucauuggcgugcucgagcaggggaaaagaacccugacuccacagccuauggaguuaaaguacucauggaaaacauggggaaaggccaagaucguuaccgcggaaacacaaaacaguuccuucauaauugauggccccaauacuccagagugccccagcgccucuagggcuuggaacgugugggaagucgaggacuaugguuuugggguguucaccacgaauaucuggcugaaacuucgggaaguuuacacacaguugugugaccaccgccucaugucagcagccgugaaggaugagagagcuguacacgccgacaugggauacuggauugagagucagaaaaacggcagcuggaagcuggaaaaagcaucccuaaucgaggucaagaccugcacuuggccuaagucucauacccuguggucgaauggugugcucgaaagcgauaugauaaucccaaaaucccuggcgggcccgauuucacagcacaacuauaggcccggguaccauacacaaacugccggaccuuggcaccuuggcaaguuggagcuggacuuuaauuauugcgaggggaccacaguggucaucacggaaaacuguggaacccguggcccaaguuuacggacuacaaccguuucugguaaacucauucacgaguggugcugucgaagcugcacucugcccccucuuagauacaugggggaagauggauguugguauggcauggagaucaggccaauauccgaaaaggaggagaauauggugaaaucacugguaagcgcugguucuggcgaaguggacaacuucacaaugggggucuugugccucgccauucuguuugaggaagugaugcgcggaaaguucggcaagaaacauaugaucgcagggguuuucuuuaccuucgugcuacugcucuccggacagaucacguggcgggauauggcucacacucugauuaugaucggcaguaaugccagcgacagaauggguaugggggucaccuaccuugcauugauugccacauuuaagauacagcccuuccuggcuuuaggauuuuuccucaggaaacugaccucucgcgagaaccuucugcuaggcgugggccucgcgauggccacuacacugcaauugccggaagauaucgagcagauggcaaaugggauugcucugggauuaauggcccucaagcugaucacccaguuugagacauaucagcuuuggacugcccugauuuccuugaccuguucaaacacgaucuucacacucaccguugcuuggcgaacugcaacccugauacuagccggugugagucugcuuccugucugccaaagcucguccaugcggaaaacagacuggcucccaaugacuguagcggcuaugggcgugcccccucugcccuuguuuaucuucucucugaaggauaccuuaaagcguagaagcuggccacucaaugaagggguuauggccgugggacuggucucaauucuugcaaguucccuguugaggaacgacgugccuauggccggcccccucguagcuggugggcugcuaaucgcauguuacgugauuacgggaacaucugccgaucugaccgucgagaaagcggcugacguuacuugggaagaggaagccgagcagacaggcgugagccauaaccuuaugaucaccguggacgaugacggcacuaugcgcauaaaggaugacgagacagaaaauauucucaccguccuguugaaaacggcauuacugaucguguccgggaucuuuccauacucaauuccggccacucuccugguuuggcacaccuggcagaagcagacacaacggagcggaguacuuugggaugugccuagucccccagagacccagaaagcugaacuggaggagggugucuauagaauaaagcagcagggcaucuucgggaaaacacaagugggaguuggcgugcagaaggaaggugucuuucauacuauguggcacgugaccagaggggccguauugacguacaacggaaagcgacuagagcccaauugggcaucugucaaaaaggaccugauuuccuauggcggcggguggcgccucagcgcucaguggcaaaaaggagaagaggugcagguuaucgccguggaaccugguaagaaccccaagaauuuccagacaaugcccggcacuuuccagaccacaaccggggagauuggagcgaucgcccuggauuuuaagccuggcacuucggguucaccgauaaucaaccgggaggggaaggucgugggacuuuacggcaauggcguugugaccaaaaacgggggauaugucucugguauugcacaaacaaaugcugaaccagacggccccacgccugaguuagaagaggaaauguucaagaaaagaaaccugacuaucauggaucuccacccagggaguggaaagaccaggaaauacuugcccgccauugugcgugaggcuaucaagcgccggcugagaacacucauacuggcaccuaccaggguaguggccgccgagauggaagaggcucuuaagggccugccgauucgauaucagacuacagcgaccaaauccgaacauacgggucgggagaucguugacuugaugugccacgcaacuuuuacaaugcgccuacugagccccgucagagugccaaauuacaaccucaucauuauggaugaagcccauuucaccgacccugcuucuaucgccgcaaggggguacauaagcacccgggugggaaugggcgaggccgcugcgauuuuuaugacugccacacccccaggcaccgcagaugcuuucccucaguccaaugcccccauccaggacgaggaacgagacauuccagagagaucauggaacagugggaaugaauggaucacagauuuugcaggaaagacugucugguucguaccgagcauaaaagccgguaacgacauugcuaacuguuuacgcaagaauggcaaaaaggugauccaacugucuaggaagacguuugauaccgaguaucagaaaacaaaacuuaacgacugggauuucguugugacuaccgacaucuccgagaugggggccaauuuuaaagcggaucgugucauugacccucggagaugccugaagcccgugauccucacagauggaccagaaaggguuauuuuggcaggccccaugccugugaccgccgcuucagccgcucagcgccgagguagagucgggcggaacccacagaaagagaaugaccaauacauauucacuggccagccccugaacaaugaugaagaccacgcacauuggacggaggccaagaugcuccuggacaacaucaauaccccugaaggaauuaucccggcucuuuucgagccagagagggaaaagagugccgcaaucgauggcgaguaucgccuaaaaggggaaagccguaagacauuuguggagcugaugagacggggagacuugcccguaugguuagcgcacaaaguggccuccgaagguauuaaguacacugauaggaaauggugcuucgacggccagcgcaacaaucagauacuggaggagaacauggauguugaaaucuggaccaaggagggggagaagaagaagcuccgaccuagauggcuggacgcucggacauauucugauccccuugcccugaaagaguuuaaggacuucgcagcuggaaggaaaucgauugcccucgauuuggucaccgaaaucggccgcgugccaagccaccuggcacauagaacuaggaaugcccuagacaaccuggugaugcuccacacaucagagcauggugggaaggcuuaccggcacgcggucgaggaacuuccugagacgauggaaacccuguuauugcugggccucaugauucugcuuacuggaggcgccaugcuguuucucaucuccgggaaaggaauagguaagacaaguaucggcuugauuuguguuaucgcaucuagcgggaugcuguggauggcugagauucccuuacaauggaucgccuccgccauagugcuagaguucuuuaugaugguacugcucauuccagaaccugagaagcagcguaccccgcaggauaaucaacuugcauauguggucaucggcauucugaccuuggcugccaucauagcggcuaacgaaaugggccugcucgagacaacuaaacgcgaccuggguaugucaaaggaacccggggugguuucuccaacgagcuaccuugauguggaccuccacccugccagugcauggacccuguacgccgucgcuacaacuguaaucacccccauguugcgacauacaauugaaaauuccaccgcaaacgugagccuggccgcgaucgcuaaccaggccguuguguuaaugggccuagacaaaggauggccaauuucuaagauggaucugggcgucccucuccuugcacuggggugcuauucacaggugaaucccuugacucugacggccgcuguccuccugcuuaucacacacuacgccauaauuggaccgggcuuacaggcaaaagcuaccagagaggcccaaaagaggacugcggccgguaucaugaagaacccaaccguggacgggaucaugacaauugaucuggacccuguuaucuaugauuccaaauucgagaagcagcucggacaggugauguugcugguacuaugugcagugcagcugcuccuuaugcggacaaguugggcucugugcgaggccuugacccuggcaacaggccccauaacgacccucugggaagguagcccaggcaaauuuuggaauacuacaauugcugucucgauggccaacaucuuccgcgggucuuaccuggccggagcgggcuuagcuuuuuccauuaugaaaagcguugggaccggaaaaagaggcacugguucacaaggggagacacuuggagaaaaguggaagaaaaagcugaaucagcucaguaggaaagaguucgaccuauauaagaaaucuggcaucaccgagguggaucggacggaagcaaaggagggucugaaacgaggcgaaauaacccaucacgccgucuccagagggagcgcuaaguugcagugguuuguggagcgcaacaugguaauccccgaaggaagggugauugaccugggcugugggcggggaggcuggucauacuauugcgccggucucaagaaaguuacagaggugcguggguacacuaagggaggcccuggccaugaggaaccgguccccaugaguaccuacggguggaauaucgugaaacuuaugagcggaaaggaugucuucuaucugccaccugagaaaugugacacauugcugugcgauauuggugaauccucucccagcccuacuguggaggaguccagaaccaucaggguucucaagaugguagaaccaugguuaaagaacaaucaguucuguauuaaagugcugaaccccuacaugccuacagucaucgagcaccuugaacgccugcaacggaagcacggcgggaugcuagugcgaaauccacucucaagaaacucuacccaugagauguauuggauaaguaauggaacuggcaacauuguugcaucggugaauauggucagcaggcuguugcugaaccgcuuuacgaugacacaccggagacccaccaucgaaaaagacguggaucucggugccgggacucgucauguaaacgcugagccggagaccccuaauauggacgugaucggagaaaggauuaagcggauaaaagaggaacacaacuccacauggcacuacgacgaugagaauccauauaagacgugggcguaccauggcucuuaugaaguuaaggccaccggcucagcaagcuccaugaucaacggggucgugaaacuucugacuaagcccugggacguggucccuaugguuacacagauggcuaugaccgauacuacaccauucggacagcaacgcguguuuaaagagaagguagacacccgaacacccagaaguaugccggguacuaggcgggugaugggcauuaccgccgagugguuauggcgcacgcuggggagaaauaaaaagccuagguugugcacccgagaagaguucacaaagaaaguccggacuaacgcagccaugggagcuguguuuaccgaagagaaucagugggauucugccaaggcggcaguugaagacgaggauuucuggaaacucguggaccgugagagagaacugcacaagcuaggcaaaugugguagcugcgucuacaacaugauggggaagcgcgagaagaaacuuggagaauuuggcaaagccaaaggcucaagggcuaucugguacauguggcugggggcccgguaucucgaguucgaggcacugggauuuuugaaugaagaucauugguucuccagagagaacaguuacagcgguguggaaggcgaggggcugcacaagcucggauauauucuucgcgacaucucuaaaauacccggcggugcuauguacgccgaugacacagcugggugggacacuaggaucaccgaagaugaccugcauaaugaggagaagauuacgcagcagauggauccagaacaccgacaauuagccaacgcaaucuuuaaacugacauaucagaauaagguaguuaaggugcagcggccuacccccacuggaacagucauggacauuaucuccagaaaagaucagaggggcucaggccaaguggggaccuacggauugaacacuuucaccaauauggaggcgcagcucauacgccagauggaaggugagggcgugcugagcaaggccgaccuagaaaacccacaccuucccgagaaaaagauuacacaguggcuggagacgaaaggggucgaacgucucaagcggauggcuaucucgggagaugacugcguugugaagccuaucgaugacagauuugccaacgcacuguuggcuuuaaaugauaugggcaaaguaaggaaggacauuccacaauggcagccgucuaaagguuggcaugauuggcaacaggugcccuucuguagucaccauuuccacgagcugauaaugaaggacgggcgcaaacucgucgugccuugccgaccacaagacgaacuuaucggacgggccagaauuucccagggcgcaggcuggagccugagggagaccgccugucuagggaaggcguaugcucagauguggucacugauguacuuucaccgcagagaucuccgguuggccuccaacgcaaucugcucugccguucccgugcauugggucccuacuagcaggacaaccuggaguauucacgcucaucaccaauggaugacuacagaagacaugcugaccguguggaaucguguauggaucgaggauaacccauggauggaggacaagacgcccguuacaaccugggaaaaugugccuuaccuuggaaaacgagaggaucaguggugugguucccugauaggccucacuagccgcgccaccugggcacagaacaucccgacagcuauucagcaagucagaucuuuaaucgggaaugaagaguuccuggacuauaugccaucaaugaagcgguuuaggaaagaggaagagagugaaggagccauuugguga

SEQ ID NO: 15481 - RNA, 9873 nt, Artificial Sequence
  derived and/or modified CDS sequence (opt3) from DENV-3__FJ373303__SS-prME
accagccugugccucaugaugauccuuccagccgcucuggcauuccacuugacuuccagggacggagaaccuaggaugauuguggggaagaacgaacggggaaagucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacgugaagcugacggugguagucggagacaucauuggcgugcucgagcaggggaaaagaacccugacuccacagccuauggaguuaaaguacucauggaaaacauggggaaaggccaagaucguuaccgcggaaacacaaaacaguuccuucauaauugauggccccaauacuccagagugccccagcgccucuagggcuuggaacgugugggaagucgaggacuaugguuuugggguguucaccacgaauaucuggcugaaacuucgggaaguuuacacacaguugugugaccaccgccucaugucagcagccgugaaggaugagagagcuguacacgccgacaugggauacuggauugagagucagaaaaacggcagcuggaagcuggaaaaagcaucccuaaucgaggucaagaccugcacuuggccuaagucucauacccuguggucgaauggugugcucgaaagcgauaugauaaucccaaaaucccuggcgggcccgauuucacagcacaacuauaggcccggguaccauacacaaacugccggaccuuggcaccuuggcaaguuggagcuggacuuuaauuauugcgaggggaccacaguggucaucacggaaaacuguggaacccguggcccaaguuuacggacuacaaccguuucugguaaacucauucacgaguggugcugucgaagcugcacucugcccccucuuagauacaugggggaagauggauguugguauggcauggagaucaggccaauauccgaaaaggaggagaauauggugaaaucacugguaagcgcugguucuggcgaaguggacaacuucacaaugggggucuugugccucgccauucuguuugaggaagugaugcgcggaaaguucggcaagaaacauaugaucgcagggguuuucuuuaccuucgugcuacugcucuccggacagaucacguggcgggauauggcucacacucugauuaugaucggcaguaaugccagcgacagaauggguaugggggucaccuaccuugcauugauugccacauuuaagauacagcccuuccuggcuuuaggauuuuuccucaggaaacugaccucucgcgagaaccuucugcuaggcgugggccucgcgauggccacuacacugcaauugccggaagauaucgagcagauggcaaaugggauugcucugggauuaauggcccucaagcugaucacccaguuugagacauaucagcuuuggacugcccugauuuccuugaccuguucaaacacgaucuucacacucaccguugcuuggcgaacugcaacccugauacuagccggugugagucugcuuccugucugccaaagcucguccaugcggaaaacagacuggcucccaaugacuguagcggcuaugggcgugcccccucugcccuuguuuaucuucucucugaaggauaccuuaaagcguagaagcuggccacucaaugaagggguuauggccgugggacuggucucaauucuugcaaguucccuguugaggaacgacgugccuauggccggcccccucguagcuggugggcugcuaaucgcauguuacgugauuacgggaacaucugccgaucugaccgucgagaaagcggcugacguuacuugggaagaggaagccgagcagacaggcgugagccauaaccuuaugaucaccguggacgaugacggcacuaugcgcauaaaggaugacgagacagaaaauauucucaccguccuguugaaaacggcauuacugaucguguccgggaucuuuccauacucaauuccggccacucuccugguuuggcacaccuggcagaagcagacacaacggagcggaguacuuugggaugugccuagucccccagagacccagaaagcugaacuggaggagggugucuauagaauaaagcagcagggcaucuucgggaaaacacaagugggaguuggcgugcagaaggaaggugucuuucauacuauguggcacgugaccagaggggccguauugacguacaacggaaagcgacuagagcccaauugggcaucugucaaaaaggaccugauuuccuauggcggcggguggcgccucagcgcucaguggcaaaaaggagaagaggugcagguuaucgccguggaaccugguaagaaccccaagaauuuccagacaaugcccggcacuuuccagaccacaaccggggagauuggagcgaucgcccuggauuuuaagccuggcacuucggguucaccgauaaucaaccgggaggggaaggucgugggacuuuacggcaauggcguugugaccaaaaacgggggauaugucucugguauugcacaaacaaaugcugaaccagacggccccacgccugaguuagaagaggaaauguucaagaaaagaaaccugacuaucauggaucuccacccagggaguggaaagaccaggaaauacuugcccgccauugugcgugaggcuaucaagcgccggcugagaacacucauacuggcaccuaccaggguaguggccgccgagauggaagaggcucuuaagggccugccgauucgauaucagacuacagcgaccaaauccgaacauacgggucgggagaucguugacuugaugugccacgcaacuuuuacaaugcgccuacugagccccgucagagugccaaauuacaaccucaucauuauggaugaagcccauuucaccgacccugcuucuaucgccgcaaggggguacauaagcacccgggugggaaugggcgaggccgcugcgauuuuuaugacugccacacccccaggcaccgcagaugcuuucccucaguccaaugcccccauccaggacgaggaacgagacauuccagagagaucauggaacagugggaaugaauggaucacagauuuugcaggaaagacugucugguucguaccgagcauaaaagccgguaacgacauugcuaacuguuuacgcaagaauggcaaaaaggugauccaacugucuaggaagacguuugauaccgaguaucagaaaacaaaacuuaacgacugggauuucguugugacuaccgacaucuccgagaugggggccaauuuuaaagcggaucgugucauugacccucggagaugccugaagcccgugauccucacagauggaccagaaaggguuauuuuggcaggccccaugccugugaccgccgcuucagccgcucagcgccgagguagagucgggcggaacccacagaaagagaaugaccaauacauauucacuggccagccccugaacaaugaugaagaccacgcacauuggacggaggccaagaugcuccuggacaacaucaauaccccugaaggaauuaucccggcucuuuucgagccagagagggaaaagagugccgcaaucgauggcgaguaucgccuaaaaggggaaagccguaagacauuuguggagcugaugagacggggagacuugcccguaugguuagcgcacaaaguggccuccgaagguauuaaguacacugauaggaaauggugcuucgacggccagcgcaacaaucagauacuggaggagaacauggauguugaaaucuggaccaaggagggggagaagaagaagcuccgaccuagauggcuggacgcucggacauauucugauccccuugcccugaaagaguuuaaggacuucgcagcuggaaggaaaucgauugcccucgauuuggucaccgaaaucggccgcgugccaagccaccuggcacauagaacuaggaaugcccuagacaaccuggugaugcuccacacaucagagcauggugggaaggcuuaccggcacgcggucgaggaacuuccugagacgauggaaacccuguuauugcugggccucaugauucugcuuacuggaggcgccaugcuguuucucaucuccgggaaaggaauagguaagacaaguaucggcuugauuuguguuaucgcaucuagcgggaugcuguggauggcugagauucccuuacaauggaucgccuccgccauagugcuagaguucuuuaugaugguacugcucauuccagaaccugagaagcagcguaccccgcaggauaaucaacuugcauauguggucaucggcauucugaccuuggcugccaucauagcggcuaacgaaaugggccugcucgagacaacuaaacgcgaccuggguaugucaaaggaacccggggugguuucuccaacgagcuaccuugauguggaccuccacccugccagugcauggacccuguacgccgucgcuacaacuguaaucacccccauguugcgacauacaauugaaaauuccaccgcaaacgugagccuggccgcgaucgcuaaccaggccguuguguuaaugggccuagacaaaggauggccaauuucuaagauggaucugggcgucccucuccuugcacuggggugcuauucacaggugaaucccuugacucugacggccgcuguccuccugcuuaucacacacuacgccauaauuggaccgggcuuacaggcaaaagcuaccagagaggcccaaaagaggacugcggccgguaucaugaagaacccaaccguggacgggaucaugacaauugaucuggacccuguuaucuaugauuccaaauucgagaagcagcucggacaggugauguugcugguacuaugugcagugcagcugcuccuuaugcggacaaguugggcucugugcgaggccuugacccuggcaacaggccccauaacgacccucugggaagguagcccaggcaaauuuuggaauacuacaauugcugucucgauggccaacaucuuccgcgggucuuaccuggccggagcgggcuuagcuuuuuccauuaugaaaagcguugggaccggaaaaagaggcacugguucacaaggggagacacuuggagaaaaguggaagaaaaagcugaaucagcucaguaggaaagaguucgaccuauauaagaaaucuggcaucaccgagguggaucggacggaagcaaaggagggucugaaacgaggcgaaauaacccaucacgccgucuccagagggagcgcuaaguugcagugguuuguggagcgcaacaugguaauccccgaaggaagggugauugaccugggcugugggcggggaggcuggucauacuauugcgccggucucaagaaaguuacagaggugcguggguacacuaagggaggcccuggccaugaggaaccgguccccaugaguaccuacggguggaauguggucaaacuuaugagcggaaaggauguguucuaucugccaccugagaaaugugacacauugcugugcgauaucggugaauccucucccagcccuacuguugaggaguccagaaccauuaggguacucaagaugguggaaccaugguuaaagaacaaucaguucuguaucaaaguccugaaccccuacaugccuacagugauugagcaccuugaacgccugcaacggaagcacggcgggaugcuaguucgaaauccacucucaagaaacucuacccaugagauguauuggaucaguaauggaacuggcaacauaguggcaucggucaauauggugagcaggcuguugcugaaccgcuuuacgaugacacaccggagacccaccauugaaaaagacguagaucucggugccgggacucgucaugugaacgcugagccggagaccccuaauauggacguuaucggagaaaggaucaagcggauuaaagaggaacacaacuccacauggcacuacgacgaugagaauccauauaagacgugggcguaccauggcucuuaugaagucaaggccaccggcucagcaagcuccaugauaaacgggguggugaaacuucugacuaagcccugggacgucguuccuauggugacacagauggcuaugaccgauacuacaccauucggacagcaacgcguauuuaaagagaagguggacacccgaacacccagaaguaugccggguacuaggcgggucaugggcaucaccgccgagugguuauggcgcacgcuggggagaaauaaaaagccuagguugugcacccgagaagaguucacaaagaaagugcggacuaacgcagccaugggagcuguuuuuaccgaagagaaucagugggauucugccaaggcggcaguggaagacgaggauuucuggaaacucgucgaccgugagagagaacugcacaagcuaggcaaaugugguagcugcguguacaacaugauggggaagcgcgagaagaaacuuggagaauuuggcaaagccaaaggcucaagggcuauuugguacauguggcugggggcccgguaucucgaguucgaggcacugggauuuuugaaugaagaucauugguucuccagagagaacaguuacagcgguguagaaggcgaggggcugcacaagcucggauauauccuucgcgacauuucuaaaauccccggcggugcuauguacgccgaugacacagcugggugggacacuaggauaaccgaagaugaccugcauaaugaggagaagaucacgcagcagauggauccagaacaccgacaauuagccaacgcaauuuuuaaacugacauaucagaauaagguugugaagguccagcggccuacccccacuggaacagugauggacaucauuuccagaaaagaucagaggggcucaggccaaguggggaccuacggauugaacacuuucaccaauauggaggcgcagcucauccgccagauggaaggugagggcguccugagcaaggccgaccuagaaaacccacaccuucccgagaaaaagauaacacaguggcuggagacgaaagggguugaacgucucaagcggauggcuauuucgggagaugacugcgugguaaagccuaucgaugacagauuugccaacgcacuguuggcuuuaaaugauaugggcaaagugaggaaggacaucccacaauggcagccgucuaaagguuggcaugauuggcagcagguccccuucuguagucaccauuuccacgagcugauuaugaaggacgggcgcaaacucgugguuccuugccgaccacaagacgaacuuauaggacgggccagaaucucccagggcgcaggcuggagccugagggagaccgccugucuagggaaggcguaugcucagauguggucacugauguacuuucaccgcagagaucuccgguuggccuccaacgcaauuugcucugccgugcccguccauugggugccuacuagcaggacaaccuggaguauccacgcucaucaccaauggaugacuacagaagacaugcugaccguauggaaucguguuuggauugaggauaacccauggauggaggacaagacgcccgugacaaccugggaaaaugucccuuaccuuggaaaacgagaggaucaguggugugguucccugaucggccucacuagccgcgccaccugggcacagaacauaccgacagcuauccagcaagugagaucuuuaauugggaaugaagaguuccuggacuauaugccaucaaugaagcgguuuaggaaagaggaagagagugaaggagccaucugguga

SEQ ID NO: 15482 - RNA, 9873 nt, Artificial Sequence
  derived and/or modified CDS sequence (opt3) from DENV-3__KF955451__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaguuggcgauaacgccuugaaaauuaauugguauaagaaggggagcaguaucggaaaaauguuugaagcuacagcccgcggugcaagaaggauggccauucugggcgacacugcuugggauuucgggucugugggaggcguccucaacucccuggguaagauggugcaccagauauuugggagcgccuacaccgcacuuuucucgggcguaucuugggugaugaaaaucggaauuggcguucuguugacguggaucgggcucaauuccaagaacacaucaaugaguuuuagcugcaucgcgauuggaauaaucacccuguauuuaggcgucguggugcaggcugacauggguugugucauuaauuggaaagggaaggagcugaagugcggauccggcaucuucguuacuaacgaggugcauacauggaccgaacaguacaaauuucaagccgauucucccaagcggcuagcaacugccauugcuggugccugggagaauggcgugugugggauccgaagcaccacacgcauggaaaaccuccuguggaaacagauagcaaaugagcuuaacuauaucuugugggaaaauaacauuaagcugacgguagucgugggagacaucauuggcguucucgagcaggggaaaagaacccugacuccacagccuauggaguuaaaguacucauggaaaacauggggaaaggcuaagaucgugaccgccgaaacacaaaacaguuccuucauaauugauggccccaauacuccagagugccccagcgcgucuagggccuggaacgucugggaaguggaggacuaugguuuugggguuuucaccacgaauaucuggcugaaacuucgggaaguguacacacaguugugugaccaccgccucaugucagcugcaguaaaggaugagagagccguccacgcugacaugggauacuggauugagagucagaaaaacggcagcuggaagcuggaaaaagccucccuaaucgaggugaagaccugcacuuggccuaagucucauacccuguggucgaauggugugcucgaaagcgauaugauaaucccaaaaucccuggcaggcccgauuucacagcacaacuauaggcccggguaccauacacaaacugcgggaccuuggcaccuuggcaaguuggagcuggacuuuaauuauugcgaggggaccacagucguuaucacggaaaacuguggaacccguggcccaaguuuacggacuacaaccgugucugguaaacucauucacgaguggugcugucgaagcugcacucugcccccucuuagauacaugggggaagauggauguugguauggcauggagaucaggccaauauccgaaaaggaggagaauaugguaaaaucacuggugagcgccgguucuggcgaagucgacaacuucacaauggggguguugugccucgcuauucuguuugaggaaguuaugcgcggaaaguucggcaagaaacauaugaucgccgggguguucuuuaccuucguccuacugcucuccggacagaucacguggcgggauauggcacacacucugauuaugaucggcaguaaugcuagcgacagaauggguaugggggugaccuaccuugccuugauugcaacauuuaagauacagcccuuccuggccuuaggauuuuuccucaggaaacugaccucucgcgagaaccuucugcuaggcguuggccucgcuauggcgacuacacugcaauugccggaagauguggagcagauggccaaugggaucgcacugggauuaauggcucucaagcugauuacccaguuugagacauaucagcuuuggacugcccugaucuccuugaccuguucaaacacgauuuucacacucaccgucgccuggcgaacugcuacccugauccuagcagguguaagucugcuuccugugugccaaagcucguccaugcggaaaacagacuggcucccaaugacuguugccgcgaugggcgugcccccucugcccuuguuuauauucucucugaaggauaccuuaaagcguagaagcuggccacucaaugaaggggucauggcugugggacugguaucaauccuugccaguucccuguugaggaacgacgugccuauggcaggcccccucgucgccggugggcugcuaauugcuuguuacguuaucacgggaacaucugcagaucugaccguggagaaagccgcggacgugacuugggaagaggaagcugagcagacaggcgucagccauaaccuuaugauuaccguggacgaugacggcacuaugcgcaucaaggaugacgagacagaaaauauacucaccguucuguugaaaacggccuuacugauuguauccgggaucuuuccauacucaaucccggcaacucuccugguguggcacaccuggcagaagcagacacaacggagcggaguccuuugggaugugccuagucccccagagacccagaaagccgaacuggaggaggguguuuauagaauuaagcagcagggcauauucgggaaaacacaagugggagucggcgugcagaaggaagguguauuucauacuauguggcacgucaccaggggggcuguguugacguacaacggaaagcgacuagagcccaauugggccucuguuaaaaaggaccugaucuccuauggcggcggguggcgccucaacgcacaguggcaaaaaggagaagaggugcaggucauugcuguggaaccugguaagaauccaaaaaacuuccagacaaugcccggcacuuuccagaccacaaccggggagaucggagccauugcgcuggauuuuaagccuggcacuagcgguucgccgaucauaaaucgggaggggaagguugugggacuuuacggcaacggcgucgugaccaaaaaugggggauauguaucagguaucgcccaaacaaacgcagaaccagacggccccacgccugaguuagaagaggaaauguucaagaaaagaaaucugacuauuauggaucuccacccagggucuggaaagaccaggaaauacuugcccgcuaucgugcgugaggccauuaagcgccggcugagaacacucauccuggcuccuaccaggguugucgcagccgagauggaagaggcccuuaagggccugccgauacgauaucagacuacagcuaccaaaagugaacauacgggucgggagauuguggacuugaugugccacgcgacuuuuacaaugcgccuacugucccccgugagagucccaaacuacaaucucaucaucauggaugaagcacauuucaccgacccugccagcauugcugccaggggguacaucucuacccggguaggaaugggcgaggcagccgcuauauuuaugacugcgacacccccaggcaccgccgaugcauucccucagagcaacgcucccauucaggacgaggaacgagacaucccagagagauccuggaauucagggaacgaauggauuacagauuuugccggaaagacugugugguucguuccgaguaucaaagcagguaacgacauagccaauuguuuacgcaagaacggcaaaaaggugauucaacugagcaggaagacguuugauaccgaguaucagaaaacaaagcuuaaugacugggauuucgucgugacuaccgacaucucugagaugggggcuaacuuuaaagccgaucguguuaucgacccucggagaugccugaagcccgugauucucacagauggaccagaaagggucaucuuggcgggccccaugccugugaccgcagccuccgcugcccagcgccgagguagaguagggcggaauccacagaaagagaacgaccaauacauuuucacuggccagccccugaauaacgaugaagaccacgcucauuggacggaggcaaagaugcuccuggacaauauaaacaccccugaaggaaucauuccggcccuuuucgagccagagagggaaaagucagcugccaucgauggcgaguaucgccuaaaaggggaaagucguaagacauuuguggagcugaugagacggggagacuugcccguuugguuagcacacaaagucgcgagcgaagguaucaaguacacugauaggaaauggugcuucgacggccagcgcaauaaccagauucuggaggagaauauggauguggaaauauggaccaaggagggggaaaaaaagaagcuccgaccuagauggcuggacgcccggacauauuccgauccccuugcucugaaagaguuuaaggacuucgccgcaggaaggaaaucuaucgcucucgauuuggugaccgaaauuggccgcgucccaacucaccuggcccauagaacaaggucggcacuagacaaccugguuaugcuccacacgagcgagcauggugggaaggccuaccggcacgcuguggaggaacuuccugagaccauggaaacucuguuauugcugggccucaugauccugcuuacaggaggcgcgaugcuguuucucauuucagggaaaggaaucgguaagaccuccauaggcuugaucuguguaauugccaguucugggaugcuguggauggcagagauccccuuacaauggauugcuagcgccaucgugcuagaguucuuuaugaugguccugcucauaccagaaccugagaagcagcguaccccgcaggauaaucaacuugccuaugugguuauuggaauccugacauuggcagcuauuaucgccgcgaacgaaaugggccugcucgagacuacgaaacgcgaccuggguauguccaaggaacccgggguggucucaccaaccucuuaccuugauguagaccuccacccugcuagcgccuggacacuguacgcaguggccacuaccguuauaacacccauguugcgacauaccaucgagaauaguacugcuaacgugucccuggcagccauugcgaaccaggcugucguguuaaugggccuagacaaaggauggccaaucagcaagauggaucugggcgucccucuccuugcccuggggugcuauucucaggugaaucccuugacgcugacagcagccguucuccugcuuauuacccacuacgcuaucauaggaccgggcuuacaggccaaagcaacuagagaggcucaaaagaggaccgccgcggguauuaugaagaacccaacaguggacgggaucaugacuaucgaucuggacccuguaauuuaugauucaaaauucgaaaagcagcucggacaggugauguugcugguccuaugugccguucagcugcuccuuaugcggaccuccugggcacugugcgaggcuuugacacuggccacgggccccaucaccacucucugggaagguaguccaggcaaauuuuggaauacaaccauagcagugagcauggcuaacauuuuccgcgggucguaccuggccggagccggcuuagcguuuucuaucaugaaguccgucgggacuggaaaaagaggcacagguagccaaggggagacccuuggagaaaaguggaagaggaaacugaaucagcucucacggaaggaguucgaccuauauaaaaagaguggcauuacggagguggaucgaaccgaagcuaaagagggucugaagagaggcgaaaucacacaucacgcaguaucucgcggguccgccaaauugcagugguuuguggagaggaacaugguuauacccgaaggacgggugaucgaccugggcugugggcguggaggcuggagcuacuauugcgcuggucucaagaaggucacugaggugagaggguacaccaaaggaggcccuggccaugaggaaccgguccccaugucaacauacggguggaauauugugaagcuuaugaguggaaaagauguuuucuaucugccaccugagaagugugacacuuugcugugcgauaucggugaaagcucccccucuccuaccguagaggagagcaggacaauucgcgugcucaaaauggucgaaccaugguuaaagaacaaucaguucuguaucaaggugcugaaccccuacaugccuaccguuauugagcaccuugaacggcugcaacgaaaacacggcgggaugcuagugagaaauccacucuccaggaacucaacucaugagauguauuggaucucuaauggaacgggcaacauagucgccagugugaauaugguaucgcgccuguugcugaaccgguuuacaaugacccacagacgucccacuauugaaaaggacguggaucucggugcagggaccaggcauguuaacgccgagccggagacaccuaauauggacgucaucggagaacggaucaaacgcauuaaggaggaacacaacagcacguggcacuacgacgaugagaauccauauaaaaccugggcuuaccauggcuccuaugaagugaaggcgacuggcucugccucaagcaugauaaacgggguggucaagcuucugacaaaacccugggacguugugccuaugguaacccagauggcaaugacugauacaaccccauucggacagcaacgaguguuuaaggagaaagucgacacaagaacucccaggccgaugccugguacccggcgcgugaugggcaucacggcugagugguuauggagaacccuggggaggaauaagaaaccccgauugugcacacgggaagaguucacuaagaagguucguaccaacgccgcaaugggagccguguuuacagaagagaaucagugggauuccgcuaaagccgcggucgaagacgaggauuucuggaagcucguggacagagagcgcgaacugcacaaacuaggcaagugugguaguugcguauacaacaugauggggaaaagggagaagaaacuuggagaauuuggcaaggcaaagggcucucgggccauuugguacauguggcugggggcuagauaucucgaguucgaggcccugggauuuuugaaugaagaucauugguucagccgcgagaacucauacuccgguguugaaggcgaggggcugcacaaacucggauauauccuuagggacauuaguaagaucccaggcggugcaauguacgcugaugacacugccgggugggacacccgaauaacggaagaugaccugcauaaugaggagaaaaucacacagcagauggauccugaacaccggcaauuagcuaacgccauuuuuaagcugaccuaucagaauaaaguggucaaggugcagagacccacuccaacaggaaccgugauggacaucauuagcaggaaggaucagcgcggcucuggccaagucgggacuuacggauugaacaccuucacaaauauggaggcacagcucauccgucagauggaaggugagggcguucuguccaaagcggaccuagaaaacccccaccuuucagagaagaaaauaacgcaguggcuggagaccaaggggguggaacggcucaaaagaauggccauuagcggagaugacugcguagugaagccuaucgaugacagguuugcuaacgcccuguuggcauuaaaugauaugggcaagguccgcaaagacaucccacaauggcagccgucgaaggguuggcaugauuggcagcaggugcccuucuguucucaccauuuccacgagcugauuaugaaagacgggcgaaagcucguugugccuugccggccacaagacgaacuuauaggaagagcuaggaucagucagggcgccggcuggucccugcgcgagacugcaugucuagggaaagccuaugcgcagauguggagccugauguacuuucacagacgggaucucagguuggcuucaaacgccauuugcuccgcaguccccgugcauuggguaccuacaucucguaccacuuggagcauccacgcccaucaccaauggaugacaaccgaagacaugcugacgguuuggaaucgaguguggauugaggauaacccauggauggaggacaagacacccgucaccacuugggaaaaugugccuuaccuuggaaagcgcgaggaucaguggugugguagucugaucggccucaccuccagagcuacaugggcccagaacauaccgacugcaauccagcaaguucggagcuuaauugggaaugaagaguuccuggacuauaugccaucuaugaaaagguuucgcaaggaggaagagucagaaggagcuaucugguga

SEQ ID NO: 15483 - RNA, 9873 nt, Artificial Sequence
  derived and/or modified CDS sequence (opt3) from DENV-3__KF955453__SS-prME
accagccugugccucaugaugauccuucccgcaacacuggcuuuccacuugacuuccagggacggcgaaccuaggaugauuguggggaagaacgaacggggaaaaucuuuacuguuuaagacggcaucagguauaaauauguguacccuaaucgccauggaucucggcgagaugugcgacgauacaguaacuuacaaauguccacauauuaccgaaguugagccggaagacaucgauugcugguguaaccugacaagcaccugggugacuuaugggacaugcaaucaggcgggagagcaccgccgagacaagcguagcguagcucuugcaccacaugugggcaugggucuggauaccagaacgcagacuuggauguccgcagagggggccuggaggcaggucgaaaaaguggagaccugggcuuugcggcacccuggauucacaauucucgcacuguuucuggcccauuacaucggcacuucucucacccagaagguugugauauucaucuuacugaugcuugucacaccaucgaugaccaugcgcugugugggcguagggaacagagacuuuguugaaggauugucaggugcuacguggguggaugucgugcuggagcacggcgggugcgugacuacaauggccaagaauaaacccacccuagacauugagcuccagaagacugaagcgacacagcuggcaacccuuaggaaacuguguaucgagggaaagauuacgaacaucaccacagauagccggugcccuacucagggcgaagccgucuugccagaggaacaggaccagaauuauguuuguaaacacaccuacguggaucgcgguugggggaacggaugcggccucuucggcaaggggagucugguaacaugcgcuaaguuucaauguuuagagcccauagagggaaaagugguccaguaugaaaaucugaaguacacugugauuaucaccguucauacaggugaccagcaccaggugggcaacgagacccaaggggucacugccgaaauuacgccucaggcauccacaaccgaggcuacucucccagaauauggaacccuuggccuggagugcucuccgcgaacagguuuggacuucaaugagaugauccuacugaccaugaaaaacaaggccuggauggugcauagacagugguuuuucgaucucccccugccuuggacuagcggggcgacaacggaaaccccaacuuggaauaggaaagagcuucugguaacauuuaagaacgcccacgccaagaagcaagaaguuguggucuugggcucccaggagggagcuaugcacaccgcccucacaggcgcuacugaaauccaaaauucagggggaaccaguauuuucgccggucaucugaagugucgguuaaaaauggacaagcuggagcuaaaaggcaugagcuacgcaaugugcacgaacaccuuugugcucaagaaagaggucucugaaacacagcacgggacuauacugaucaagguggaguacaagggagaagauguucccuguaaaauuccuuucuccaccgaggacggccaagguaaggcccauaacgggcgucuuaucacagcuaauccagugguaacuaaaaaggaggaacccgucaacauagaggcggaaccgccuuucggcgagucaaauauugugaucggaaucggcgauaacgcauugaaaauuaauugguauaagaaggggagcaguaucggaaaaauguuugaagccaccgcucgcggugccagaaggauggcaauucugggcgacacggccugggauuucgggucuguuggaggcgugcucaacucccuggguaagaugguccaccagauauuugggagcgcuuacacagcccuuuucucgggcgugucuuggguaaugaaaaucggaauuggcgugcuguugaccuggaucgggcucaauuccaagaacacuucaaugaguuuuagcugcaucgcaauuggaauaaucacacuguauuuaggcgcgguuguccaggcugacauggguugugugauuaauuggaaagggaaggagcugaagugcggauccggcaucuucgugaccaacgagguccauacuuggaccgaacaguacaaauuucaagccgauucucccaagcggcuagcaacagccauugcuggugccugggagaauggcguuugugggauccgaagcacgacccgcauggaaaaccuccuguggaaacagauagcaaaugagcuuaacuauaucuugugggaaaauaacauuaagcugacuguggugguaggagacaucauuggcguccucgagcaggggaaaagaacacugaccccacagccuauggaguuaaaguacucauggaaaacauggggaaaggcuaagaucgugacugccgaaacccaaaacaguuccuucauaauugauggccccaauacgccagagugccccagcgcgucuagggccuggaacguuugggaaguggaggacuaugguuuuggggucuucacaaccaauaucuggcugaaacuucgggaaguguacacucaguugugugaccaccgccucaugucagcugcaguuaaggaugagagagccgugcacgcugacaugggauacuggauugagagucagaaaaacggcagcuggaagcuggaaaaagccucccuaaucgagguaaagaccugcacauggccuaagucucauacucuguggucgaaugguguccucgaaagcgauaugauaaucccaaaaucccuggcaggcccgauuucacagcacaacuauaggcccggguaccauacccaaacagcgggaccuuggcaccuuggcaaguuggagcuggacuuuaauuauugcgaggggacgaccguggugaucacugaaaacuguggaacacguggcccaaguuuacggaccacuacagucucugguaaacucauucacgaguggugcugucgaagcugcacccugcccccucuuagauacaugggggaagauggauguugguauggcauggagaucaggccaauauccgaaaaggaggagaauaugguuaaaucacuggugagcgccgguucuggcgaaguagacaacuucacgauggggguguugugccucgcuauucuguuugaggaagucaugcgcggaaaguucggcaagaaacauaugaucgccgggguguucuuuacuuucguucuacugcucuccggacagaucaccuggcgggauauggcacacacacugauuaugaucggcaguaaugcuagcgacagaauggguaugggggugaccuaccuugccuugauugcaacuuuuaagauacagcccuuccuggccuuaggauuuuuccucaggaaacugacaucucgcgagaaccuucugcuaggcgucggccucgcuauggcgaccacacugcaauugccggaagauaucgagcagauggccaaugggauugcacugggauuaauggcucucaagcugaucacucaguuugagaccuaucagcuuuggacggcccugauuuccuugacauguucaaacaccaucuucacucucaccguggccuggcgaacagcuacucugauacuagccgguguuagucugcuuccugugugccaaagcucguccaugcggaaaaccgacuggcucccaaugacggucgccgcgaugggcguacccccucugcccuuguuuaucuucaaucugaaggauacauuaaagcguagaucuuggccacucaacgaaggggugauggcuguuggacuggugagcauucuugccucaagucuguugaggaacgacgucccuauggcaggcccccucguggccggugggcugcuaaucgcuuguuacguaauuaccggaacuuccgcagaucugacaguggagaaagccgcggacgucaccugggaagaggaagcugagcagacuggcguuucucauaaucuuaugaucacaguggacgaugacggcaccaugcgcauaaaggaugacgagacggaaaacauucucacugugcuguugaaaaccgccuuacugaucgucagcgggaucuuuccauacuccauuccggcaacacuccugguguggcacaccuggcagaagcagacacaacggucaggaguucuuugggauguaccuagucccccagagacucagaaagccgaacuggaggaggguguguauagaauaaagcagcagggcaucuucgggaaaacccaagucggagugggcguucagaaggaagguguguuucauacgauguggcacgucacaagaggggcuguguugacuuacaauggaaagcgacuagagcccaacugggccagugucaagaaggaccugauuucuuauggcggcggguggcgccucuccgcacaguggcaaaaaggagaagagguccaggugaucgcuguugaaccugguaagaaucccaaaaauuuccagaccaugcccggcacauuccagaccacuaccggggagauuggagccaucgcgcuggauuuuaagccuggcacaagcgguucgccgauaaucaaucgggaggggaagauugugggacuuuacggcaacggcgucgugacgaaaaaugggggauauguuucagguaucgcccaaacuaacgcagaaccagacggccccaccccugaguuagaagaggaaauguucaagaaaagaaaucugacaauuauggaucuccacccagggucuggaaagaccaggaaauacuugcccgcuaucgugcgugaggccauaaagcgccggcugagaacucucauucuggcuccuacaagggucguggcagccgagauggaagaggcccuuaagggccugccgauccgauaucagaccacggcuacuaaaagugaacauacaggucgggagaucguagacuugaugugccacgcgaccuuuaccaugcgccuacugucccccgugagaguuccaaacuacaaucucauuaucauggaugaagcacauuucacugacccugccagcauagcugccaggggguacauuucuacacgggucggaaugggcgaggcagccgcuaucuuuaugaccgcgacacccccaggcacugccgaugcauucccucagagcaacgcucccauucaggacgaggaacgagacaucccagagagauccuggaacucagggaacgaauggauaacggauuuugccggaaagaccgugugguucgugccgaguauuaaagcagguaacgacaucgccaauuguuuacgcaagaacggcaaaaaggucauccaacugagcaggaagacauuugauacugaguaucagaaaaccaaacuuaaugacugggauuucguagugacaaccgacauuucugagaugggggcuaacuuuaaagccgaucguguuaucgacccucggagaugccugaagcccgugauucucacugauggaccagaaagggucauauuggcgggccccaugccugugacggcagccuccgcugcccagcgccgagguagaguugggcggaauccacagaaagagaacgaccaauacaucuucaccggccagccccugaauaacgaugaagaccacgcucauuggacagaggcaaagaugcuccuggacaauauuaacacuccugaaggaaucaucccggcccuuuucgagccagagagggaaaagucagcugccauugauggcgaguaucgccuaaaaggggaaagucguaagaccuuuguggagcugaugagacggggagacuugcccgucugguuagcacacaaaguggcgagcgaagguauaaaguacacagauaggaaauggugcuucgacggccagcgcaauaaccagauccuggaggagaauauggauguagaaauuuggaccaaggagggggagaaaaagaagcuccgaccuagauggcuggacgcccggacuuauuccgauccccuugcucugaaagaguuuaaggacuucgccgcaggaaggaaaucuaucgcucucgauuuggugacagaaauuggccgcguuccaacgcaccuggcccauagaaccaggaacgcacuagacaaucuggucaugcuccacacuucggagcauggugggaaggccuaccggcacgcuguggaggaacuuccugagacaauggaaacccuguuauugcugggccucaugaucagccugaccggaggcgcgaugcuuuuucugauaucagggaaaggaaucgguaagacauccauuggccucaucugugugauugccaguucugggauguuguggauggcagagaucccccugcaauggauagcuagcgccauugucuuagaguucuuuaugaugguucuacugaucccagaaccugagaagcagcguacuccgcaggauaaccaacucgccuaugugguaauuggaauccuuacgcuggcagcuauaaucgccgcgaaugaaaugggcuugcuggagaccacaaaacgcgaccucgguauguccaaggaacccgggguggucucaccaacuucuuaccuggauguggaccuucacccugcuagcgccuggacccucuacgcaguugccacaaccgugauuacucccaugcugcgacauacgaucgagaacaguacagcuaacgucuccuuggcagccauugcgaaucaggcuguagugcugaugggcuuagacaaaggauggccaaucagcaagauggaucuaggcguuccucugcucgcccuugggugcuauucucaggugaacccccugaccuugacugcagccguccugcuccugauaacccacuacgcuauuaucggaccgggccuucaggccaaagcaacaagagaggcucaaaagaggacugccgcggguaucaugaagaauccaaccguggacgggauuaugacaaucgauuuagacccugucauauaugauucaaaauucgaaaagcagcugggacaggugaugcucuugguucugugugccgugcagcuacugcucaugcggacguccugggcacuuugcgaggcucugaccuuggccacuggccccauuacaacccugugggaagguaguccaggcaaauuuuggaacacuacaaucgcaguaagcauggcuaauauuuuccgcgggucguaccucgccggagccggccuggcguuuucuaucaugaaguccguggggaccggaaaaagaggcacggguagccaaggggagaccuuaggagaaaaguggaagaagaaacuuaaccagcugucaaggaaagaguucgaccucuauaagaaaaguggcauaacagaggucgaucggacugaagcuaaagagggucuaaaacgaggcgaaaucacccaucacgcaguuucuagaggguccgccaagcugcagugguuuguggagcgcaauauggucauucccgaaggaagggugaucgacuugggcugugggcggggaggcuggagcuacuauugcgcuggucugaagaaaguaacagaggugcguggguacacuaagggaggcccuggccaugaggaaccgguucccaugucaaccuacggguggaacauugugaaacucaugaguggaaaggaugucuucuaucuuccaccugagaaaugugacacacuguugugcgauaucggugaaagcucccccucuccuaccguggaggagagcagaacuauuaggguccugaagaugguggaaccauggcucaagaauaaccaguucuguaucaaaguuuuaaaucccuacaugccuacgguaauagagcaccuggaacgccuucaacggaagcacggcgggaugcuggugcgaaacccacuauccagaaauucaacacaugagauguauuggauuucuaacggaaccggcaauaucgucgccagugugaacaugguuucgaggcuccuguugaaccgcuuuacuaugacccaccggagacccacaaucgaaaaagacguggaucugggugcagggacgcgucaugucaaugccgagccggagaccccuaacauggacgugauuggagaaaggauaaagcggaucaaagaggaacacaauagcacuuggcacuacgacgaugagaacccauauaagacaugggcuuaccauggcuccuaugaaguaaaggcgaccggcucugccucaagcaugauuaauggggugguuaaacuccuuacuaagcccugggacgucgugccuauggugacacagauggcaaugaccgauacaacuccauucggacagcaacgcgucuuuaaagagaagguugacacccgaacgcccagauccaugccggguaccaggcgggugaugggcaucacagcugaguggcuguggcgcacuuuagggagaaacaaaaagccuaggcugugcacccgagaagaguucacaaagaaaguacggacuaaugccgcaaugggagccguguuuaccgaagagaaccagugggauagugcuaaggccgcggucgaagacgaggauuucuggaaauugguggaccgugagagagaacuccacaagcugggcaaaugugguucuugcguuuacaauaugauggggaagcgcgagaaaaagcuaggagaauuuggcaaggcaaaaggcagcagggccauuugguacauguggcuuggggcucgguaucuggaguucgaggcccucggauuucugaacgaagaucauugguucucaagagaaaauuccuacagugguguggagggcgagggguugcacaagcugggauauauccuccgcgacauaagcaaaauccccggcggugcaauguacgcugaugacacggccgggugggacacaaggauuaccgaagaugaccuucauaacgaggagaagaucacucagcagauggauccagaacaccgacaacuggcuaaugccauuuuuaaauuaacauaucagaacaaggucgugaagguacagcggccuacccccacuggaaccguuauggacaucauaucuagaaaagaucagaggggcuccggccaaguggggacauacggacugaauacguucaccaacauggaggcacaguugauucgccagauggaaggugagggcguccucucaaaggcggaccuggaaaacccacaccuacccgagaaaaagaucacucaguggcuugagacaaaagggguggaacgucugaagcggauggccaucagcggagaugacugcguggucaagccuauugaugacagauuugcuaaugcccuccuggcauugaacgauaugggcaaaguuaggaaggacauaccacaauggcagccgucgaaagguuggcaugauuggcaacaggugcccuucuguucucaccauuuccacgaguuaaucaugaaggacgggcgcaaacugguagugccuugccgaccacaagacgaacucauuggacgggcuagaaucagucagggcgccggcuggucccuuagggagaccgcaugucuggggaaggccuaugcgcagauguggagccuaauguacuuucaccgcagagaucugcggcucgcuucaaaugccauuugcuccgcaguccccgugcauuggguuccuacuucuaggacaaccuggagcauccacgcccaucaccaauggaugacgacagaagacauguugaccguguggaaccgugucuggauagaggauaauccauggauggaggacaagacucccgugaccacaugggaaaacguaccuuaccugggaaaacgagaggaucaguggugugguagucuuaucggccugacuucccgcgcuaccugggcccagaauauuccgacagcaauccagcaaguuagaagccucauugggaacgaagaguucuuagacuauaugccaucuaugaagcgguuuaggaaagaggaagagucagaaggagcuaucugguga

SEQ ID NO: 15484 - RNA, 9873 nt, Artificial Sequence
  derived and/or modified CDS sequence (opt3) from DENV-3__FJ373304__SS-prME
accagccugugccucaugaugauccuucccgccgcucuggcauuccacuugaccuccagagacggcgagccuaggaugauuguggggaagaacgaacggggaaaaucuuuacuguuuaagacugccucagguauaaauauguguacgcuaaucgcgauggaucucggcgaaaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaaggucgugcaccagaucuuugggagcgccuacaccgcacuuuucucgggcguaucuugggugaugaaaauuggaaucggcguucuguugacguggaucgggcucaauuccaagaacacaucaaugaguuuuagcugcauugcgauaggaaucauuacccuguauuuaggcgcugucgugcaggccgacauggguugugugaucaauuggaaagggaaggagcugaagugcggauccggcauuuucgucacuaacgagguucauacauggaccgaacaguacaaauuucaagcagauucucccaagcggcuagccacugcuaucgccggugcaugggagaauggcgugugugggauacgaagcaccacacgcauggaaaaccuccuguggaaacagaucgcuaaugagcuuaacuauauuuugugggaaaauaacaucaagcugacggugguagucggagacaccauuggcgugcucgagcaggggaaaagaacucugacaccacagccuauggaguuaaaguacucauggaaaaccuggggaaaggccaagaucguuacagcggaaacucaaaacaguuccuucauaauugauggccccaauaccccagagugccccagcgccucuagggcuuggaacgugugggaagucgaggacuaugguuuugggguguucacgacaaauaucuggcugaaacuucgggaaguuuacacccaguugugugaccaccgccucaugucagcagccgugaaggaugagagagcuguacacgccgacaugggauacuggauugagagucagaaaaacggcagcuggaagcuggaaaaagcaucccuaaucgaggucaagacuugcaccuggccuaagucucauacacuguggucgaauggugugcucgaaagcgauaugauaaucccaaaaucccuggcgggcccgauuucacagcacaacuauaggcccggguaccauacucaaaccgccggaccuuggcaccuuggcaaguuggagcuggacuuuaauuauugcgaggggacaacgguggucaucaccgaaaacuguggaacucguggcccaaguuuacggacaaccacuguuucugguaaacucauucacgaguggugcugucgaagcugcacacugcccccucuuagauacaugggggaagauggauguugguauggcauggagaucaggccaauauccgaaaaggaggagaauauggugaaaucacugguaagcgcugguucuggcgaaguggacaacuucaccaugggggucuugugccucgccauucuguuugaggaagugaugcgcggaaaguucggcaagaaacauaugaucgcagggguuuucuuuacguucgugcuacugcucuccggacagaucacuuggcgggauauggcucacacccugauuaugaucggcaguaaugccagcgacagaauggguaugggggucacauaccuugcauugauugccaccuuuaagauacagcccuuccuggcuuuaggauuuuuccucaggaaacugacuucucgcgagaaccuucugcuaggcgugggccucgcgauggccacaacccugcaauugccggaagauaucgagcagauggcaaaugggauugcucugggauuaauggcccucaagcugaucacacaguuugagacuuaucagcuuuggaccgcccugauuuccuugacguguucaaacacaaucuucacccucacuguugcuuggcgaaccgcaacacugauacuagccggugugagucugcuuccugucugccaaagcucguccaugcggaaaacugacuggcucccaaugaccguagcggcuaugggcgugcccccucugcccuuguuuaucuucucucugaaggauacguuaaagcguagaagcuggccacucaaugaagggguuauggccgugggacuggucucaauucuugcaaguucccuguugaggaacgacgugccuauggccggcccccucguagcuggugggcugcuaaucgcauguuacgugauuacaggaaccucugccgaucugacugucgagaaagcggcugacguuacaugggaagaggaagccgagcagaccggcgugagccauaaccuuaugaucacuguggacgaugacggcacaaugcgcauaaaggaugacgagaccgaaaauauucucacgguccuguugaaaacugcauuacugaucguguccgggaucuuuccauacucaauuccggccacccuccugguuuggcacacauggcagaagcagacccaacggagcggaguacuuugggaugugccuagucccccagagacacagaaagcugaacuggaggagggugucuauagaauaaagcagcagggcaucuucgggaaaacucaagugggaguuggcgugcagaaggaaggugucuuucauaccauguggcacgugacgagaggggccguauugacauacaacggaaagcgacuagagcccaauugggcaucugucaaaaaggaccugauuuccuauggcggcggguggcgccucagcgcucaguggcaaaaaggagaagaggugcagguuaucgccguggaaccugguaagaaccccaagaauuuccagacuaugcccggcaccuuccagacaaccacuggggagauuggagcgaucgcccuggauuuuaagccuggcaccucggguucaccgauaaucaaccgggaggggaaggucgugggacuuuacggcaauggcguugugaccaagaacgggggauaugucucugguauugcacaaacgaaugcugaaccagacggccccacuccugaguuagaagaggaaauguucaagaaaagaaaccugaccaucauggaucuccacccagggaguggaaagacaaggaaauacuugcccgccauugugcgugaggcuaucaagcgccggcugagaacccucauacuggcaccuacuaggguaguggccgccgagauggaagaggcucuuaagggccugccgauucgauaucagacaaccgcgacgaaauccgaacauacuggucgggagaucguugacuugaugugccacgcaacauuuaccaugcgccuacugagccccgucagagugccaaauuacaaccucaucauuauggaugaagcccauuucaccgacccugcuucuaucgccgcaaggggguacauaagcacucgggugggaaugggcgaggccgcugcgauuuuuaugacagccacaccaccaggcacagcagaugcuuucccucaguccaaugcccccauccaggacgaggaacgagacauuccagagagaucauggaacagugggaaugaauggaucacugauuuugcaggaaagacggucugguucguaccgagcauaaaagccgguaacgacauugcuaacuguuuacgcaagaauggcaaaaaggugauccaacugucuaggaagaccuuugauacagaguaucagaaaacuaaacuuaacgacugggauuucguugugaccacagacaucuccgagaugggggccaauuuuaaagcggaucgugucauugacccucggagaugccugaagcccgugauccucaccgauggaccagaaaggguuauuuuggcaggccccaugccugugacugccgcuucagccgcucagcgccgagguagagucgggcggaacccacagaaagagaaugaccaauacauauucacgggccagccccugaacaaugaugaagaccacgcacauuggaccgaggccaagaugcuccuggacaacaucaauacaccugaaggaauuaucccggcucuuuucgagccagagagggaaaagagugccgcaaucgauggcgaguaucgccuaaaaggggaaagccguaagacuuuuguggagcugaugagacggggagacuugcccguaugguuagcgcacaaaguggccuccgaagguauuaaguacaccgauaggaaauggugcuucgacggccagcgcaacaaucagauacuggaggagaacauggauguugaaaucuggacaaaggagggggagaaaaagaagcuccgaccuagauggcuggacgcucggaccuauucugauccccuugcccugaaagaguuuaaggacuucgcagcuggaaggaaaucgauugcccucgauuuggucacugaaaucggccgcgugccaacacaccuggcacauagaacgaggaaugcccuagacaaccuggugaugcuccacaccagcgagcauggugggaaggcuuaccggcacgcggucgaggaacuuccugagacuauggaaacacuguuauugcugggccucaugauucugcuuaccggaggcgccaugcuguuucucaucucagggaaaggaauagguaagaccuccaucggcuugauuuguguuaucgcaaguucugggaugcuguggauggcugagauucccuuacaauggaucgccagcgccauaauucuagaguucuuuaugauggugcugcucaucccagaaccugagaagcagcguacaccgcaggauaaucaacuugcauauguagugauuggaauccugacuuuggcugccauaaucgcggcuaacgaaaugggccugcucgagacgaccaaacgcgaccuggguauguccaaggaacccggggucgugucaccaacaucuuaccuugauguugaccuccacccugccagcgcauggacucuguacgccguggcuaccacagucauuacccccauguugcgacauacuaucgagaauaguacggcaaacguaucccuggccgcgauugcuaaccaggccgugguuuuaaugggccuagacaaaggauggccaaucagcaagauggaucugggcgugccucuccuugcacuggggugcuauucucaggucaaucccuugacacugaccgccgcugugcuccugcuuauaacucacuacgccauuaucggaccgggcuuacaggcaaaagcuaccagagaggcccaaaagaggacagcggccgguaucaugaagaacccaacugucgacgggauuaugaccaucgaucuggacccugugauauaugauucaaaauucgaaaagcagcucggacagguuauguugcuggugcuaugugcaguacagcugcuccuuaugcggacauccugggcucugugcgaggccuugacgcuggcaaccggccccauuacuacacucugggaagguaguccaggcaaauuuuggaauaccacuaucgcugugagcauggccaacauuuuccgcgggucguaccuggccggagcgggcuuagcuuuuucuaucaugaaguccgucgggacaggaaaaagaggcaccgguagccaaggggagacgcuuggagaaaaguggaagaaaaagcugaaucagcucucaaggaaagaguucgaccuauauaagaaaaguggcauaaccgagguugaucggacagaagcaaaggagggucugaaacgaggcgaaaucacucaucacgccgugucuagaggguccgcuaaguugcagugguuugucgagcgcaacauggugauucccgaaggaaggguaaucgaccugggcugugggcggggaggcuggagcuacuauugcgccggucucaagaaagugaccgagguucguggguacacaaagggaggcccuggccaugaggaaccggugcccaugucaacuuacggguggaauauugucaaacuuaugaguggaaaggauguguucuaucugccaccugagaaaugugacaccuugcugugcgauaucggugaaagcucccccucuccuacagucgaggagagcagaaccauuagggugcucaagaugguugaaccaugguuaaagaacaaucaguucuguaucaaaguacugaaccccuacaugccuacugugauagagcaccuugaacgccugcaacggaagcacggcgggaugcuaguccgaaauccacucuccagaaacucaacgcaugagauguauuggauuucuaauggaacaggcaacaucguggcaaguguuaauauggugucgaggcuguugcugaaccgcuuuaccaugacucaccggagacccaccaucgaaaaagacgucgaucucggugccgggacacgucaugugaacgcugagccggagacgccuaauauggacguaauuggagaaaggauaaagcggaucaaagaggaacacaacagcaccuggcacuacgacgaugagaauccauauaagacuugggcguaccauggcuccuaugaagugaaggccacaggcucugcaucaagcaugauuaacgggguugucaaacuucugaccaagcccugggacguggugccuauggucacucagauggcuaugacagauaccacaccauucggacagcaacgcguuuuuaaagagaagguggacacucgaacccccagauccaugccggguacgaggcggguaaugggcaucaccgccgagugguuauggcgcacacuggggagaaauaaaaagccuagguugugcacucgagaagaguucaccaagaaagugcggacaaacgcagccaugggagcugucuuuacugaagagaaucagugggauagugccaaggcggcaguggaagacgaggauuucuggaaacucguugaccgugagagagaacugcacaagcuaggcaaaugugguucuugcguguacaacaugauggggaagcgcgagaagaaacuuggagaauuuggcaaagccaaaggcagcagggcuauuugguacauguggcugggggcccgguaucucgaguucgaggcacugggauuuuugaaugaagaucauugguucucaagagagaacuccuacaguggugucgaaggcgaggggcugcacaagcucggauauauccuucgcgacauaagcaaaauccccggcggugcuauguacgccgaugacaccgcugggugggacacgaggauuacagaagaugaccugcauaaugaggagaagaucacccagcagauggauccagaacaccgacaauuagccaacgcaauuuuuaaacugacuuaucagaauaaggugguaaagguucagcggccuacacccaccggaacugugauggacaucauaucuagaaaagaucagaggggcuccggccaagucgggaccuacggauugaacacauucacgaauauggaggcgcagcucauucgccagauggaaggugagggcgugcugucaaaggccgaccuagaaaacccacaccuucccgagaaaaagaucacccaguggcuggagacuaaagggguggaacgucucaagcggauggcuaucagcggagaugacugcgucguuaagccuauugaugacagauuugccaacgcacuguuggcuuuaaaugauaugggcaaagugaggaaggacauaccacaauggcagccgucgaaagguuggcaugauuggcagcagguacccuucuguucucaccauuuccacgagcugaucaugaaggacgggcgcaaacucguggucccuugccgaccacaagacgaacuuauuggacgggccagaaucagucagggcgcaggcuggucccugagggagacagccugucuagggaaggcguaugcucagauguggagccugauguacuuucaccgcagagaucuccgguuggccucaaacgcaauuugcuccgccgugcccguucauugggugccuaccucuaggacuacauggagcauccacgcucaucaccaauggaugaccacggaagacaugcugacagucuggaaucguguguggauagaggauaacccauggauggaggacaagacccccguaacuaccugggaaaauguuccuuaccuuggaaaacgagaggaucaguggugugguagucugaucggccucacaucccgcgccacuugggcacagaacauuccgaccgcuauccagcaagugaggagcuuaauugggaaugaagaguuccuggacuauaugccaucuaugaagcgguuuaggaaagaggaagagucagaaggagccaucugguga

SEQ ID NO: 15485 - RNA, 9873 nt, Artificial Sequence
  derived and/or modified CDS sequence (opt3) from DENV-3__EU854291__SS-prME
accagccugugccucaugaugauccuucccgccgcucuggcauuccacuugaccuccagggacggagaaccuaggaugauuguggggaagaacgaacggggaaaaucuuuacuguuuaagacugccucagguauaaauauguguacgcuaaucgcgauggaucucggcgagaugugcgacgauaccauuacauacaaauguccacauaucacugaaguagagccggaagacauugauugcugguguaaccugaccaguacauggguuaccuaugggacuugcaaucaggcuggagagcaccgccgagacaagcguagcguggcccuugcaccccauguaggcaugggucuggauacaagaacccagacguggauguccgccgagggggcuuggagacagguggaaaaagucgagacuugggcauugcggcacccuggauucaccauccucgcccuguuucuggcucauuacauaggcacaucucucacucagaaggugguuaucuucauuuuacugaugcuugugaccccaucgaugacaaugcgcugugucggcguggggaacagagacuuuguagaaggauugucaggugccaccuggguugaugugguccuggagcacggcgggugcgugacgacuauggcgaagaauaaacccacacuagacaucgagcuccagaagaccgaagcaacucaacuggccacacuuaggaaacuguguauugagggaaagaucaccaacauaacgaccgauagccggugcccuacacagggcgaagcuguguugccagaggaacaggaccagaauuaugucuguaaacacacuuacguugaucgcgguugggggaacggaugcggccucuucggcaaggggagucuggugaccugcgccaaguuucaauguuuagagcccauugagggaaaaguagugcaguaugaaaaucugaaguacacagucaucauuacugugcauaccggugaccagcaccagguuggcaacgagacacaaggggugaccgcagaaaucacuccucaggcuuccacgacagaggccauccucccagaauauggaacccuuggccuggagugcucuccgcgaacugguuuggacuucaaugagaugauucuacugaccaugaaaaacaaggcguggaugguccauagacagugguuuuucgaucucccccugccuuggacaagcggggccaccacugaaacaccaacguggaauaggaaagagcuucuggugaccuuuaagaacgcacacgcuaaaaagcaagaaguaguuguguugggcucccaggagggagccaugcacacugcucucacaggcgccaccgaaauacaaaauucagggggaacaaguaucuucgcaggucaucugaagugucgguuaaaaauggacaagcuggagcuaaaaggcaugagcuacgccaugugcacuaacaccuuuguccucaagaaagaggugucugaaacgcagcacgggaccauucugaucaaggucgaguacaagggagaagaugugcccuguaaaauaccuuucuccacagaggacggccaagguaaggcucauaacgggcgucuuauuacugcgaauccaguugugaccaaaaaggaggaacccguaaacaucgaggcagaaccgccuuucggcgagucaaauaucgucauuggaaucggcgauaacgccuugaaaauuaauugguauaagaaggggagcaguauaggaaaaauguuugaagcuacagcccgcggugcaagaaggauggccauccugggcgacacugcuugggauuucgggucugugggaggcguucucaacucccuggguaagauggugcaccagauuuuugggagcgccuacaccgcacuuuucucgggcgucucuugggugaugaaaaucggaaucggcguacuguugacguggauugggcucaauuccaagaacacaucaaugaguuuuagcugcauagcgaucggaauuaucacccuguauuuaggcgcugugguucaggccgacauggguugugucauuaauuggaaagggaaggagcugaagugcggauccggcaucuucgugacuaacgaggugcauacauggaccgaacaguacaaauuucaagcagauucucccaagcggcuagccacugcuauagccggugcaugggagaauggcgucugugggauccgaagcaccacacgcauggaaaaccuccuguggaaacagauugcuaaugagcuuaacuauaucuugugggaaaauaacauuaagcugacgguuguggugggagacaccaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgccucuagggcuuggaacgugugggaaguugaggacuaugguuuugggguguucacgacaaauauuuggcugaaacuucgggaagucuacacccaguugugugaccaccgccucaugucagcagccgugaaggaugagagagcuguucacgccgacaugggauacuggaucgagagucagaaaaacggcagcuggaagcuggaaaaagcaucccuaauagaggugaagacuugcaccuggccuaagucucauacacuguggucgaaugguguacucgaaagcgauaugaucauuccaaaaucccuggcgggcccgaucucacagcacaacuauaggcccggguaccauacucaaaccgccggaccuuggcaccuuggcaaguuggagcuggacuuuaauuauugcgaggggacaacggucgugauuaccgaaaacuguggaacucguggcccaaguuuacggacaaccacugugucugguaaacucauccacgaguggugcugucgaagcugcacacugcccccucuuagauacaugggggaagauggauguugguauggcauggagauaaggccagucuccgaaaaggaggagaauaugguuaaaucacuggugagcgcugguucuggcgaaguagacaacuucaccauggggguguugugccucgccauucuguuugaggaagucaugcgcggaaaguucggcaagaaacauaugaucgcagggguguucuuuacguucguucuacugcucuccggacagaucacuuggcgggauauggcucacacccugauuaugaucggcaguaaugccagcgacagaauggguaugggggugacauaccuugcauugauugccaccuuuaagauacagcccuuccuggcuuuaggauuuuuccucaggaaacugacuucucgcgagaaccuucugcuaggcgucggccucgcgauggccacaacccugcaauugccggaagauaucgagcagauggcaaaugggauugcucugggauuaauggcccucaagcugaucacacaguuugagacuuaucagcuuuggaccgcccugauuuccuugacguguucaaacacaaucuucacccucacuguggcuuggcgaaccgcaacacugauacuagccgguguuagucugcuuccugugugccaaagcucguccaugcggaaaacugacuggcucccaaugaccgucgcggcuaugggcguacccccucugcccuuguuuaucuucucucugaaggauacguuaaagcguagaagcuggccacucaaugaaggggugauggccguuggacuggugucaauucuugcaaguucccuguugaggaacgacgucccuauggccggcccccucguggcuggugggcugcuaaucgcauguuacguaauuacaggaaccucugccgaucugacuguggagaaagcggcugacgucacaugggaagaggaagccgagcagaccggcguuagccauaaccuuaugaucacuguggacgaugacggcacaaugcgcauaaaggaugacgagaccgaaaauauucucacggugcuguugaaaacugcauuacugaucgucuccgggaucuuuccauacucaauuccggccacccuccugguguggcacacauggcagaagcagacccaacggagcggaguucuuugggauguaccuagucccccagagacacagaaagcugaacuggaggaggguguguauagaauaaagcagcagggcaucuucgggaaaacucaagucggagugggcguucagaaggaagguguguuucauaccauguggcacgucacgagaggggccguguugacauacaacggaaagcgacuagagcccaauugggcaucugucaagaaggaccugauuuccuauggcggcggguggcgccucagcgcucaguggcaaaaaggagaagagguccaggugaucgccguugaaccugguaagaaccccaagaauuuccagacuaugcccggcaccuuccagacaaccacuggggagauuggagcgaucgcccuggauuuuaagccuggcaccucggguucaccgauaaucaaccgggaggggaagguggucggacuuuacggcaauggcgugguuaccaagaacgggggauaugugucugguauugcacaaacgaaugcugaaccagacggccccacuccugaguuagaagaggaaauguucaagaaaagaaaccugaccaucauggaucuccacccagggaguggaaagacaaggaaauacuugcccgccauuguccgugaggcuaucaagcgccggcugagaacccucauacuggcaccuacuagggugguagccgccgagauggaagaggcucuuaagggccugccgauucgauaucagacaaccgcgacgaaauccgaacauacuggucgggagaucguggacuugaugugccacgcaacauuuaccaugcgccuacugagccccguuagagucccaaauuacaaccucaucauuauggaugaagcccauuucaccgacccugcuucuaucgccgcaaggggguacauaagcacucgggugggaaugggcgaggccgcugcgauuuuuaugacagccacaccaccaggcacagcagaugcuuucccucaguccaaugcccccauccaggacgaggaacgagacauuccagagagaucauggaacagugggaaugaauggaucacugauuuugcaggaaagacggugugguucgucccgagcauaaaagccgguaacgacauugcuaacuguuuacgcaagaauggcaaaaagguaauccaacugucuaggaagaccuuugauacagaguaucagaaaacuaaacuuaacgacugggauuucgugguuaccacagacaucuccgagaugggggccaauuuuaaagcggaucgugugauugacccucggagaugccugaagcccgucauccucaccgauggaucagaaagggugauuuuggcaggcccaaugcccguuacugccgcuagugccgcucagcgccgagguagaguggggcggaacccucagaaagagaaugaccaauacauauucacgggccagccacugaacaaugaugaagaccacgcacauuggaccgaggccaagaugcuccuggacaacaucaauacacccgaaggaauuaucccugcucuuuucgagccggagagggaaaagagcgccgcaaucgauggcgaguaucgccuaaaaggggaaucccguaagacuuuugucgagcugaugagacggggagacuugccagugugguuagcgcacaaaguagccucugaagguauuaaguacaccgauaggaaauggugcuucgacggccagcgcaacaaucagauacuggaggagaacauggauguggaaaucuggacaaaggagggggagaaaaagaagcuccgacccagauggcuggacgcucggaccuauucggauccucuugcccugaaagaguuuaaggacuucgcagcuggaaggaaaagcauugcccucgauuugguuacugaaaucggccgcguccccacacaccuggcacauagaacgaggaaugcccuagacaaccuggugaugcuccacaccucagagcauggugggaaggcuuaccggcacgcgguggaggaacuuccagagacuauggaaacacuguuauugcugggccucaugauucugcuuaccggaggcgccaugcuguuucucaucuccgggaaaggaauagguaagaccaguaucggcuugauuugugucaucgcaucuagcgggaugcuguggauggcugagauuccuuuacaauggaucgccuccgccauaguucuagaguucuuuaugauggugcugcucauucccgaaccagagaagcagcguacaccucaggauaaucaacuugcauauguagugaucggcauucugacuuuggcugccacgaucgcggcuaacgaaaugggccugcucgagaccacaaaacgcgaccuggguaugucaaaggaaccgggggucgugucucccacuagcuaccuugauguugaccuccacccagccagugcauggacccuguacgccguggcuacaaccgucauaacuccuauguugcgacauacgaucgaaaauuccacagcaaacguaagccuggccgcgauugcuaaccaggccgugguuuuaaugggccuagacaaaggauggcccaucucuaagauggaucugggcgugccacuccuugcacuggggugcuauucacaggucaauccuuugacccugacugccgcugugcuccugcuuauuacccacuacgccaucauaggacccggcuuacaggcaaaagcuacaagagaggcccaaaagaggacugcggccgguauuaugaagaacccgaccgucgacgggaucaugacaaucgaucuggacccagugauuuaugauuccaaauucgagaagcagcucggacagguuauguugcuggugcuaugugcaguacagcugcuccuuaugcggacgaguugggcucugugcgaggccuugacccuggcaacuggcccuaucacaacccucugggaagguagccccggcaaauuuuggaauacuacaauagcugugucgauggccaacauuuuccgcgggucuuaccuggccggagcgggcuuagcuuuuuccaucaugaaaagcgucgggaccggaaaaagaggcacggguucacaaggggagacccuuggagaaaaguggaagaaaaagcugaaucagcucaguaggaaagaguucgaccuauauaagaaaucuggcauuacagagguugaucggacugaagcaaaggagggucugaaacgaggcgaaaucacccaucacgccguguccagagggagcgcuaaguugcagugguuugucgagcgcaacauggugauaccagaaggaaggguaaucgaccugggcugugggcggggaggcuggucauacuauugcgccggucucaagaaagugacagagguucguggguacacuaagggaggccccggccaugaggaaccugugccgaugaguaccuacggguggaauauugucaaacuuaugagcggaaaggauguguucuaucugcccccagagaaaugugacacauugcugugcgauaucggugaauccucuccuagccccaccgucgaggaguccagaacuauuagggugcucaagaugguugaaccuugguuaaagaacaaucaguucuguaucaaaguacugaacccauacaugcccacggugauugagcaccuugaacgccugcaacggaagcacggcgggaugcuaguccgaaauccucucucaagaaacucuacacaugagauguauuggaucaguaauggaaccggcaacauaguggcaucgguuaauauggugagcaggcuguugcugaaccgcuuuacuaugacccaccggagaccaacaauugaaaaagacgucgaucucggugccgggacgcgucaugugaacgcugagcccgagaccccgaauauggacguaaucggagaaaggaucaagcggauuaaagaggaacacaacuccacuuggcacuacgacgaugagaauccuuauaagacaugggcguaccauggcucuuaugaagugaaggccaccggcucagcaagcuccaugauaaacgggguugucaaacuucugacuaagccaugggacguggugcccauggucacacagauggcuaugaccgauacaacuccuuucggacagcaacgcguuuuuaaagagaagguggacacccgaacgccaagacccaugccggguaccaggcggguaaugggcaucacagccgagugguuauggcgcacucuggggagaaauaaaaagccuagguugugcacccgagaagaguucacaaagaaagugcggacuaacgcagccaugggagcugucuuuaccgaagagaaucagugggauagugccaaggcggcaguggaagacgaggauuucuggaaacucguugaccgugagagagaacugcacaagcuaggcaaaugugguucuugcguguacaacaugauggggaagcgcgagaagaaacuuggagaauuuggcaaagccaaaggcagcagggcuauuugguacauguggcugggggcccgguaucucgaguucgaggcacugggauuuuugaaugaagaucauugguucucaagagagaacuccuacaguggugucgaaggcgaggggcugcacaagcucggauauauccuucgcgacauuagcaaaauccccggcggugcuauguacgccgaugacacggcugggugggacacaaggauaaccgaagaugaccugcauaaugaggagaagaucacucagcagauggauccagaacaccgacaauuagccaacgcaauuuuuaaacugacauaucagaauaaggugguaaagguucagcggccuacccccacuggaaccgugauggacaucauuucuagaaaagaucagaggggcuccggccaagucgggacauacggauugaacacguucaccaauauggaggcgcagcucauccgccagauggaaggugagggcgugcugucaaaggccgaccuagaaaacccacaccuucccgagaaaaagauaacucaguggcuggagacaaaagggguggaacgucucaagcggauggcuauuagcggagaugacugcgucguuaagccuaucgaugacagauuugccaacgcacuguuggcuuuaaaugauaugggcaaagugaggaaggacaucccacaauggcagccgucgaaagguuggcaugauuggcagcagguacccuucuguucucaccauuuccacgagcugauuaugaaggacgggcgcaaacucguggucccuugccgaccacaagacgaacuuauaggacgggccagaaucagucagggcgcaggcuggucccugagggagaccgccugucuagggaaggcguaugcucagauguggagccugauguacuuucaccgcagagaucuccgguuggccucaaacgcaauuugcuccgccgugcccguucauugggugccuacuucuaggacaaccuggagcauccacgcucaucaccaauggaugacgacagaagacaugcugaccgucuggaaucguguguggauugaggauaacccauggauggaggacaagacucccguaaccacaugggaaaauguuccuuaccuuggaaaacgagaggaucaguggugugguagucugaucggccucacuucccgcgccaccugggcacagaacauaccgacagcuauccagcaagugaggagcuuaauugggaaugaagaguuccuggacuauaugccaucuaugaagcgguuuaggaaagaggaagagucagaaggagccaucugguga

SEQ ID NO: 15486 - RNA, 9873 nt, Artificial Sequence
  derived and/or modified CDS sequence (opt3) from DENV-3__KF955454__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaggcgauaugaucauuccaaaaagccuggcggggccgaucucccagcacaacuauaggcccggauaccauacacaaacugccggcccuuggcaccuugggaaguuggagcuggacuuuaauuauugcgagggaaccacaguggugauuacggaaaacuguggcacccgugguccaucauuacggacuacaaccgucagugggaaacucauccacgaguggugcugucgaucuugcacucugcccccucuuagauacaugggagaagauggcuguugguaugguauggagauaaggccaauuagcgaaaaggaggagaauaugguuaaaucccuggugucagcuggcagcggggaaguagacaacuucacaaugggaguguugugccucgccauccuguuugaggaagucaugcgcggcaaguucgggaagaaacauaugaucgcaggaguguucuuuaccuucguucuacugcucucuggccagauuacguggcgggauauggcucacacucugaucaugauugguuccaaugccagugacagaauggggaugggagugaccuaccuugcauugauagccacauuuaagauccagcccuuccuggcuuuaggcuuuuuccucaggaaacugaccagccgcgagaaccuucugcuaggcgucgggcucgcgauggccacuacacugcaauugccggaagauauugagcagauggcaaauggaaucgcucuggguuuaauggcccucaagcugauuacccaguuugagacauaucagcuuuggacugcccugaucucuuugaccuguuccaacacgauauucacacucaccguggcuuggcgaacugcaacccugauccuagccggcguuucacugcuuccugugugccaaaguagcucgaugcggaaaacagacuggcucccaaugacugucgcggcuauggggguacccccucugcccuuguuuauuuucucccugaaggauaccuuaaagcguagaucuuggccacucaaugaaggagugauggccguuggccuggugagcauccuugcaucaagucuguugaggaacgacgucccuauggccgguccccucguggcugggggacugcuaauugcauguuacguaaucacgggcacauccgccgaucugaccguggagaaagcggcugacgucacuugggaagaggaagccgagcagacaggcguuucucauaaccuuaugauaaccguggacgaugacgggacuaugcgcauuaaggaugacgagacagaaaauauccucaccgugcuguugaaaacggcauuacugaucgucagcggaauuuuuccauacuccauaccggccacucuccugguguggcacaccuggcagaagcagacacaacggucagguguucuuugggauguaccuagccccccagagacccagaaagcugaacuggaggagggcguguauagaaucaagcagcaggggauuuucggaaaaacacaagucggcguggguguucagaaggaagggguguuucauacuauguggcacgucaccaggggagccguguugacguacaacggcaagcgacuagagcccaauugggcaaguguaaaaaaggaccugaucucuuauggcgggggauggcgccucuccgcucaguggcaaaaaggugaagagguccaggugauugccguugaaccuggcaagaacccaaaaaauuuccagacaaugcccgggacuuuccagaccacaaccggagagaucggcgcgauagcccuggauuuuaagccugguacuagcgggucgccgaucauuaaccgggagggaaagguggucggccuuuacggcaauggggugguuaccaaaaacggagguuaugugucaggcaucgcacaaacaaaugcugaaccagacgggcccacgccugaguuagaagaggaaauguucaagaaaagaaaccugacuauuauggaucuccacccaggaucuggcaagaccaggaaauacuugcccgccaucguccgugaggcuauaaagcgccggcugagaacacucauucuggcaccuaccagggugguagccgccgagauggaagaggcucuuaagggucugccgauccgauaucagacuacagcgaccaaaagugaacauacggggcgggagaucguggacuugaugugccacgcaacuuuuacaaugcgccuacugucccccguuagagucccaaauuacaaccucauuaucauggaugaagcccauuucaccgacccugcuagcauagccgcaaggggauacauuucuacccgggugggcaugggcgaggccgcugcgaucuuuaugacugccacacccccagggaccgcagaugcuuucccucagagcaaugcccccauucaggacgaggaacgagacaucccagagagauccuggaacucaggaaaugaauggauaacagauuuugcagguaagacugugugguucgucccgaguauuaaagccggcaacgacaucgcuaacuguuuacgcaagaaugggaaaaagguaauccaacugagcaggaagacguuugauaccgaguaucagaaaacaaagcuuaacgacugggauuucgugguuacuaccgacauuucugagaugggagccaauuuuaaagcggaucgugugaucgacccucggagaugccugaagcccgucauucucacagauggcccagaaagggugauauuggcaggucccaugccuguuaccgccgcuuccgccgcucagcgccgagggagagugggccggaacccacagaaagagaaugaccaauacaucuucacuggacagccccugaacaaugaugaagaccacgcacauuggacggaggccaagaugcuccuggacaacauuaauaccccugaaggcaucaucccggcucuuuucgagccagagagggaaaagucagccgcaauugauggggaguaucgccuaaaaggagaaagucguaagacauuucuggaguugaugagacggggugacuuacccgucuggcuggcguacaaaguggccagcgaaggcauaaaguauacugauaggaaauggugcuucgacgggcagcgcaacaaucagauccucgaggagaacauggauguagaaauuuggaccaaggagggagaaaaaaagaagcugcgaccuagauggcuugacgcucggacauacuccgauccccuggcccucaaagaguuuaaggacuucgcagcuggcaggaaaucuaucgccuuggaucuggugaccgaaauuggucgcguuccaacucaccuagcacacagaacaaggaaugcccuggacaaccucgucaugcuucauacgucggagcacgggggcaaggcuuaucggcaugcgguggaggaacugccugagaccauggaaacuuuauugcugcucggacugaugauccuucugacaggcggggccaugcucuuuuugauaagcggaaaagguaucggcaagaccucaauugggcugaucugugugauugcauccaguggaauguuauggauggcugagaucccccuacaauggauagccucugccauuguccuggaguucuuuaugaugguucuccuuaucccagaaccugagaagcagcguaccccgcaggauaaucaacuggcauacgugguaauuggcaucuugacacuggcugccauaaucgcggcuaacgaaaugggucuccuggagacuacgaaacgcgaccuugggaugagcaaggaacccggcguggucuccccaaccucauaccucgauguggaccugcacccugccucugcauggacauuguaugccguugcuacuaccgugauuacacccaugcugcgacacaccaucgagaauagcacugcaaacgucaguuuagccgcgauugcuaaccaggccguagugcuaaugggacuggacaaaggcuggccaaucuccaagauggaucucgggguuccucuucuggcauugggaugcuacagccaggugaauccccugacgcucacagccgcuguccugcuuuuaauaacccauuaugccauuaucggcccgggucugcaggcaaaagcuacuagagaggcccaaaagaggaccgcggccgggaucaugaagaacccaacaguggacggaauuaugacuaucgaucucgacccugucauauacgauucuaaauucgaaaagcaguugggccaggugaugcugcuaguucugugugcagugcagcuccuucugaugcggaccucaugggcuuugugcgaggcccugacacucgcaacgggucccauuaccacucugugggaaggcuccccagggaaauuuuggaauacaaccaucgcuguaaguauggccaacauuuuccgcggaagcuauuuagccggcgcggggcuugcuuuuucgaucaugaagucugugggaacuggcaaaagagguacagggucccaaggagagacccugggcgaaaaguggaagaaaaagcucaaucagcuaagcaggaaagaguucgaccuguacaagaaaucagguauaacggaggucgaucgggcagaagccaaggagggcuugaaacgaggggaaaucacccaccaugcuguuaguagaggaucugccaagcugcagugguuuguggagcgcaacauggucauucccgaaggcagggugaucgaccucggguguggacggggcgguugguccuauuacugcgcagggcuuaagaaaguaacagaggugcguggauacacuaagggcggcccugggcacgaggaaccgguucccaugagcaccuauggauggaauauugugaaacugaugucagguaaggaugucuucuacuugccaccugagaaaugugacacacugcucugcgauaucggcgaaaguagccccuccccuacuguggaggagucuagaaccauuagggucuuaaagaugguggaaccauggcugaagaacaaucaguucuguaucaaaguucuuaaccccuauaugccuacaguaauagagcaucuggaacgccuacaacggaagcacgggggaaugcucgugcgaaauccacugagcagaaacuccacccacgagauguacuggauuucaaauggcacugguaacaucgucgccucugugaauaugguuaguagguugcugcucaaccgcuuuacgaugacacaucggagacccaccaucgaaaaagacguggaucuuggggcuggaacucgucacgucaacgcggagccggagaccccuaauauggacgugauuggcgaaaggauaaagcggaucaaagaggaacauaacucgacauggcacuaugacgaugagaauccauacaagacgugggccuaucacggcagcuacgaaguaaaggcaaccggguccgcuucuucaaugauuaacggagugguuaaacuguuaacuaagcccugggacgucgugccuauggugacacagauggccaugaccgauacuacaccauucggucagcaacgcgucuuuaaagagaagguugacacccgaacacccagaagcaugccgggcacuaggcgggugauggggaucaccgcagaguggcuguggcgcacguugggaagaaauaaaaagccuaggcucugcacccgagaagaguucacaaagaaaguacggacuaacgccgcuaugggcgccguguuuaccgaagagaaucagugggauuccgcgaaggcagccgucgaagacgaggauuucuggaaacugguggaccgugagagagaacuacauaagcuugguaaaugugggaguugcguuuacaacaugaugggaaagcgcgagaaaaagcugggcgaauuuggcaaggcuaaagggucuagggccauuugguauauguggcucggagcacgguaccuggaguucgaggcuuuggguuuucugaaugaagaucacugguucagcagagagaacucauauuccggcguggaaggggagggacuccauaagcuuggcuacauccugcgcgacauaaguaaaauccccgguggggccauguaugcugaugacacagccggaugggacacuaggauuaccgaagaugacuuacacaaugaggagaagaucacgcagcagauggauccagaacaucgacaacuggcaaacgcgauuuuuaaauugacauaccagaauaaggucgugaagguacagcggccuacccccacuggcacaguuauggacaucauaagcagaaaagaucagaggggcucugggcaagugggaaccuauggucucaacacuuucaccaauauggaggcccagcugauucgccagauggaaggcgaggggguccuauccaaggcugaccuugaaaacccacaccccccugagaaaaagaucacacaguggcuggagacgaaaggaguggaacgucucaagcggauggccaucucaggcgaugacugcguggucaagccaauugaugacagauuugcaaacgcucuguuggccuuaaaugauauggguaaaguuaggaaggacauaccgcaauggcagcccagcaaaggguggcacgauuggcagcaggugccuuucuguucgcaucacuuccaugagcugaucaugaaggacggacgcaaacucguagugccaugccgaccccaagacgaacuuauuggccgggcaagaaucucucagggcgccggguggagucugagggagaccgcgugucuaggaaaggcuuacgcccagauguggucccugauguacuuucaccgcagagaucuccgguuggcaagcaacgccauuugcucagcugucccugugcacuggguuccaacuuccaggacaaccuggucuauccaugcccaccaucaauggaugacuacagaagacaugcugaccguguggaaucgugucuggauagaggauaaccccuggauggaggacaagacgccugugacaaccugggaaaauguaccguaucuugguaaacgagaggaucagugguguggcagccugaucgggcucacuagucgcgcaaccugggcucagaacauuccaacagccauccagcaaguuagauccuuaauuggaaaugaagaguuccuggacuacaugcccagcaugaagcgguuuaggaaagaggaagagucugaaggcgcgaucugguga

SEQ ID NO: 15487 - RNA, 9873 nt, Artificial Sequence
  derived and/or modified CDS sequence (opt3) from DENV-3__EU854292__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcauugggaacagagacuuuguagaaggauugucaggugccaccuggguugaugugguccuggagcacggcgggugcgugacgacuauggcgaagaauaaacccacacuagacaucgagcuccagaagaccgaagcaacucaacuggccacacuuaggaaacuguguauugagggaaagaucaccaacauaacgaccgauagccggugcccuacacagggcgaagcugccuugccagaggaacaggaccagaauuauguguguaaacacacuuacgucgaucgcgguugggggaacggaugcggccucuucggcaaggggagucugguuaccugcgcaaaguuucaauguuuagagcccauugagggaaaagugguacagcaugaaaaucugaaguauacagugaucauuacuguccacaccggugaccagcaucaggugggcaacgagacacaagggguuaccgcugaaaucacuccucaggccuccacgacagaggcgauccucccagaauacggaacccuuggccuggagugcucuccgcgaacugguuuggacuucaaugagaugauucuacugaccaugaaaaacaaggccuggauggugcacagacagugguuuuucgaucucccccugccuuggacaagcggggcaaccacugaaacaccaacguggaauaggaaagagcuucuggucaccuuuaagaacgcucacgccaaaaagcaagaagugguaguuuugggcucccaggagggagcuaugcauacugcccucacaggcgcaaccgaaauacagaauucagggggaacaaguaucuucgccggucaccugaagugucgguuaaaaauggacaagcuggagcuaaaaggcaugagcuaugcuaugugcacuaacaccuuugugcucaagaaagaggucucugaaacgcagcaugggaccauucugaucaagguggaguacaagggagaagaugcgcccuguaaaauaccuuucuccacagaggacggccaagguaaggcacacaacgggcgucuuauuacugccaauccagucgugaccaaaaaggaggaacccguuaacaucgaggcugaaccgccuuucggcgagucaaauaucgugauuggaaucggcgauaacgccuugaaaauuaauugguacaagaaggggagcaguauaggaaaaauguuugaagcaacagcccgcggugcuagaaggauggccauccugggcgacacugcaugggauuucgggucuguaggaggcguccucaacucccuggguaagauggugcaucagauuuuugggagcgcguauaccgcucuuuucucgggcguuucuugggugaugaaaaucggaaucggcguccuguugacguggauugggcucaauuccaagaacacaucaaugaguuuuagcugcauagccaucggaauuaucacccuguacuuaggcgcagugguacaggccgacauggguugugugauuaauuggaaagggaaggagcugaagugcggauccggcaucuucguuacuaacgagguccacacauggaccgaacaguauaaauuucaagcugauucucccaagcggcuagccacugcaauagcuggugccugggagaauggcgugugugggauccgaagcaccacacgcauggaaaaccuccuguggaaacagauugcgaaugagcuuaacuacaucuugugggaaaauaacauuaagcugacgguggucguuggagacaucauaggcgugcucgagcaggggaaaagaacccugacuccacagccuauggaguuaaaguauucauggaaaacauggggaaaggccaagauugugaccgcugaaacacaaaacaguuccuucaucauugauggccccaauacuccagagugccccagcgcagccagggcuuggaacguaugggaagucgaggacuacgguuuugggguguucaccacgaauaucuggcugaaacuucgggaaguuuauacacaguugugugaccaccgccucaugucugccgcagugaaggaugagagagcgguccaugccgacaugggauacuggauagagucacagaaaaacggcaguuggaagcuggaaaaagcuagccuaaucgaggugaagaccugcacuuggccuaagucccacacccuguggucuaaugguguucucgaaucggauaugauuaucccaaaaagccuggccggcccgauuucccagcauaaccacaggcccggguaccacacacaaacugcaggaccuuggcaucuuggcaaguuggagcuggacuuuaauuauugcgaggggaccacagugguaaucacggaaaacuguggaacccguggcccaucauuacggacuacaaccgucagugguaaacucauacacgaguggugcugucgaucuugcacucugcccccucuuagauacaugggggaagauggauguugguauggcauggagauuaggccaaucagcgaaaaggaggagaauauggugaaaucccuggugucagcugguagcggcaaggucgacaacuucacaauggggguuuugugccucgccauccuguuugaagaggugaugcgcggaaaguucggcaaaaagcauaugauugcagggguauucuuuaccuucgugcuacugcucucuggacagaucacguggcgggauauggcccacacucugauuaugauaggcuccaaugcuagugacagaauggguaugggggucaccuaccuugcguugaucgccacauuuaaaauucagcccuuccuggcauuaggauuuuuccucaggaagcugaccagccgcgaaaaccuucugcuaggcgugggccucgcuauggccacuacacugcaauugccggaggauaucgaacagauggccaaugggauugcucugggauuaauggcacucaaacugaucacccaguuugagacauaucagcuuuggacugcccugauaucuuugaccuguuccaacacgaucuucacacucaccguugcguggcgaacugcuacccugauucuagccggugugucacugcuuccugucugccaaaguagcucgaugcggaagacagacuggcucccaauggcaguggccgcuaugggcguucccccucugcccuuguuuaucuucugucugaaggauacuuuaaaacguagauccuggccacucaaugagggggugauggcagucggacugguaucuauucuugccagcucacuguugaggaacgacgugccuauggcgggcccccucguugcuggugggcugcuaaucgccugcuacgugauaaccggaacgagugcagaucugacagucgaaaaggccgcugacauuaccugggaggaagaggccgaacagacuggcgugucccauaaccuuaugaucacaguagacgaugacggcaccaugcgcaucaaagaugacgagacugagaauauucucacagugcuguugaagaccgcauuacugauagucucugggaucuuuccauauagcauuccggcuacgcuccugguuuggcacacuuggcagaaacagacccaacgguccggagugcuuugggaugugccuucacccccagaaacacagaaggccgagcuggaagagggugucuacagaaucaaacagcagggcauuuucgggaagacccaagugggaguuggcguacagaaggaggguguguuucacacaauguggcaugucacuaggggggcgguguugaccuacaacggaaaacgacuagaacccaauugggccagcguuaagaaagaccugaucaguuauggcggcggguggcgccucucugcacaguggcaaaagggagaggaagugcaggucauagcuguggagccugguaaaaacccaaagaauuuccagacgaugcccggcacauuccagacuaccacaggggaaaucggagccauugcucuggauuuuaagccuggcaccuccgguagcccgaucauuaaccgggaggggaaaguagucggacuuuacggcaauggcgugguuacuaagaacgggggauaugugucggguaucgcacaaaccaaugccgagccagacggccccacaccugaauuagaggaagagauguucaaaaagagaaaccugacgauaauggaucuccacccagggucaggaaaaacuaggaaguacuugcccgccauuguccgugaagcuaucaagcgccggcugagaacccucauccuggcgccuacaagggugguugcagccgagauggaggaagcucuuaaaggccugccgauucgauaucagaccacugccacaaagucugagcauaccggucgggaaaucguggacuugaugugucacgcaacguuuacuaugcgccuacugagucccgucagagugccaaauuacaaccucauaauuauggaugaggcccauuucacagacccugcuuccaucgcggccaggggguauauuagcacccggguaggaaugggcgaagcagcugccaucuuuaugaccgcaacucccccaggcacagccgaugcuuucccucagucuaaugcccccauacaggacgaggagcgagacauuccagaaagaagcuggaacuccgggaaugaguggaucaccgauuuugcgggaaaaacagugugguucguuccgucaaucaaggcagguaacgacauugccaacugcuuacgcaaaaauggcaagaaggucauccaacugaguaggaaaacuuuugauacggaauaccagaagaccaaacuuaacgacugggauuucguggugacaacugacauuagcgagaugggggcuaauuuuaaggccgaucgugucauagacccucggagaugccugaaacccguaauccucaccgauggaccagagagggugauuuuggcuggccccaugccuguuacagcagccucugcugcccagcgccgagguagaguggggcggaacccacacaaggaaaaugaccaguacaucuucaccggccaaccccugaacaaugaugaggaccacgcacauuggacugaagcgaagaugcuccuggacaacaucaauacgccugagggaauuauaccggcccuuuucgaaccagagagggagaaauccgcugccaucgauggcgaauaucgccuaaagggggagucacguaaaaccuuugucgaacugaugagacggggagacuugcccgugugguuagcacacaagguugcuagugaggguauuaaauacacagauaggaagugguguuucgacggccagcgcaacaaucagauccuggaagagaacauggauguggagauuuggacuaaagaaggggagaagaagaaacuccgaccuagauggcuggacgcccggaccuauagcgauccccuugcacugaaggaauuuaaagacuucgccgcuggaaggaaguccaucgcgcucgauuuggucacagagauaggccgcgugccaucucaucuggcccacagaaccaggaaugcacuagacaaccugguaaugcuccacacuucggaacauggugggcgggcuuaccgucacgccguggaggagcuuccugaaacaauggagacgcuguuauugcugggccucaugauccugcuuaccggaggcgccaugcuguuucucauuagcgggaaaggaaucgguaagacuucaauuggcuugaucugcguuauagcauccagugggaugcuguggauggcugaaauucccuuacaguggaucgccucugcgauuguccuagaguucuuuaugauggugcugcucaucccagagccugaaaagcaacgcacaccgcaggauaaucagcuugcuuauguggucauaggaauccugaccuuggccgcaauuaucgccgcuaacgagaugggccugcucgaaaccacaaaacgagaccuggguaugagcaaggagcccgggguuguguccccaacuucauaccuugauguagaccuccauccugcaucugccuggacgcuguaugcgguggcuaccacagucauuacucccauguugagacacaccaucgaaaauagcacagccaacgugagucuggcagccauagcuaaccaagccguuguguuaaugggccuagacaaaggauggccaauuuccaagauggaucugggcgucccucuccuugcacugggguguuacagccagguaaaucccuugacccugacugcugccgugcuccugcuuaucacgcauuacgcgaucauuggaccgggcuuacaggccaaagcaacaagggaggcucagaagcggaccgccgcagguaucaugaagaacccaacuguugacgggauaaugaccauugaucuggacccugugaucuaugauucuaaauucgagaagcaacucggacaggucauguugcuggugcuaugcgcuguccagcugcuccuuaugcgcacaucaugggcccugugugaagccuugacucuggcgaccggccccauuacaacgcucugggaggguuccccaggcaaauuuuggaauaccacuaucgcugugaguauggcaaacauauucagagggagcuaccuggccggagcuggcuuagccuuuucgaucaugaagucuguugggacaggaaaaaggggcaccgguucccagggggaaacucuuggagagaaguggaagaaaaagcugaaucaacucagccggaaagaauucgaccuauauaagaaaucaggcauuacagagguggaucgaaccgaggcaaaggaaggucugaaaagaggcgagaucacgcaccacgccguaagucgcgggucugcuaaguugcagugguuuguggaaaggaacauggucauucccgagggacggguuaucgaccugggcugcgggcguggaggcugguccuacuauugugcgggucucaagaaagugaccgaagucagaggguacacaaagggaggcccuggccaugaggagccggugcccaugagcacuuauggguggaauauuguaaaacuuaugucaggaaaggauguguucuaccugccaccugaaaaaugcgacaccuugcugugugauaucggugagaguagccccuccccuacaguugaagagucuaggacuauacgcgugcucaagauggucgagccaugguuaaagaacaaucaguucugcauuaaagugcugaaccccuacaugccuaccgucaucgaacaccuugagcggcugcagcgaaagcauggcgggaugcuagugagaaauccacucagcaggaacuccacacacgaaauguauuggaucucaaauggaaccggcaacauuguugccucuguaaauauggugagucgccuguugcugaaccgguuuacuaugacgcacagacgucccacaauagagaaagacgucgaucucggugcagggaccaggcaugugaacgcugaaccggagacuccuaauauggacguuaucggagagcggauuaagcgcaucaaagaagagcacaacucgaccuggcauuacgacgaugaaaauccauauaagacaugggccuaccacggcagcuaugaggugaaggcaacgggcuccgccucuucaaugauuaacggggucgugaaacuucugaccaagcccugggacguagugccuaugguuacucaaauggcuaugacagauaccacuccauucggacagcagcgagucuuuaaagaaaagguggacacaagaacccccaggagcaugccggguacacggcgcgugaugggcaucacugccgagugguuauggagaacccuggggaggaauaaaaagccucgauuguguacgcgggaggaauucaccaagaaaguccguacaaacgcggcaaugggagccguuuuuacugaggaaaaucaaugggauuccgcuaaggccgcaguggaggacgaagauuucuggaaacucguagacagagagcgcgagcugcauaagcuaggcaaaugcgguaguugcguguacaacaugauggggaagagggaaaaaaagcuuggagaguuuggcaaggcuaaaggcucucgggccauaugguauauguggcugggggcuagauaccucgaauucgaggcccugggauuuuugaaugaggaucacugguucagccgcgaaaacucauacuccggugucgagggcgaagggcugcacaagcucggauauauccuuagggacauuaguaaaauccccggcggugcaauguacgcggaugacaccgccgggugggacacacgaauuacugaggaugaccugcauaaugaagagaagaucacccagcagauggauccagagcaccggcaguuagcuaacgccauauuuaaacugacguaucaaaauaaggugguuaaggugcagagaccuacacccaccggaacugucauggacauuaucagcaggaaagaucagcgcggcucuggccagguggggacauacggauugaacaccuucacuaauauggaagcacaacucauccgucagauggagggugaaggcguacuguccaaggcugaccuagagaacccacaucuucccgaaaaaaagauuacccaguggcuggagacaaaagggguugagcggcucaagagaauggccauaucaggagaugacuguguggucaagccuaucgaugacagguuugcaaacgcccuguuggcguuaaaugauaugggcaaagugcgcaaggacauuccacaguggcaaccgagcaaagguuggcacgauuggcagcaggugcccuucugcucgcaccauuuccacgaacugaucaugaaggacgggcgaaaacucgucguuccuugucggccacaggacgagcuuauuggaagagcuaggaucucucaaggcgccggcuggagucugaaggaaacggcaugccuagggaaggccuaugcucagauguggucccugauguacuuucaucgcagagaucuccgguuggccagcaacgcaauauguucagcugugcccguacacugggugccuaccuccaggacuacauggucuauccaugcccaccaccaguggaugaccacugaggacaugcugacagucuggaaucguguguggauugaagauaacccauggauggaggacaaaacccccguuacgacaugggagaaugugccuuaucuuggaaagcgagaagaucaauggugcgguagccugaucggccucaccagucgcgcgacuugggcucagaacauuccgaccgccauccagcaggucagauccuuaauugggaaugaggaauuccuggacuacaugccaagcaugaaacgguuuaggaaggaggaggaaucugagggagcaauaugguga

SEQ ID NO: 15488 - RNA, 9873 nt, Artificial Sequence
  derived and/or modified CDS sequence (opt3) from DENV-3__FJ639746__SS-prME
accagccugugccucaugaugauccuuccagccgcucuggcauuccacuugacuuccagagacggcgaaccuaggaugauuguggggaagaacgaacggggaaaaucuuuacuguuuaagacugccucagguauaaauauguguacgcuaaucgcgauggaucucggcgagaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucucucugaaggauaccuuaaagcguagaagcuggccacucaaugaaggggugauggccguuggacuggugucaauccuugcaaguucccuguugaggaacgacgucccuauggccggcccccucguggcuggugggcugcuaauugcauguuacguaaucacgggaacaucugccgaucugaccguggagaaagcggcugacgucacuugggaagaggaagccgagcagacaggcguuagccauaaccuuaugauaaccguggacgaugacggcacuaugcgcauuaaggaugacgagacagaaaauauccucaccgugcuguugaaaacggcauuacugaucgucuccgggauuuuuccauacucaauaccggccacucuccugguguggcacaccuggcagaagcagacacaacggagcggaguucuuugggauguaccuagucccccagagacccagaaagcugaacuggaggaggguguguauagaaucaagcagcagggcauuuucgggaaaacacaagucggagugggcguucagaaggaagguguguuucauacuauguggcacgucaccagaggggccguguugacguacaacggaaagcgacuagagcccaauugggcaucugucaagaaggaccugaucuccuauggcggcggguggcgccucagcgcucaguggcaaaaaggagaagagguccaggugauugccguugaaccugguaagaaccccaagaauuuccagacaaugcccggcacuuuccagaccacaaccggggagaucggagcgauagcccuggauuuuaagccuggcacuucggguucaccgaucauuaaccgggaggggaagguggucggacuuuacggcaauggcgugguuaccaaaaacgggggauaugugucugguaucgcacaaacaaaugcugaaccagacggccccacgccugaguuagaagaggaaauguucaagaaaagaaaccugacuauuauggaucuccacccagggaguggaaagaccaggaaauacuugcccgccaucguccgugaggcuauaaagcgccggcugagaacacucauucuggcaccuaccagggugguagccgccgagauggaagaggcucuuaagggccugccgauccgauaucagacuacagcgaccaaauccgaacauacgggucgggagaucguggacuugaugugccacgcaacuuuuacaaugcgccuacugagccccguuagagucccaaauuacaaccucauuaucauggaugaagcccauuucaccgacccugcuucuauagccgcaaggggguacauuagcacccgggugggaaugggcgaggccgcugcgaucuuuaugacugccacacccccaggcaccgcagaugcuuucccucaguccaaugcccccauucaggacgaggaacgagacaucccagagagaucauggaacagugggaaugaauggauaacagauuuugcaggaaagacugugugguucgucccgagcauuaaagccgguaacgacaucgcuaacuguuuacgcaagaauggcaaaaagguaauccaacugucuaggaagacguuugauaccgaguaucagaaaacaaaacuuaacgacugggauuucgugguuacuaccgacauuuccgagaugggggccaauuuuaaagcggaucgugugaucgacccucggagaugccugaagcccgucauucucacagauggaccagaaagggugauauuggcaggccccaugccuguuaccgccgcuucagccgcucagcgccgagguagaguggggcggaacccacagaaagagaaugaccaauacaucuucacuggccagccccugaacaaugaugaagaccacgcacauuggacggaggccaagaugcuccuggacaacauuaauaccccugaaggaaucaucccggcucuuuucgagccagagagggaaaagagugccgcaauugauggcgaguaucgccuaaaaggggaaagccguaagacauuugucgagcugaugagacggggagacuugcccgugugguuagcgcacaaaguagccuccgaagguauaaaguacacugauaggaaauggugcuucgacggccagcgcaacaaucagauccuggaggagaacauggauguggaaauuuggaccaaggagggggagaagaagaagcuccgaccuagauggcuggacgcucggacauauucugauccccuugcccugaaagaguuuaaggacuucgcagcuggaaggaaaucgaucgcccucgauuugguuaccgaaauuggccgcgucccaagccaccuggcacauagaacuaggaaugcccuagacaaccuggugaugcuccacacaucagagcauggugggaaggcuuaccggcacgcgguggaggaacuuccugagacgauggaaacccuguuauugcugggccucaugauccugcuuacuggaggcgccaugcuguuucucauauccgggaaaggaaucgguaagacaaguauuggcuugaucugugucauugcaucuagcgggaugcuguggauggcugagauccccuuacaauggauagccuccgccauuguucuagaguucuuuaugauggugcugcucaucccagaaccugagaagcagcguaccccgcaggauaaucaacuugcauauguagugauuggaauccugaccuuggcugccauaaucgcggcuaacgaaaugggccugcucgagacaacuaaacgcgaccuggguaugucaaaggaacccggggucgugucuccaacgagcuaccuugauguugaccuccacccugccagugcauggacccuguacgccguggcuacaacugucauuacccccauguugcgacauacaaucgaaaauuccaccgcaaacguaagccuggccgcgauugcuaaccaggccgugguuuuaaugggccuagacaaaggauggccaaucucuaagauggaucugggcgugccucuccuugcacuggggugcuauucacaggucaaucccuugacucugacggccgcugugcuccugcuuauaacacacuacgccauuaucggaccgggcuuacaggcaaaagcuaccagagaggcccaaaagaggacugcggccgguaucaugaagaacccaaccgucgacgggauuaugacaaucgaucuggacccugugauauaugauuccaaauucgagaagcagcucggacagguuauguugcuggugcuaugugcaguacagcugcuccuuaugcggacaaguugggcucugugcgaggccuugacccuggcaacaggccccauuacgacccucugggaagguagcccaggcaaauuuuggaauacuacaaucgcugugucgauggccaacauuuuccgcgggucuuaccuggccggagcgggcuuagcuuuuuccaucaugaaaagcgucgggaccggaaaaagaggcacugguucacaaggggagacacuuggagaaaaguggaagaaaaagcugaaucagcucaguaggaaagaguucgaccuauauaagaaaucuggcauaaccgagguugaucggacggaagcaaaggagggucugaaacgaggcgaaaucacccaucacgccguguccagagggagcgcuaaguugcagugguuugucgagcgcaacauggugauucccgaaggaaggguaaucgaccugggcugugggcggggaggcuggucauacuauugcgccggucucaagaaagugacagagguucguggguacacuaagggaggcccuggccaugaggaaccggugcccaugaguaccuacggguggaauauugucaaacuuaugagcggaaaggauguguucuaucugccaccugagaaaugugacacauugcugugcgauaucggugaauccucucccagcccuacugucgaggaguccagaaccauuagggugcucaagaugguugaaccaugguuaaagaacaaucaguucuguaucaaaguacugaaccccuacaugccuacaguggucgagcaccuugaacgccugcaacggaagcacggcgggaugcuagugcgaaauccacucucaagaaacucuacccaugagauguauuggauaaguaauggaacuggcaacauuguugcaucggugaauauggucagcaggcuguugcugaaccgcuuuacgaugacacaccggagacccaccaucgaaaaagacguggaucucggugccgggacucgucauguaaacgcugagccggagaccccuaauauggacgugaucggagaaaggauuaagcggauaaaagaggaacacaacuccacauggcacuacgacgaugagaauccauauaagacgugggcguaccauggcucuuaugaaguuaaggccaccggcucagcaagcuccaugaucaacggggucgugaaacuucugacuaagcccugggacguggucccuaugguuacacagauggcuaugaccgauacuacaccauucggacagcaacgcguguuuaaagagaagguagacacccgaacacccagaaguaugccggguacuaggcgggugaugggcauuaccgccgagugguuauggcgcacgcuggggagaaauaaaaagccuagguugugcacccgagaagaguucacaaagaaaguccggacuaacgcagccaugggagcuguguuuaccgaagagaaucagugggauucugccaaggcggcaguugaagacgaggauuucuggaaacucguggaccgugagagagaacugcacaagcuaggcaaaugugguagcugcgucuacaacaugauggggaagcgcgagaagaaacuuggagaauuuggcaaagccaaaggcucaagggcuaucugguacauguggcugggggcccgguaucucgaguucgaggcacugggauuuuugaaugaagaucauugguucuccagagagaacaguuacagcgguguggaaggcgaggggcugcacaagcucggauauauucuucgcgacaucucuaaaauacccggcggugcuauguacgccgaugacacagcugggugggacacuaggaucaccgaagaugaccugcauaaugaggagaagauuacgcagcagauggauccagaacaccgacaauuagccaacgcaaucuuuaaacugacauaucagaauaagguaguuaaggugcagcggccuacccccacuggaacagucauggacauuaucuccagaaaagaucagaggggcucaggccaaguggggaccuacggauugaacacuuucaccaauauggaggcgcagcucauacgccagauggaaggugagggcgugcugagcaaggccgaccuagaaaacccacgucuucccgagaaaaagauuacacaguggcuggagacgaaaggggucgaacggcucaagagaauggcuaucucgggagaugacugcguugugaagccuaucgaugacagguuugccaacgcacuguuggcuuuaaaugauaugggcaaaguacgcaaggacauuccacaauggcagccgucuaaagguuggcacgauuggcaacaggugcccuucuguagucaucacuuccaugagcugauaaugaaggacgggcgaaaacucgucgugccuugccggccacaagacgaacuuaucggaagggccaggauuucccagggcgcaggcuggagccugcgcgagaccgccugucuagggaaggcguaugcucagauguggucacugauguacuuucacagacgggaucucagguuggccuccaacgcaaucugcucugccguucccgugcacugggucccuacuagccguacaaccuggaguauucaugcucaccaucaauggaugacuacagaagacaugcugaccguguggaaucgaguauggaucgaggauaacccauggauggaggacaagacgcccauaacaaccugggaaaauguuccuuaccuuggaaaacgcgaggaucaguggugugguucccugaucggccucacuagcagagccaccugggcacagaacauuccgacagcuauccagcaagugcggucuuuaauugggaaugaagaguuccuggacuauaugccaucaaugaagagguuucgcaaagaggaagagagugaaggagccaucugguga

SEQ ID NO: 15489 - RNA, 9873 nt, Artificial Sequence
  derived and/or modified CDS sequence (opt3) from DENV-3__FJ639750__SS-prME
accagccugugccucaugaugauccuuccagccgcucuggcauuccacuugacuuccagggacggcgaaccuaggaugauuguggggaagaacgaacggggaaaaucuuuacuguuuaagacugccucagguauaaauauguguacgcuaaucgcgauggaucucggcgagaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucucucugaaggauaccuuaaagcguagaagcuggccacucaaugaaggggugauggccguuggacuggugucaauccuugcaaguucccuguugaggaacgacgucccuauggccggcccccucguggcuggugggcugcuaauugcauguuacguaaucacgggaacaucugccgaucugaccguggagaaagcggcugacgucacuugggaagaggaagccgagcagacaggcguuagccauaaccuuaugauaaccguggacgaugacggcacuaugcgcauuaaggaugacgagacagaaaauauccucaccgugcuguugaaaacggcauuacugaucgucuccgggauuuuuccauacucaauaccggccacucuccugguguggcacaccuggcagaagcagacacaacggagcggaguucuuugggauguaccuagucccccagagacccagaaagcugaacuggaggaggguguguauagaaucaagcagcagggcauuuucgggaaaacacaagucggagugggcguucagaaggaagguguguuucauacuauguggcacgucaccagaggggccguguugacguacaacggaaagcgacuagagcccaauugggcaucugucaagaaggaccugaucuccuauggcggcggguggcgccucagcgcucaguggcaaaaaggagaagagguccaggugauugccguugaaccugguaagaaccccaagaauuuccagacaaugcccggcacuuuccagaccacaaccggggagaucggagcgauagcccuggauuuuaagccuggcacuucggguucaccgaucauuaaccgggaggggaagguggucggacuuuacggcaauggcgugguuaccaaaaacgggggauaugugucugguaucgcacaaacaaaugcugaaccagacggccccacgccugaguuagaagaggaaauguucaagaaaagaaaccugacuauuauggaucuccacccagggaguggaaagaccaggaaauacuugcccgccaucguccgugaggcuauaaagcgccggcugagaacacucauucuggcaccuaccagggugguagccgccgagauggaagaggcucuuaagggccugccgauccgauaucagacuacagcgaccaaauccgaacauacgggucgggagaucguggacuugaugugccacgcaacuuuuacaaugcgccuacugagccccguuagagucccaaauuacaaccucauuaucauggaugaagcccauuucaccgacccugcuucuauagccgcaaggggguacauuagcacccgggugggaaugggcgaggccgcugcgaucuuuaugacugccacacccccaggcaccgcagaugcuuucccucaguccaaugcccccauucaggacgaggaacgagacaucccagagagaucauggaacagugggaaugaauggauaacagauuuugcaggaaagacugugugguucgucccgagcauuaaagccgguaacgacaucgcuaacuguuuacgcaagaauggcaaaaagguaauccaacugucuaggaagacguuugauaccgaguaucagaaaacaaaacuuaacgacugggauuucgugguuacuaccgacauuuccgagaugggggccaauuuuaaagcggaucgugugaucgacccucggagaugccugaagcccgucauucucacagauggaccagaaagggugauauuggcaggccccaugccuguuaccgccgcuucagccgcucagcgccgagguagaguggggcggaacccacagaaagagaaugaccaauacaucuucacuggccagccccugaacaaugaugaagaccacgcacauuggacggaggccaagaugcuccuggacaacauuaauaccccugaaggaaucaucccggcucuuuucgagccagagagggaaaagagugccgcaauugauggcgaguaucgccuaaaaggggaaagccguaagacauuugucgagcugaugagacggggagacuugcccgugugguuagcgcacaaaguagccuccgaagguauaaaguacacugauaggaaauggugcuucgacggccagcgcaacaaucagauccuggaggagaacauggauguggaaauuuggaccaaggagggggagaagaagaagcuccgaccuagauggcuggacgcucggacauauucugauccccuugcccugaaagaguuuaaggacuucgcagcuggaaggaaaucgaucgcccucgauuugguuaccgaaauuggccgcgucccaagccaccuggcacauagaacuaggaaugcccuagacaaccuggugaugcuccacacaucagagcauggugggaaggcuuaccggcacgcgguggaggaacuuccugagacgauggaaacccuguuauugcugggccucaugauccugcuuacuggaggcgccaugcuguuucucauauccgggaaaggaaucgguaagacaaguauuggcuugaucugugucauugcaucuagcgggaugcuguggauggcugagauccccuuacaauggauagccuccgccauuguucuagaguucuuuaugauggugcugcucaucccagaaccugagaagcagcguaccccgcaggauaaucaacuugcauauguagugauuggaauccugaccuuggcugccauaaucgcggcuaacgaaaugggccugcucgagacaacuaaacgcgaccuggguaugucaaaggaacccggggucgugucuccaacgagcuaccuugauguugaccuccacccugccagugcauggacccuguacgccguggcuacaacugucauuacccccauguugcgacauacaaucgaaaauuccaccgcaaacguaagccuggccgcgauugcuaaccaggccgugguuuuaaugggccuagacaaaggauggccaaucucuaagauggaucugggcgugccucuccuugcacuggggugcuauucacaggucaaucccuugacucugacggccgcugugcuccugcuuauaacacacuacgccauuaucggaccgggcuuacaggcaaaagcuaccagagaggcccaaaagaggacugcggccgguaucaugaagaacccaaccgucgacgggauuaugacaaucgaucuggacccugugauauaugauuccaaauucgagaagcagcucggacagguuauguugcuggugcuaugugcaguacagcugcuccuuaugcggacaaguugggcucugugcgaggccuugacccuggcaacaggccccauuacgacccucugggaagguagcccaggcaaauuuuggaauacuacaaucgcugugucgauggccaacauuuuccgcgggucuuaccuggccggagcgggcuuagcuuuuuccaucaugaaaagcgucgggaccggaaaaagaggcacugguucacaaggggagacacuuggagaaaaguggaagaaaaagcugaaucagcucaguaggaaagaguucgaccuauauaagaaaucuggcauaaccgagguugaucggacggaagcaaaggagggucugaaacgaggcgaaaucacccaucacgccguguccagagggagcgcuaaguugcagugguuugucgagcgcaacauggugauucccgaaggaaggguaaucgaccugggcugugggcggggaggcuggucauacuauugcgccggucucaagaaagugacagagguucguggguacacuaagggaggcccuggccaugaggaaccggugcccaugaguaccuacggguggaauauugucaaacuuaugagcggaaaggauguguucuaucugccaccugagaaaugugacacauugcugugcgauaucggugaauccucucccagcccuacugucgaggaguccagaaccauuagggugcucaagaugguugaaccaugguuaaagaacaaucaguucuguaucaaaguacugaaccccuacaugccuacagugauagagcaccuugaacgccugcaacggaagcacggcgggaugcuaguccgaaauccacucucaagaaacucuacccaugagauguauuggauuaguaauggaacuggcaacaucguggcaucgguuaauauggugagcaggcuguugcugaaccgcuuuacgaugacacaccggagacccaccaucgaaaaagacgucgaucucggugccgggacucgucaugugaacgcugagccggagaccccuaauauggacguaauuggagaaaggauaaagcggaucaaagaggaacacaacuccacauggcacuacgacgaugagaauccauauaagacgugggcguaccauggcucuuaugaagugaaggccaccggcucagcaagcuccaugauuaacgggguugucaaacuucugacuaagcccugggacguggugccuauggucacacagauggcuaugaccgauacuacaccauucggacagcaacgcguuuuuaaagagaagguggacacccgaacacccagaaguaugccggguacuaggcggguaaugggcaucaccgccgagugguuauggcgcacgcuggggagaaauaaaaagccuagguugugcacccgagaagaguucacaaagaaagugcggacuaacgcagccaugggagcugucuuuaccgaagagaaucagugggauucugccaaggcggcaguggaagacgaggauuucuggaaacucguugaccgugagagagaacugcacaagcuaggcaaaugugguagcugcguguacaacaugauggggaagcgcgagaagaaacuuggagaauuuggcaaagccaaaggcucaagggcuauuugguacauguggcugggggcccgguaucucgaguucgaggcacugggauuuuugaaugaagaucauugguucuccagagagaacaguuacagcggugucgaaggcgaggggcugcacaagcucggauauauccuucgcgacauaucuaaaauccccggcggugcuauguacgccgaugacacagcugggugggacacuaggauuaccgaagaugaccugcauaaugaggagaagaucacgcagcagauggauccagaacaccgacaauuagccaacgcaauuuuuaaacugacauaucagaauaaggugguaaagguucagcggccuacccccacuggaacagugauggacaucauauccagaaaagaucagaggggcucaggccaagucgggaccuacggauugaacacuuucaccaauauggaggcgcagcucauucgccagauggaaggugagggcgugcugagcaaggccgaccuagaaaacccacaccuucccgagaaaaagaucacacaguggcuggagacgaaagggguggaacgucucaagcggauggcuaucucgggagaugacugcgucguuaagccuauugaugacagauuugccaacgcacuguuggcuuuaaaugauaugggcaaagugaggaaggacauaccacaauggcagccgucuaaagguuggcaugauuggcagcagguacccuucuguagucaccauuuccacgagcugaucaugaaggacgggcgcaaacucguggucccuugccgaccacaagacgaacuuauuggacgggccagaaucucccagggcgcaggcuggagccugagggagaccgccugucuagggaaggcguaugcucagauguggucacugauguacuuucaccgcagagaucuccgguuggccuccaacgcaauuugcucugccgugcccguucauugggugccuacuagcaggacaaccuggaguauccacgcucaucaccaauggaugacuacagaagacaugcugaccgucuggaaucguguguggauagaggauaacccauggauggaggacaagacgcccguaacaaccugggaaaauguuccuuaccuuggaaaacgagaggaucaguggugugguucccugaucggccucacuagccgcgccaccugggcacagaacauuccgacagcuauccagcaagugagaucuuuaauugggaaugaagaguuccuggacuauaugccaucaaugaagcgguuuaggaaagaggaagagagugaaggagccaucugguga

SEQ ID NO: 15490 - RNA, 9873 nt, Artificial Sequence
  derived and/or modified CDS sequence (opt3) from DENV-3__FJ639754__SS-prME
accagccugugccucaugaugauccuuccagccgcucuggcauuccacuugacuuccagagacggcgagccuaggaugauuguggggaagaacgaacggggaaaaucuuuacuguuuaagacugccucagguauaaauauguguacgcuaaucgcgauggaucucggcgagaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucucucugaaggauaccuuaaagcguagaagcuggccacucaaugaaggggugauggccguuggacuggugucaauccuugcaaguucccuguugaggaacgacgucccuauggccggcccccucguggcuggugggcugcuaauugcauguuacguaaucacgggaacaucugccgaucugaccguggagaaagcggcugacgucacuugggaagaggaagccgagcagacaggcguuagccauaaccuuaugauaaccguggacgaugacggcacuaugcgcauuaaggaugacgagacagaaaauauccucaccgugcuguugaaaacggcauuacugaucgucuccgggauuuuuccauacucaauaccggccacucuccugguguggcacaccuggcagaagcagacacaacggagcggaguucuuugggauguaccuagucccccagagacccagaaagcugaacuggaggaggguguguauagaaucaagcagcagggcauuuucgggaaaacacaagucggagugggcguucagaaggaagguguguuucauacuauguggcacgucaccagaggggccguguugacguacaacggaaagcgacuagagcccaauugggcaucugucaagaaggaccugaucuccuauggcggcggguggcgccucagcgcucaguggcaaaaaggagaagagguccaggugauugccguugaaccugguaagaaccccaagaauuuccagacaaugcccggcacuuuccagaccacaaccggggagaucggagcgauagcccuggauuuuaagccuggcacuucggguucaccgaucauuaaccgggaggggaagguggucggacuuuacggcaauggcgugguuaccaaaaacgggggauaugugucugguaucgcacaaacaaaugcugaaccagacggccccacgccugaguuagaagaggaaauguucaagaaaagaaaccugacuauuauggaucuccacccagggaguggaaagaccaggaaauacuugcccgccaucguccgugaggcuauaaagcgccggcugagaacacucauucuggcaccuaccagggugguagccgccgagauggaagaggcucuuaagggccugccgauccgauaucagacuacagcgaccaaauccgaacauacgggucgggagaucguggacuugaugugccacgcaacuuuuacaaugcgccuacugagccccguuagagucccaaauuacaaccucauuaucauggaugaagcccauuucaccgacccugcuucuauagccgcaaggggguacauuagcacccgggugggaaugggcgaggccgcugcgaucuuuaugacugccacacccccaggcaccgcagaugcuuucccucaguccaaugcccccauucaggacgaggaacgagacaucccagagagaucauggaacagugggaaugaauggauaacagauuuugcaggaaagacugugugguucgucccgagcauuaaagccgguaacgacaucgcuaacuguuuacgcaagaauggcaaaaagguaauccaacugucuaggaagacguuugauaccgaguaucagaaaacaaaacuuaacgacugggauuucgugguuacuaccgacauuuccgagaugggggccaauuuuaaagcggaucgugugaucgacccucggagaugccugaagcccgucauucucacagauggaccagaaagggugauauuggcaggccccaugccuguuaccgccgcuucagccgcucagcgccgagguagaguggggcggaacccacagaaagagaaugaccaauacaucuucacuggccagccccugaacaaugaugaagaccacgcacauuggacggaggccaagaugcuccuggacaacauuaauaccccugaaggaaucaucccggcucuuuucgagccagagagggaaaagagugccgcaauugauggcgaguaucgccuaaaaggggaaagccguaagacauuugucgagcugaugagacggggagacuugcccgugugguuagcgcacaaaguagccuccgaagguauaaaguacacugauaggaaauggugcuucgacggccagcgcaacaaucagauccuggaggagaacauggauguggaaauuuggaccaaggagggggagaaaaagaagcuccgaccuagauggcuggacgcucggacauauucugauccccuugcccugaaagaguuuaaggacuucgcagcuggaaggaaaucgaucgcccucgauuugguuaccgaaauuggccgcgucccaagccaccuggcacauagaacuaggaaugcccuagacaaccuggugaugcuccacacaucagagcauggugggaaggcuuaccggcacgcgguggaggaacuuccugagacgauggaaacccuguuauugcugggccucaugauccugcuuacuggaggcgccaugcuguuucucauauccgggaaaggaaucgguaagacaaguauuggcuugaucugugucauugcaucuagcgggaugcuguggauggcugagauccccuuacaauggauagccuccgccauuguucuagaguucuuuaugauggugcugcucaucccagaaccugagaagcagcguaccccgcaggauaaucaacuugcauauguagugauuggaauccugaccuuggcugccauaaucgcggcuaacgaaaugggccugcucgagacaacuaaacgcgaccuggguaugucaaaggaacccggggucgugucuccaacgagcuaccuugauguugaccuccacccugccagugcauggacccuguacgccguggcuacaacugucauuacccccauguugcgacauacaaucgaaaauuccaccgcaaacguaagccuggccgcgauugcuaaccaggccgugguuuuaaugggccuagacaaaggauggccaaucucuaagauggaucugggcgugccucuccuugcacuggggugcuauucacaggucaaucccuugacucugacggccgcugugcuccugcuuauaacacacuacgccauuaucggaccgggcuuacaggcaaaagcuaccagagaggcccaaaagaggacugcggccgguaucaugaagaacccaaccgucgacgggauuaugacaaucgaucuggacccugugauauaugauuccaaauucgagaagcagcucggacagguuauguugcuggugcuaugugcaguacagcugcuccuuaugcggacaaguugggcucugugcgaggccuugacccuggcaacaggccccauuacgacccucugggaagguagcccaggcaaauuuuggaauacuacaaucgcugugucgauggccaacauuuuccgcgggaauuaccuggccggagcgggcuuagcuuuuucuaucaugaaguccgucgggaccggaaaaagaggcacugguagccaaggggagacacuuggagaaaaguggaagaaaaagcugaaccagcucucaaggaaagaguucgaccuauauaagaaaaguggcauaaccgagguugaucggacggaagcaaaggagggucugaaacgaggcgaaaucacccaucacgccgugucuagaggguccgcuaaguugcagugguuugucgagcgcaauauggugauucccgaaggaaggguaaucgaccugggcugugggcggggaggcuggagcuacuauugcgccggucucaagaaagugacagagguucguggguacacuaagggaggcccuggccaugaggaaccggugcccaugucaaccuacggguggaacauugucaaacuuaugaguggaaaggauguguucuaucugccaccugagaaaugugacacauugcugugcgauaucggugaaagcucccccucuccuacugucgaggagagcagaaccauuagggugcucaagaugguugaaccaugguuaaagaauaaccaguucuguaucaaaguacugaaucccuacaugccuacagugauagagcaccuugaacgccugcaacggaagcacggcgggaugcuaguccgaaacccacucuccagaaauucaacccaugagauguauuggauuucuaacggaacuggcaauaucguggcaaguguuaacauggugucgaggcuguugcugaaccgcuuuacgaugacacaccggagacccaccaucgaaaaagacgucgaucucggugccgggacucgucaugugaaugcugagccggagaccccuaacauggacguaauuggagaaaggauaaagcggaucaaagaggaacacaauagcacauggcacuacgacgaugagaacccauauaagacgugggcguaccauggcuccuaugaagugaaggccaccggcucugcaucaagcaugauuaaugggguugucaaacuucugacuaagcccugggacguggugccuauggucacacagauggcuaugaccgauacuacaccauucggacagcaacgcguuuuuaaagagaagguggacacccgaacacccagauccaugccggguacuaggcggguaaugggcaucaccgccgagugguuauggcgcacgcuggggagaaacaaaaagccuagguugugcacccgagaagaguucacaaagaaagugcggacuaaugcagccaugggagcugucuuuaccgaagagaaccagugggauagugccaaggcggcaguggaagacgaggauuucuggaaacucguugaccgugagagagaacugcacaagcuaggcaaaugugguucuugcguguacaauaugauggggaagcgcgagaagaaacuuggagaauuuggcaaagccaaaggcagcagggcuauuugguacauguggcugggggcccgguaucucgaguucgaggcacugggauuuuugaacgaagaucauugguucucaagagaaaauuccuacaguggugucgaaggcgaggggcugcacaagcucggauauauccuucgcgacauaagcaaaauccccggcggugcuauguacgccgaugacacagcugggugggacacuaggauuaccgaagaugaccugcauaacgaggagaagaucacgcagcagauggauccagaacaccgacaauuagccaaugcaauuuuuaaacugacauaucagaacaaggugguaaagguucagcggccuacccccacuggaacagugauggacaucauaucuagaaaagaucagaggggcuccggccaagucgggaccuacggauugaauacuuucaccaacauggaggcgcagcucauucgccagauggaaggugagggcgugcugucaaaggccgaccuagaaaacccacaccuucccgagaaaaagaucacacaguggcuggagacgaaagggguggaacgucucaagcggauggcuaucagcggagaugacugcgucguuaagccuauugaugacagauuugccaaugcacuguuggcuuuaaacgauaugggcaaagugaggaaggacauaccacaauggcagccgucgaaagguuggcaugauuggcagcagguacccuucuguucucaccauuuccacgagcugaucaugaaggacgggcgcaaacucguggucccuugccgaccacaagacgaacuuauuggacgggccagaaucagucagggcgcaggcuggucccugagggagaccgccugucuagggaaggcguaugcucagauguggagccugauguacuuucaccgcagagaucuccgguuggccucaaaugcaauuugcuccgccgugcccguucauugggugccuacuucuaggacaaccuggagcauccacgcucaucaccaauggaugacuacagaagacaugcugaccgucuggaaccguguguggauagaggauaauccauggauggaggacaagacgcccguaacaaccugggaaaacguuccuuaccuuggaaaacgagaggaucaguggugugguagucugaucggccucacuucccgcgccaccugggcacagaauauuccgacagcuauccagcaagugaggagcuuaauugggaacgaagaguuccuggacuauaugccaucuaugaagcgguuuaggaaagaggaagagucagaaggagccaucugguga

SEQ ID NO: 15491 - RNA, 9873 nt, Artificial Sequence
  derived and/or modified CDS sequence (opt3) from DENV-3__FJ639757__SS-prME
accagccugugccucaugaugauccuuccagccgcucuggcauuccacuugacauccagggacggcgagccuaggaugauuguggggaagaacgaacggggaaaaucuuuacuguuuaagacugccucagguauaaauauguguacgcuaaucgcgauggaucucggcgaaaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauagcgccuugaaaaucaacugguauaagaaggggaguucuauuggaaaaauguuugaagcuacagcccgcggugcaagaaggauggccauacugggcgacacugcuugggauuucggguccguuggaggcgugcucaauagccuggguaagaugguccaccagaucuuugggucggccuacaccgcacuuuucucuggcguguccuggguaaugaaaauuggaaucggcgugcuguugacguggaucgggcucaacucaaagaauacaaguaugagcuuuuccugcauugcgauaggaaucauuacccuguauuuaggcgcuguuguccaggccgacauggguugugugaucaacuggaaagggaaggagcugaagugcggaucuggcauuuucgugacuaaugagguccauacauggaccgaacaguacaaauuucaagcagauagccccaagcggcuagccacugcuaucgccggugcaugggagaacggcguuugugggauacgaucaaccacacgcauggaaaaucuccuguggaaacagaucgcuaacgagcuuaauuauauuuugugggaaaacaauaucaagcugacgguggugguaggagacauuaucggcguccucgagcaggggaaaagaacccugacuccacagccuauggaguuaaaguacaguuggaaaacauggggaaaggccaagauagugaccgcggaaacacaaaacuccagcuucauuaucgauggccccaacacuccagagugccccucugccucaagggcuuggaauguuugggaaguggaggacuaugguuuuggggucuucaccacgaacauuuggcugaaacuucgggaaguguacacacaguugugugaccaccgccucaugagugcagccguuaaggaugagagagcugugcacgccgacaugggauacuggaucgagagccagaaaaauggcuccuggaagcuggaaaaagcaucucuaauagagguaaagaccugcacuuggccuaagucgcauacccuguggagcaacgguguccucgaauccgauaugaucauuccaaaaucacuggcgggcccgaucagucagcacaauuauaggcccggguaccauacacaaacugccggaccuuggcaccuuggcaaguuggagcuggacuuuaacuauugcgaggggaccacaguggugauuacggaaaauuguggaacccguggcccaucuuuacggacuacaaccgucagcgguaaacucauccacgaguggugcugucgauccugcacucugcccccucuuagauacaugggggaagauggauguugguauggcauggagauaaggccaauuucagaaaaggaggagaacaugguuaaaagccuggugucugcugguuccggcgaaguagacaauuucacaauggggguguugugccucgccauccuguuugaggaagucaugcgcggaaaguucggcaagaaacauaugaucgcagggguguucuuuaccuucguucuacugcucaguggacagauuacguggcgggauauggcucacacucugaucaugauuggcagcaacgccucugacagaauggguaugggggugaccuaccuugcauugauagccacauuuaagauccagcccuuccuggcuuuaggauuuuuccucaggaaacugaccucccgcgagaaucuucugcuaggcgucggccucgcgauggccacuacacugcaauugccggaagauauugagcagauggcaaacgggaucgcucugggauuaauggcccucaagcugauuacccaguuugagacauaucagcuuuggacugcccugaucucauugaccuguaguaauacgauauucacacucaccguggcuuggcgaacugcaacccugauccuagccgguguuagccugcuuccugugugccaaucguccucuaugcggaaaacagacuggcucccaaugacugucgcggcuaugggcguacccccucugcccuuguuuauuuucagccugaaggauaccuuaaagcguagaucauggccacucaacgaaggggugauggccguuggacuggugaguauccuugcauccucucuguugaggaaugacgucccuauggccggcccccucguggcuggugggcugcuaauugcauguuacguaaucacgggaacaagcgccgaucugaccguggagaaagcggcugacgucacuugggaagaggaagccgagcagacaggcguuucccauaaccuuaugauaaccguggacgaugacggcacuaugcgcauuaaggaugacgagacagaaaacauccucaccgugcuguugaaaacggcauuacugaucgucucagggauuuuuccauacagcauaccggccacucuccugguguggcacaccuggcagaagcagacacaacggaguggaguucuuugggauguaccuucucccccagagacccagaaagcugaacuggaggaggguguguauagaaucaagcagcagggcauuuucgggaaaacacaagucggagugggcguucagaaggaagguguguuucauacuauguggcacgucaccagaggggccguguugacguacaauggaaagcgacuagagcccaacugggcauccgucaagaaggaccugaucagcuauggcggcggguggcgccucucggcucaguggcaaaaaggagaagagguccaggugauugccguugaaccugguaagaaucccaagaacuuccagacaaugcccggcacuuuccagaccacaaccggggagaucggagcgauagcccuggauuuuaagccuggcacuucagguucuccgaucauuaaucgggaggggaagguggucggacuuuacggcaacggcgugguuaccaaaaaugggggauaugugagugguaucgcacaaacaaacgcugaaccagacggccccacgccugaguuagaagaggaaauguucaagaaaagaaaucugacuauuauggaucuccacccaggguccggaaagaccaggaaauacuugcccgccaucguccgugaggcuauaaagcgccggcugagaacacucauucuggcaccuaccagggugguagccgccgagauggaagaggcucuuaagggccugccgauccgauaucagacuacagcgaccaaaagcgaacauacgggucgggagaucguggacuugaugugccacgcaacuuuuacaaugcgccuacugucucccguuagagucccaaacuacaaucucauuaucauggaugaagcccauuucaccgacccugcuagcauagccgcaaggggguacauuuccacccgggugggaaugggcgaggccgcugcgaucuuuaugacugccacacccccaggcaccgcagaugcuuucccucagucaaacgcccccauucaggacgaggaacgagacaucccagagagaaguuggaauagcgggaacgaauggauaacagauuuugcaggaaagacugugugguucgucccgucuauuaaagccgguaaugacaucgcuaacuguuuacgcaagaacggcaaaaagguaauccaacuguccaggaagacguuugauaccgaguaucagaaaacaaaacuuaaugacugggauuucgugguuacuaccgacauuucagagaugggggccaacuuuaaagcggaucgugugaucgacccucggagaugccugaagcccgucauucucacagauggaccagaaagggugauauuggcaggccccaugccuguuaccgccgcuagugccgcucagcgccgagguagaguggggcggaauccacagaaagagaacgaccaauacaucuucacuggccagccccugaauaacgaugaagaccacgcacauuggacggaggccaagaugcuccuggacaauauuaacaccccugaaggaaucaucccggcucuuuucgagccagagagggaaaagagcgccgcaauugauggcgaguaucgccuaaaaggggaaucccguaagacauuugucgagcugaugagacggggagacuugcccgugugguuagcgcacaaaguagccucugaagguauaaaguacacugauaggaaauggugcuucgacggccagcgcaauaaccagauccuggaggagaauauggauguggaaauuuggaccaaggagggggagaagaagaagcuccgaccuagauggcuggacgcucggacauauucggauccccuugcccugaaagaguuuaaggacuucgcagcuggaaggaaaagcaucgcccucgauuugguuaccgaaauuggccgcgucccaacucaccuggcacauagaacaaggaacgcccuagacaaucuggugaugcuccacacgucagagcauggugggaaggcuuaccggcacgcgguggaggaacuuccugagaccauggaaacucuguuauugcugggccucaugauccugcuuacaggaggcgccaugcuguuucucauauccgggaaaggaaucgguaagaccaguauuggcuugaucugugucauugcaucuagcgggaugcuguggauggcugagauccccuuacaauggauagccuccgccauuguucuagaguucuuuaugauggugcugcucaucccagaaccugagaagcagcguaccccgcaggauaaccaacuugcauauguagugauuggaauccugacauuggcugccauaaucgcggcuaaugaaaugggccugcucgagacuacgaaacgcgaccuggguaugucaaaggaacccggggucgugucuccaaccagcuaccuugauguugaccuccacccugccagugcauggacacuguacgccguggcuacuaccgucauuacacccauguugcgacauaccaucgagaacuccacugcaaauguaagccuggccgcgauugcuaaccaggccgugguuuuaaugggccuagacaaaggauggccaaucucuaagauggaucugggcgugccucuccuugcacuggggugcuauucacaggucaaccccuugacgcugacagccgcugugcuccugcuuauaacccacuacgccauuaucggaccgggcuuacaggcaaaagcuacuagagaggcccaaaagaggaccgcggccgguaucaugaagaauccaacagucgacgggauuaugacuaucgaucuggacccugugauauaugauuccaaauucgaaaagcagcucggacagguuauguugcuggugcuaugugcaguacagcugcuccuuaugcggaccaguugggcucugugcgaggccuugacacuggcaacgggccccauuaccacucucugggaagguagcccaggcaaauuuuggaacacaaccaucgcugugucgauggccaauauuuuccgcgggucuuaccuggccggagcgggcuuagcuuuuuccaucaugaaaagcgucgggacuggaaaaagaggcacagguucacaaggggagacccuuggagaaaaguggaagaaaaagcugaaccagcucaguaggaaagaguucgaccuauauaagaaaucuggcauaacggagguugaucggaccgaagcaaaggagggucugaaacgaggcgaaaucacacaucacgccguguccagagggagcgcuaaguugcagugguuugucgagcgcaauauggugauucccgaaggaaggguaaucgaccugggcugugggcggggaggcuggucauacuauugcgccggucucaagaaagugacugagguucguggguacaccaagggaggcccuggccaugaggaaccggugcccaugaguacauacggguggaacauugucaaacuuaugagcggaaaggauguguucuaucugccaccugagaaaugugacacuuugcugugcgauaucggugaauccucucccagcccuaccgucgaggaguccagaacaauuagggugcucaagaugguugaaccaugguuaaagaauaaccaguucuguaucaaaguacugaaucccuacaugccuaccgugauagagcaccuugaacgccugcaacggaagcacggcgggaugcuaguccgaaacccacucucaagaaauucuacucaugagauguauuggauuaguaacggaacgggcaauaucguggcaucgguuaacauggugagcaggcuguugcugaaucgcuuuacaaugacccaccggagacccacuaucgaaaaagacgucgaucucggugccgggacccgucaugugaacgcugagccggagacaccuaacauggacguaauuggagaaaggauaaagcggaucaaagaggaacacaauuccacguggcacuacgacgaugagaacccauauaagaccugggcguaccauggcucuuaugaagugaaggccacuggcucagcaagcuccaugauuaaugggguugucaaacuucugacaaagcccugggacguggugccuauggucacccagauggcuaugacugauacaaccccauucggacagcaacgcguuuuuaaagagaagguggacacacgaacucccagaaguaugccggguaccaggcggguaaugggcaucacggccgagugguuauggcgcacccuggggagaaacaaaaagccuagguugugcacacgagaagaguucacuaagaaagugcggaccaaugcagccaugggagcugucuuuacagaagagaaccagugggauucugccaaggcggcaguggaagacgaggauuucuggaaacucguugaccgugagagagaacugcacaagcuaggcaaaugugguagcugcguguacaauaugauggggaagcgcgagaagaaacuuggagaauuuggcaaagccaaaggcucaagggcuauuugguacauguggcugggggcccgguaucucgaguucgaggcacugggauuuuugaacgaagaucauugguucuccagagagaauaguuacagcggugucgaaggcgaggggcugcacaagcucggauauauccuucgcgacauaucuaaaauccccggcggugcuauguacgccgaugacacugcugggugggacaccaggauuacggaagaugaccugcauaacgaggagaagaucacacagcagauggauccagaacaccgacaauuagccaaugcaauuuuuaaacugaccuaucagaacaaggugguaaagguucagcggccuacucccacaggaaccgugauggacaucauauccagaaaagaucagaggggcucaggccaagucgggacuuacggauugaauaccuucacaaacauggaggcgcagcucauucgccagauggaaggugagggcgugcugagcaaggccgaccuagaaaauccacaccuucccgagaaaaagaucacgcaguggcuggagaccaaagggguggaacgucucaagcggauggcuaucucgggagaugacugcgucguuaagccuauugaugacagauuugccaacgcacuguuggcuuuaaacgauaugggcaaagugaggaaggacauaccacaauggcagccgucuaaagguuggcaugauuggcagcagguacccuucuguagucaccauuuccacgagcugaucaugaaggacgggcgcaaacucguggucccuugccgaccacaagacgaacuuauuggacgggccagaaucucccagggcgcaggcuggagccugagggagacugccugucuagggaaggcguaugcucagauguggucacugauguacuuucaccgcagagaucuccgguuggccuccaaugcaauuugcucugccgugcccguucauugggugccuacaagcaggaccacuuggaguauccacgcucaucaccaauggaugacaaccgaagacaugcugacggucuggaaccguguguggauagaggauaauccauggauggaggacaagacacccguaaccacuugggaaaacguuccuuaccuuggaaaacgagaggaucaguggugugguucccugaucggccucaccagccgcgccacaugggcacagaauauuccgacugcuauccagcaagugagaucuuuaauugggaacgaagaguuccuggacuauaugccaucaaugaagcgguuuaggaaagaggaagagagugaaggagccaucugguga

SEQ ID NO: 15492 - RNA, 9873 nt, Artificial Sequence
  derived and/or modified CDS sequence (opt3) from DENV-3__FJ639758__SS-prME
accagccugugccucaugaugauccuuccagccgcucuggcauuccacuugacuuccagggacggagaaccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacgucauuggcgugcucgagcaggggaaaagaacccugacuccacagccuauggaguuaaaguacucauggaaaacauggggaaaggccaagaucguuaccgcggaaacacaaaacaguuccuucauaauugauggccccaauacuccagagugccccagcgccucuagggcuuggaacgugugggaagucgaggacuaugguuuugggguguucaccacgaauaucuggcugaaacuucgggaaguuuacacacaguugugugaccaccgccucaugucagcagccgugaaggaugagagagcuguacacgccgacaugggauacuggauugagagucagaaaaacggcagcuggaagcuggaaaaagcaucccuaaucgaggucaagaccugcacuuggccuaagucucauacccuguggucgaauggugugcucgaaagcgauaugauaaucccaaaaucccuggcgggcccgauuucacagcacaacuauaggcccggguaccauacacaaacugccggaccuuggcaccuuggcaaguuggagcuggacuuuaauuauugcgaggggaccacaguggucaucacggaaaacuguggaacccguggcccaaguuuacggacuacaaccguuucugguaaacucauucacgaguggugcugucgaagcugcacucugcccccucuuagauacaugggggaagauggauguugguauggcauggagaucaggccaauauccgaaaaggaggagaauauggugaaaucacugguaagcgcugguucuggcgaaguggacaacuucacaaugggggucuugugccucgccauucuguuugaggaagugaugcgcggaaaguucggcaagaaacauaugaucgcagggguuuucuuuaccuucgugcuacugcucuccggacagaucacguggcgggauauggcucacacucugauuaugaucggcaguaaugccagcgacagaauggguaugggggucaccuaccuugcauugauugccacauuuaagauacagcccuuccuggcuuuaggauuuuuccucaggaaacugaccucucgcgagaaccuucugcuaggcgugggccucgcgauggccacuacacugcaauugccggaagauaucgagcagauggcaaaugggauugcucugggauuaauggcccucaagcugaucacccaguuugagacauaucagcuuuggacugcccugauuuccuugaccuguucaaacacgaucuucacacucaccguugcuuggcgaacugcaacccugauacuagccggugugagucugcuuccugucugccaaagcucguccaugcggaaaacagacuggcucccaaugacuguagcggcuaugggcgugcccccucugcccuuguuuaucuucucucugaaggauaccuuaaagcguagaagcuggccacucaaugaagggguuauggccgugggacuggucucaauucuugcaaguucccuguugaggaacgacgugccuauggccggcccccucguagcuggugggcugcuaaucgcauguuacgugauuacgggaacaucugccgaucugaccgucgagaaagcggcugacguuacuugggaagaggaagccgagcagacaggcgugagccauaaccuuaugaucaccguggacgaugacggcacuaugcgcauaaaggaugacgagacagaaaauauucucaccguccuguugaaaacggcauuacugaucguguccgggaucuuuccauacucaauuccggccacucuccugguuuggcacaccuggcagaagcagacacaacggagcggaguacuuugggaugugccuagucccccagagacccagaaagcugaacuggaggagggugucuauagaauaaagcagcagggcaucuucgggaaaacacaagugggaguuggcgugcagaaggaaggugucuuucauacuauguggcacgugaccagaggggccguauugacguacaacggaaagcgacuagagcccaauugggcaucugucaaaaaggaccugauuuccuauggcggcggguggcgccucagcgcucaguggcaaaaaggagaagaggugcagguuaucgccguggaaccugguaagaaccccaagaauuuccagacaaugcccggcacuuuccagaccacaaccggggagauuggagcgaucgcccuggauuuuaagccuggcacuucggguucaccgauaaucaaccgggaggggaaggucgugggacuuuacggcaauggcguugugaccaaaaacgggggauaugucucugguauugcacaaacaaaugcugaaccagacggccccacgccugaguuagaagaggaaauguucaagaaaagaaaccugacuaucauggaucuccacccagggaguggaaagaccaggaaauacuugcccgccauugugcgugaggcuaucaagcgccggcugagaacacucauacuggcaccuaccaggguaguggccgccgagauggaagaggcucuuaagggccugccgauucgauaucagacuacagcgaccaaauccgaacauacgggucgggagaucguugacuugaugugccacgcaacuuuuacaaugcgccuacugagccccgucagagugccaaauuacaaccucaucauuauggaugaagcccauuucaccgacccugcuucuaucgccgcaaggggguacauaagcacccgggugggaaugggcgaggccgcugcgauuuuuaugacugccacacccccaggcaccgcagaugcuuucccucaguccaaugcccccauccaggacgaggaacgagacauuccagagagaucauggaacagugggaaugaauggaucacagauuuugcaggaaagacugucugguucguaccgagcauaaaagccgguaacgacauugcuaacuguuuacgcaagaauggcaaaaaggugauccaacugucuaggaagacguuugauaccgaguaucagaaaacaaaacuuaacgacugggauuucguugugacuaccgacaucuccgagaugggggccaauuuuaaagcggaucgugucauugacccucggagaugccugaagcccgugauccucacagauggaccagaaaggguuauuuuggcaggccccaugccugugaccgccgcuucagccgcucagcgccgagguagagucgggcggaacccacagaaagagaaugaccaauacauauucacuggccagccccugaacaaugaugaagaccacgcacauuggacggaggccaagaugcuccuggacaacaucaauaccccugaaggaauuaucccggcucuuuucgagccagagagggaaaagagugccgcaaucgauggcgaguaucgccuaaaaggggaaagccguaagacauuuguggagcugaugagacggggagacuugcccguaugguuagcgcacaaaguggccuccgaagguauuaaguacacugauaggaaauggugcuucgacggccagcgcaacaaucagauacuggaggagaacauggauguugaaaucuggaccaaggagggggagaagaagaagcuccgaccuagauggcuggacgcucggacauauucugauccccuugcccugaaagaguuuaaggacuucgcagcuggaaggaaaucgauugcccucgauuuggucaccgaaaucggccgcgugccaagccaccuggcacauagaacuaggaaugcccuagacaaccuggugaugcuccacacaucagagcauggugggaaggcuuaccggcacgcggucgaggaacuuccugagacgauggaaacccuguuauugcugggccucaugauucugcuuacuggaggcgccaugcuguuucucaucuccgggaaaggaauagguaagacaaguaucggcuugauuuguguuaucgcaucuagcgggaugcuguggauggcugagauucccuuacaauggaucgccuccgccauagugcuagaguucuuuaugaugguacugcucauuccagaaccugagaagcagcguaccccgcaggauaaucaacuugcauauguggucaucggcauucugaccuuggcugccaucauagcggcuaacgaaaugggccugcucgagacaacuaaacgcgaccuggguaugucaaaggaacccggggugguuucuccaacgagcuaccuugauguggaccuccacccugccagugcauggacccuguacgccgucgcuacaacuguaaucacccccauguugcgacauacaauugaaaauuccaccgcaaacgugagccuggccgcgaucgcuaaccaggccguuguguuaaugggccuagacaaaggauggccaauuucuaagauggaucugggcgucccucuccuugcacuggggugcuauucacaggugaaucccuugacucugacggccgcuguccuccugcuuaucacacacuacgccauaauuggaccgggcuuacaggcaaaagcuaccagagaggcccaaaagaggacugcggccgguaucaugaagaacccaaccguggacgggaucaugacaauugaucuggacccuguuaucuaugauuccaaauucgagaagcagcucggacaggugauguugcugguacuaugugcagugcagcugcuccuuaugcggacaaguugggcucugugcgaggccuugacccuggcaacaggccccauaacgacccucugggaagguagcccaggcaaauuuuggaauacuacaauugcugucucgauggccaacaucuuccgcgggucuuaccuggccggagcgggcuuagcuuuuuccauuaugaaaagcguugggaccggaaaaagaggcacugguucacaaggggagacacuuggagaaaaguggaagaaaaagcugaaucagcucaguaggaaagaguucgaccuauauaagaaaucuggcaucaccgagguggaucggacggaagcaaaggagggucugaaacgaggcgaaauaacccaucacgccgucuccagagggagcgcuaaguugcagugguuuguggagcgcaacaugguaauccccgaaggaagggugauugaccugggcugugggcggggaggcuggucauacuauugcgccggucucaagaaaguuacagaggugcguggguacacuaagggaggcccuggccaugaggaaccgguccccaugaguaccuacggguggaauaucgugaaacuuaugagcggaaaggaugucuucuaucugccaccugagaaaugugacacauugcugugcgauauuggugaauccucucccagcccuacuguggaggaguccagaaccaucaggguucucaagaugguagaaccaugguuaaagaacaaucaguucuguauuaaagugcugaaccccuacaugccuacagucguggagcaccuugaacgccugcaacggaagcacggcgggaugcuaguucgaaauccacucucaagaaacucuacccaugagauguauuggaucaguaauggaacuggcaacauaguggcaucggucaauauggugagcaggcuguugcugaaccgcuuuacgaugacacaccggagacccaccauugaaaaagacguagaucucggugccgggacucgucaugugaacgcugagccggagaccccuaauauggacguuaucggagaaaggaucaagcggauuaaagaggaacacaacuccacauggcacuacgacgaugagaauccauauaagacgugggcguaccauggcucuuaugaagucaaggccaccggcucagcaagcuccaugauaaacgggguggugaaacuucugacuaagcccugggacgucguuccuauggugacacagauggcuaugaccgauacuacaccauucggacagcaacgcguauuuaaagagaagguggacacccgaacacccagaaguaugccggguacuaggcgggucaugggcaucaccgccgagugguuauggcgcacgcuggggagaaauaaaaagccuagguugugcacccgagaagaguucacaaagaaagugcggacuaacgcagccaugggagcuguuuuuaccgaagagaaucagugggauucugccaaggcggcaguggaagacgaggauuucuggaaacucgucgaccgugagagagaacugcacaagcuaggccgcugugguagcugcguguacaacaugauggggaaaagggagaagaaacuuggagaauuuggcaaggccaagggcucacgggcuauuugguacauguggcugggggccagauaucucgaguucgaggcacugggauuuuugaaugaagaucauugguucucccgcgagaacaguuacagcgguguagaaggcgaggggcugcacaaacucggauauauccuuagggacauuucuaagauccccggcggugcuauguacgccgaugacacagcugggugggacacucgaauaaccgaagaugaccugcauaaugaggagaaaaucacgcagcagauggauccagaacaccggcaauuagccaacgcaauuuuuaagcugacauaucagaauaaaguugugaagguccagagaccuacccccacuggaacagugauggacaucauuuccaggaaggaucagcgcggcucaggccaaguggggaccuacggauugaacacuuucaccaauauggaggcgcagcucauccgucagauggaaggugagggcguccugagcaaagccgaccuagaaaacccacggcuucccgagaagaaaauaacacaguggcuggagacgaaggggguugaaagacucaaaaggauggcuauuucgggagaugacugcgugguaaagccuaucgaugaccgcuuugccaacgcacuguuggcuuuaaaugauaugggcaaggugcgaaaagacaucccacaauggcagccgucuaaggguuggcacgauuggcagcagguccccuucuguagucaucacuuccaugagcugauuaugaaagacgggcggaagcucgugguuccuugcagaccacaagacgaacuuauaggaagggcccgcaucucccagggcgcaggcuggagccugagagagaccgccugucuagggaaagcguaugcucagauguggucacugauguacuuucaccggagggaucuccguuuggccuccaacgcaauuugcucugccgugcccguccacugggugccuacuagccgaacaaccuggaguauccaugcucaccaucaauggaugacuacagaagacaugcugaccguauggaaucgcguuuggauugaggauaacccauggauggaggacaagacgcccgugacaaccugggaaaaugucccuuaccuuggaaagagagaggaucaguggugugguucccugaucggccucacuagccgggccaccugggcacagaacauaccgacagcuauccagcaagugaggucuuuaauugggaaugaagaguuccuggacuauaugccaucaaugaaacgcuuuagaaaggaggaagagagugaaggagccaucugguga

SEQ ID NO: 15493 - RNA, 9873 nt, Artificial Sequence
  derived and/or modified CDS sequence (opt3) from DENV-3__FJ639759__SS-prME
acaagccugugccucaugaugauccuuccagccgcucuggcauuccacuugacauccagggacggcgaaccuaggaugauuguggggaagaacgaacggggaaaaucuuuacuguuuaagacugccucagguauuaauauguguacgcuaaucgcgauggaucucggcgagaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacaccauuggcguccucgagcaggggaaaagaacucugacaccacagccuauggaguuaaaguacucauggaaaaccuggggaaaggccaagaucgugacagcggaaacucaaaacaguuccuucauaauugauggccccaauaccccagagugccccagcgccucuagggcuuggaacguuugggaaguggaggacuaugguuuuggggucuucacgacaaauaucuggcugaaacuucgggaaguguacacccaguugugugaccaccgccucaugucagcagccguuaaggaugagagagcugugcacgccgacaugggauacuggauugagagucagaaaaacggcagcuggaagcuggaaaaagcaucccuaaucgagguaaagacuugcaccuggccuaagucucauacacuguggucgaaugguguccucgaaagcgauaugauaaucccaaaaucccuggcgggcccgauuucacagcacaacuauaggcccggguaccauacucaaaccgccggaccuuggcaccuuggcaaguuggagcuggacuuuaauuauugcgaggggacaacgguggugaucaccgaaaacuguggaacucguggcccaaguuuacggacaaccacugucucugguaaacucauucacgaguggugcugucgaagcugcacacugcccccucuuagauacaugggggaagauggauguugguauggcauggagaucaggccaauauccgaaaaggaggagaauaugguuaaaucacuggugagcgcugguucuggcgaaguagacaacuucaccauggggguguugugccucgccauucuguuugaggaagucaugcgcggaaaguucggcaagaaacauaugaucgcaggggugcuauucacguuuguucugcuccuguccggacagaucacuuggcgggauauggcucacacccuuauuaugaucggcaguaaugccagcgacagaauggguaugggggugacauacuuggcacugauugccaccuucaagauacagcccuuuuuagcucucggauucuuucugaggaaacuuacuucucgcgagaaccugcuacucggcgucggccuggcgauggccacaaccuugcaacugccggaagauaucgagcagauggcaaaugggauugcuuuaggacucauggcccugaaacuuaucacacaguucgagacuuaucagcuguggaccgccuugauuucccucacguguucaaacacaaucuuuacccugacuguggcuuggcgaaccgcaacacuaauacuggccgguguuagucuucucccugugugccaaagcucguccaugcggaaaacugacuggaucccaaugaccgucgcggcuaugggcguacccccucugcccuuguucauauuuucucugaaggauacguuaaagcguagaagcuggccacucaaugaaggggugauggccguuggacuggugucaauccuugcaaguucccuguugaggaacgacgucccuauggccggcccccucguggcuggugggcugcuaauugcauguuacguaaucacaggaaccucugccgaucugacuguggagaaagcggcugacgucacaugggaagaggaagccgagcagaccggcguuagccauaaccuuaugauaacuguggacgaugacggcacaaugcgcauuaaggaugacgagaccgaaaauauccucacggugcuguugaaaacugcauuacugaucgucuccgggauuuucccauacucaauaccggccacccuccugguguggcacacauggcagaagcagacccaacggagcggaguucuuugggauguaccuagucccccagagacacagaaagcugaacuggaggaggguguguauagaaucaagcagcagggcauuuuugggaaaacucaagucggagugggcguucagaaggaagguguguuccauaccauguggcacgucacgagaggggccguguugacauacaacggaaagcgacuagagcccaauugggcaucugucaagaaggaccugaucuccuauggcggcggguggcgccucagcgcucaguggcaaaaaggagaagagguccaggugauugccguugaaccugguaagaaccccaagaauuuucagacuaugcccggcaccuuccagacaaccacuggggagaucggagcgauagcccuggauuucaagccuggcaccucggguucaccgaucauuaaccgggaggggaagaucgugggacuuuacggcaauggcgucgugaccaagaacgggggauauguuucugguauugcacaaacgaaugcugaaccagacggccccacuccugaguuagaagaggaaauguuuaagaaaagaaaccugaccaucauggaucuccacccagggaguggaaagacaaggaaauacuugcccgccauagugcgugaggcuauuaagcgccggcugagaacccucauccuggcaccuacuagggucguggccgccgagauggaagaggcucuuaagggccugccgauccgauaucagacauccgcgaccaaaagcgaacauacgggucgggagauuguagacuugaugugccacgcaacuuucacaaugcgccuacugucucccgugagaguuccaaauuacaaccucaucauaauggaugaagcccauuuuaccgacccugcuagcauugccgcaaggggguacaucuccacccgggucggaaugggcgaggccgcugcgauuuucaugacugccacacccccaggcaccgcagaugcuuuuccucagucaaaugcccccauccaggacgaggaacgagacauaccagagagaaguuggaacagcgggaaugaauggauuacagauuucgcaggaaagacugugugguuugugccgucuaucaaagccgguaacgacaucgcuaacuguuuacgcaagaauggcaaaaaggucauucaacuguccaggaagacguucgauaccgaguaucagaaaacaaaacuuaacgacugggauuuuguagugacuaccgacaucucagagaugggggccaauuucaaagcggaucguguuauugacccucggagaugccugaagcccgugauacucacagauggaccagaaagggucaucuuggcaggccccaugccugugaccgccgcuagugccgcucagcgccgagguagaguugggcggaacccacagaaagagaaugaccaauacauuuuuacuggccagccccugaacaaugaugaagaccacgcacauuggacggaggccaagaugcuccuggacaacaucaauaccccugaaggaaucauuccggcucuuuucgagccagagagggaaaagagcgccgcaauagauggcgaguaucgccuaaaaggggaaucccguaagacauucguggagcugaugagacggggagacuugcccgucugguuagcgcacaaaguggccucugaagguaucaaguacacugauaggaaauggugcuuugacggccagcgcaacaaucagauucuggaggagaacauggauguagaaaucuggaccaaggagggggagaagaagaagcuccgaccuagauggcuggacgcucggacauauucggauccccuugcccugaaagaguucaaggacuuugcagcuggaaggaaaagcauugcccucgauuuggugaccgaaaucggccgcguuccaacucaccuggcacauagaacaaggaaugcccuagacaaccuggucaugcuccacacgucagagcauggugggaaggcuuaccggcacgcgguggaggaacuuccugagaccauggaaacucuguuauugcugggccucaugauacugcuuacaggaggcgccaugcuguuccucaucuccgggaaaggaauugguaagaccaguaucggcuugauuugugugaucgcaucuagcgggaugcuguggauggcugagauacccuuacaauggauugccuccgccaucguccuagaguuuuucaugaugguucugcucauuccagaaccugagaagcagcguaccccgcaggauaaucaacuugcauaugugguaaucggaauacugacauuggcugccaucauugcggcuaacgaaaugggccugcucgagacuacgaaacgcgaccuggguaugucaaaggaacccgggguggucucuccaaccagcuaccuugauguggaccuccacccugccagugcauggacacuguacgccguugcuacuaccgugaucacacccauguugcgacauaccauugaaaauuccacugcaaacgucagccuggccgcgaucgcuaaccaggccguaguguuaaugggccuagacaaaggauggccaauaucuaagauggaucugggcguuccucuccuugcacuggggugcuauucacaggugaaucccuugacgcugacagccgcuguccuccugcuuauuacccacuacgccaucaucggaccgggcuuacaggcaaaagcuacuagagaggcccaaaagaggaccgcggccgguauuaugaagaacccaacaguggacgggaucaugacuauagaucuggacccugucauuuaugauuccaaauuugaaaagcagcucggacaggugauguugcugguucuaugugcagugcagcugcuccuuaugcggaccaguugggcucugugcgaggccuugacacuggcaacgggccccaucaccacucucugggaagguagcccaggcaaauucuggaauacaaccauugcuguaucgauggccaacaucuuucgcgggucuuaccuggccggagcgggcuuagcuuucuccauaaugaaaagcguggggacuggaaaaagaggcacagguucacaaggggagacccuuggagaaaaguggaagaaaaagcugaaucagcucaguaggaaagaguuugaccuauauaagaaaucuggcaucacggaggucgaucggaccgaagcaaaggagggucugaaacgaggcgaaauuacacaucacgccguuuccagagggagcgcuaaguugcagugguucguggagcgcaacauggucauccccgaaggaagggugauugaccugggcugugggcggggaggcuggucauacuauugcgccggucucaagaaaguaacugaggugcguggguacaccaagggaggcccuggccaugaggaaccgguucccaugaguacauacggguggaauaucgugaaacuuaugagcggaaaggaugucuuuuaucugccaccugagaaaugugacacuuugcugugcgauauuggugaauccucucccagcccuaccguggaggaguccagaacaaucaggguccucaagaugguggaaccaugguuaaagaacaaucaguucuguauaaaaguucugaaccccuacaugccuaccguaauugagcaccuugaacgccugcaacggaagcacggcgggaugcuagugcgaaauccacucucaagaaacucuacucaugagauguauuggaucaguaauggaacgggcaacaucgucgcaucggugaauaugguuagcaggcuguugcugaaccgcuucacaaugacccaccggagacccacuauugaaaaagacguggaucucggugccgggacccgucaugucaacgcugagccggagacaccuaauauggacgugauaggagaaaggaucaagcggauuaaagaggaacacaacuccacguggcacuacgacgaugagaauccauauaagaccugggcguaccauggcucuuaugaaguaaaggccacuggcucagcaagcuccaugaucaacggggugguuaaacuucugacaaagcccugggacgucgugccuauggugacccagauggcuaugacugauacaaccccauuuggacagcaacgcgucuucaaagagaagguugacacacgaacucccagaaguaugccggguaccaggcgggugaugggcauuacggccgagugguuauggcgcacccuggggagaaauaaaaagccuagguugugcacacgagaagaguuuacuaagaaaguacggaccaacgcagccaugggagcuguguucacagaagagaaucagugggauucugccaaggcggcagucgaagacgaggauuuuuggaaacucguggaccgugagagagaacugcacaagcuaggcaaaugugguagcugcguuuacaacaugauggggaagcgcgagaagaaacuuggagaguucggcaaagccaaaggcucaagggcuaucugguacauguggcugggggcccgguaucucgaguuugaggcacugggauucuugaaugaagaucauugguuuuccagagagaacaguuacagcgguguggaaggcgaggggcugcacaagcucggauauauacuucgcgacaucucuaaaauucccggcggugcuauguacgccgaugacacugcugggugggacaccaggaucacggaagaugaccugcauaaugaggagaagauuacacagcagauggauccagaacaccgacaauuagccaacgcaaucuucaaacugaccuaucagaauaaggucgugaagguacagcggccuacucccacaggaaccguuauggacauaauuuccagaaaagaucagaggggcucaggccaaguggggacuuacggauugaacaccuuuacaaauauggaggcgcagcucauccgccagauggaaggugagggcguccugagcaaggccgaccuagaaaacccacaccuucccgagaaaaagaucacgcaguggcuggagaccaaagggguggaacgucucaagcggauggcuauuucgggagaugacugcguggucaagccuauagaugacagauucgccaacgcacuguuggcuuuaaaugauaugggcaaaguuaggaaggacaucccacaauggcagccgucuaaagguuggcaugauuggcaacaggugcccuuuuguagucaccauuuccacgagcugauuaugaaggacgggcgcaaacucguagugccuugccgaccacaagacgaacuuaucggacgggccagaauuucccagggcgcaggcuggagccugagggagacugccugucuagggaaggcguaugcucagauguggucacugauguacuuccaccgcagagaucuccgguuggccuccaacgcaaucugcucugccguccccgugcauuggguuccuacaagcaggaccacuuggaguauacacgcucaucaccaauggaugacaaccgaagacaugcugacgguguggaaucgugucuggaucgaggauaacccauggauggaggacaagacacccgugaccacuugggaaaauguaccuuaccuuggaaaacgagaggaucaguggugugguucccugauuggccucaccagccgcgccacaugggcacagaacaucccgacugcuauucagcaaguuagaucuuuaaucgggaaugaagaguuucuggacuauaugccaucaaugaagcgguucaggaaagaggaagagagugaaggagccauuugguga

SEQ ID NO: 15494 - RNA, 9873 nt, Artificial Sequence
  derived and/or modified CDS sequence (opt3) from DENV-3__FJ639761__SS-prME
accagccugugccucaugaugauccuucccgccgcucuggcauuccacuugacauccagggacggcgaaccuaggaugauuguggggaagaacgaacggggaaaaucuuuacuguuuaagacugccucagguauaaauauguguacgcuaaucgcgauggaucucggcgaaaugugcgacgauaccguaacauacaaauguccacauauuacugaaguugaaccggaagacaucgauugcugguguaaccugaccaguacaugggugaccuaugggacuugcaaucaggcuggagaacaccgccgagacaagcguagcguagcccuugcaccccaugugggcaugggucuggauacaagaacccagacguggauguccgccgaaggggcuuggaggcaggucgaaaaaguggaaacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuacagcccauagagggaaaagugguccaguaugagaaucugaaguacacagugauuaucacuguucauaccggugaccagcaccaagugggcaacgaaacacagggggucaccgcagagauuacuccucaggcuuccacgacagaagccauccucccagaguauggaacccuuggccuggaaugcucuccgcgaacugguuuggacuucaaugagaugauccuacugaccaugaaaaacaaggcguggauggugcauagacaaugguuuuucgaucucccccugccuuggacaagcggggccaccacugagacaccaacguggaauaggaaagaacuucugguaaccuuuaagaacgcacacgcuaaaaagcaggagguuguggucuugggcucccaggaaggagccaugcacacugcucucacaggcgccaccgagauucaaaauucagggggaacaaguauauucgcaggucaucugaagugucgguuaaaaauggacaagcuggaacuaaaaggcaugagcuacgccaugugcacuaacaccuuugugcucaagaaagaggucucugagacgcaacacgggaccauccugauuaagguggaauacaagggagaggauguucccuguaaaaucccuuucuccacagaagacggccaggguaaggcucauaacgggcgucuuauaacugcgaauccagugguaaccaaaaaggaggagcccgucaacauugaagcagagccgccuuucggcgaaucaaauaucgugaucggaauuggcgauaacgccuugaaaaucaauugguauaagaaggggagcaguauuggaaaaauguuugaggcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggaacugaagugcggauccggcauuuucgugacuaacgagguccauacauggaccgagcaauacaaauuucaggcagauucucccaagcggcuagccacugcuaucgccggugcaugggaaaauggcguuugugggauacgaagcaccacacgcauggagaaccuccuguggaaacagaucgcuaaugaacuuaacuauauuuugugggagaauaacaucaagcugacgguggugguaggagacauuaucggcguccucgaacaggggaaaagaacccugacuccacaaccuauggaguuaaaguacucauggaaaacauggggaaaggccaagauagugaccgcggagacacagaacaguuccuucauuaucgauggccccaauacuccagaaugccccagcgccucuagggcuuggaacguuugggagguggaagacuaugguuuuggggucuucaccacgaauauuuggcugaaacuucgggagguguacacacaguugugugaccaccgccucaugucagcagccguuaaggaugaaagagcugugcacgccgacaugggauacuggaucgagagucagaaaaacggcagcuggaagcuggagaaagcaucccuaauagaaguaaagaccugcacuuggccuaagucucauacccuguggucgaaugguguccucgagagcgauaugaucauuccaaaaucccuggcgggcccgaucucacaacacaacuauaggcccggguaccauacacagacugccggaccuuggcaccuuggcaaguuggaacuggacuuuaauuauugcgaggggaccacaguggugauuacggagaacuguggaacccguggcccaaguuuacggacuacaaccgucucugguaaacucauccacgaauggugcugucgaagcugcacucugcccccucuuagauacaugggggaggauggauguugguauggcauggaaauaaggccaauuuccgagaaggaagagaauaugguuaaaucacuggugagcgcugguucuggcgagguagacaacuucacaauggggguguugugccucgccauccuguuugaagaggucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccaacccuuccuggcuuuaggauuuuuccucaggaaacugaccucucgcgaaaaccuucugcuaggcgucggccucgcgauggccacuacacugcaguugccggaggauauugaacagauggcaaaugggaucgcucugggauuaauggcccucaagcugauuacccaguuugagacauaucaacuuuggacugcccugaucuccuugaccuguucaaacacgauauucacacucaccguggcuuggcgaacugcaacccugauccuagccgguguuagucugcuuccugugugccagagcucguccaugcggaaaacagacuggcucccaaugacugucgcggcuaugggcguacccccucugcccuuguuuauuuucucucugaaggauaccuuaaagcguagaagcuggccacucaaugagggggugauggccguuggacuggugucaauccuugcaaguucccuguugaggaacgacgucccuauggccggcccccucguggcuggugggcugcuaauugcauguuacguaaucacgggaacaucugccgaucugaccguggaaaaagcggcugacgucacuugggaggaagaggccgaacagacaggcguuagccauaaccuuaugauaaccguggacgaugacggcacuaugcgcauuaaggaugacgagacagagaauauccucaccgugcuguugaaaacggcauuacugaucgucuccgggauuuuuccauacucaauaccggccacucuccugguguggcacaccuggcagaagcaaacacagcggagcggaguucuuugggauguaccuagucccccagaaacccagaaagcugagcuggaagaggguguguauagaaucaagcagcaaggcauuuucgggaaaacacaggucggagugggcguucagaaggaggguguguuucauacuauguggcacgucaccagaggggccguguugacguacaacggaaagcgacuagaacccaauugggcaucugucaagaaggaccugaucuccuauggcggcggguggcgccucagcgcucaauggcagaaaggagaggaaguccaggugauugccguugagccugguaagaaccccaagaauuuccagacaaugcccggcacuuuccaaaccacaaccggggaaaucggagcgauagcccuggauuuuaagccuggcacuucggguucaccgaucauuaaccgggaggggaagguggucggacuuuacggcaauggcgugguuaccaaaaacgggggauaugugucugguaucgcacagacaaaugcugagccagacggccccacgccugaauuagaggaagagauguucaagaaaagaaaccugacuauuauggaucuccacccagggaguggaaagaccaggaaauacuugcccgccaucguccgugaagcuauaaagcgccggcugagaacacucauucuggcaccuaccagggugguagccgccgagauggaggaagcucuuaagggccugccgauccgauaucagacuacagcgaccaaauccgagcauacgggucgggaaaucguggacuugaugugccacgcaacuuuuacaaugcgccuacugagccccguuagagucccaaauuacaaccucauuaucauggaugaggcccauuucaccgacccugcuucuauagccgcaaggggguacauuagcacccgggugggaaugggcgaagccgcugcgaucuuuaugacugccacacccccaggcaccgcagaugcuuucccucaguccaaugcccccauucaagacgaggagcgagacaucccagaaagaucauggaacagugggaaugaguggauaacagauuuugcaggaaagacugugugguucgucccgagcauuaaagccgguaacgacaucgcuaacuguuuacgcaagaauggcaaaaagguaauccagcugucuaggaagacguuugauaccgaauaucagaaaacaaaacuuaacgacugggauuucgugguuacuaccgacauuuccgagaugggggccaauuuuaaagcggaucgugugaucgacccucggagaugccugaagcccgucauucucacagauggaccagagagggugauauuggcaggccccaugccuguuaccgccgcuucagccgcucagcgccgagguagaguggggcggaacccacaaaaagaaaaugaccaguacaucuucacuggccagccccugaacaaugaugaggaccacgcacauuggacggaagccaagaugcuccuggacaacauuaauaccccugagggaaucaucccggcucuuuucgaaccagagagggagaagagugccgcaauugauggcgaauaucgccuaaaaggggagagccguaagacauuugucgaacugaugagacggggagacuugcccgugugguuagcgcacaaaguagccuccgaggguauaaaguacacugauaggaaauggugcuucgacggccagcgcaacaaucaaauccuggaagagaacauggauguggagauuuggaccaaggaaggggagaaaaagaagcuccgaccuagauggcuggacgcucggacauauucugauccccuugcccugaaagaauuuaaggacuucgcagcuggaaggaaaucgaucgcccucgauuugguuaccgagauuggccgcgucccaacucaccuggcacauagaacaaggaaugcccuagacaaccuggugaugcuccacacgagcgaacauggugggaaggcuuaccggcacgcgguggaggagcuuccugaaaccauggagacucuguuauugcugggccucaugauccugcuuacaggaggcgucaugcuguuucucauaucagggaaaggaaucgguaagaccuccauuggcuugaucuguguuauugccaguucugggaugcuguggauggcagaaauccccuuacaguggauagcuagcgccauugugcuagaguucuuuaugaugguacugcucaucccagagccugaaaagcagcguaccccgcaagauaaucagcuugccuauguggucauuggaauccugacauuggcagcuauaaucgccgcgaacgagaugggccugcucgaaacuacgaaacgcgaccuggguauguccaaggagcccggggugguuucaccaaccucuuaccuugauguggaccuccacccugcuagcgccuggacacuguacgcagucgccacuaccguaauuacacccauguugcgacauaccaucgaaaauaguacugcuaacgugucccuggcagccauugcgaaccaggcuguuguguuaaugggccuagacaaaggauggccaaucagcaagauggaucugggcgucccucuccuugcccuggggugcuauucucaggugaaucccuugacgcugacagcagccguccuccugcuuauaacccacuacgcuauuaucggaccgggcuuacaagccaaagcaacuagagaggcucagaagaggaccgccgcggguaucaugaagaacccaacaguggacgggauuaugacuaucgaucuggacccuguuauauaugauucaaaauucgagaagcagcucggacaggugauguugcugguacuaugugccgugcaacugcuccuuaugcggaccuccugggcacugugcgaggcuuugacacuggccacgggccccauuaccacucucugggaggguaguccaggcaaauuuuggaauacaaccaucgcagucagcauggcuaacauuuuccgcgggucguaccuggccggagccggcuuagcguuuucuaucaugaaguccguugggacuggaaaaagaggcacaggucuucagggggaaacccugggagagaaguggaagaaaaagcucaaucagcuaagcaggaaagaguucgaccuguauaagaaaucaggcauaacggagguggaucggaccgaggcuaaggaagguuugaaacgaggcgagaucacacaucacgcagucaguagagggucugccaagcugcagugguuuguggaacgcaacaugguaauucccgagggaagggugaucgaccucggcugugggcggggaggcugguccuacuauugcgcuggucuuaagaaaguuacugaagugcguggguacaccaagggaggcccuggccaugaggagccgguccccaugagcacauacggguggaauauugugaaacugaugucaggaaaggaugucuucuauuugccaccugaaaaaugugacacucugcucugcgauaucggugagaguagccccuccccuaccguggaagagucuagaacaauuaggguuuuaaagaugguagagccauggcugaagaacaaucaauucuguaucaaagugcuuaaccccuacaugccuaccgucauagaacaccuggagcgccuacagcggaagcacggcgggaugcucgugcgaaauccacugagcagaaacuccacucaugaaauguauuggauuucaaauggaacgggcaacaucguugccucugugaauauggucaguagguugcugcucaaccgcuuuacaaugacccaccggagacccacuaucgagaaagacguggaucuuggugcagggacccgucauguaaacgccgaaccggagacaccuaauauggacgugauuggagagaggauaaagcggaucaaagaagaacacaacucgacguggcacuacgacgaugaaaauccauauaagaccugggcuuaccauggcagcuaugagguuaaggcgacuggcuccgccucuucaaugauuaacggggucgugaaacuguuaacaaagcccugggacguggucccuaugguuacccagauggcaaugacugauacaaccccauucggacaacagcgcguguuuaaagaaaagguagacacacgaacucccagaagcaugccggguaccaggcgggugaugggcaucacggcugaguggcuguggcgcaccuuggggagaaauaaaaagccuaggcucugcacacgagaggaguucacuaagaaaguccggaccaacgccgcaaugggagccguguuuacagaggaaaaucagugggauuccgcuaaggccgcgguugaggacgaagauuucuggaaacugguggaccgugagagagagcuacacaaacuuggcaaaugugguaguugcgucuacaacaugauggggaagcgcgagaagaagcugggagaguuuggcaaggcaaaaggcucuagggccauuugguacauguggcucggggcucgguaucuggaguucgaggccuugggauuucugaaugaggaucauugguucagcagagaaaacucauacuccgguguggagggcgaagggcuccacaaacuuggauauauccugcgcgacauaaguaaaauccccggcggugcaauguacgcugaugacacugccgggugggacaccaggauuacggaggaugacuuacauaaugaagagaagaucacacagcaaauggauccagagcaccgacagcuggcuaacgccauuuuuaaauugaccuaucagaauaagguaguuaaggugcagcggccuacucccacaggaaccgucauggacaucauaagcagaaaagaucaaaggggcucuggccagguggggacuuacggacucaacaccuucacaaauauggaagcacagcugauucgccagauggagggugaaggcgugcuauccaaggcggaccuugagaacccacaucugccagagaaaaagaucacgcaauggcucgagaccaaaggggucgagcgucugaagcggauggccaucucaggagaugacugcguugugaagccuauugaugacagauuugcuaacgccuuguuagcacugaaugauaugggcaaaguaaggaaggacauaccacaguggcagccgagcaaagguuggcacgauuggcagcaagugcccuucuguucgcaccauuuccacgaacucaucaugaaggacgggcgcaaacuugucgugccuugccgaccacaggacgagcugauuggacgggcuagaaucucucagggcgccggcuggagucuaagggaaacugcaugucuggggaaggccuaugcgcaaauguggucccucauguacuuucaccgcagagauuugcggcuggcuagcaacgccauuugcucagcaguucccgugcauugggucccuacauccaggaccacuuggucuauccacgcccaucaccaguggaugacaaccgaggacaugcuuacgguguggaaucguguauggauagaagauaacccauggauggaggacaagacacccguuaccacuugggagaaugugccuuaccugggaaaacgagaagaucaguggugugguagccucaucggcuuaaccagucgcgcuacaugggcccagaacauuccgacugcaauccaacaggucagaucccugauugggaaugaggaguucuuggacuauaugccaagcaugaagcgguuuaggaaagaggaggaaucugagggagcuaucugguga

SEQ ID NO: 15495 - RNA, 9873 nt, Artificial Sequence
  derived and/or modified CDS sequence (opt3) from DENV-3__FJ639762__SS-prME
accagccugugccucaugaugauccuuccagccgcucuggcauuccacuugacauccagagacggagagccuaggaugauuguggggaagaacgaacggggaaaaucuuuacuguuuaagacugccucagguauaaauauguguacgcuaaucgcgauggaucucggcgaaaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagaucgaguacaagggagaagaugugcccuguaaaauaccuuucuccacagaggacggccaagguaaggcucauaacgggcgucuuauuacugcgaauccaguugugaccaaaaaggaggaacccguaaacaucgaggcagaaccgccuuucggcgagucaaauaucgucauuggaaucggcgauaacgccuugaaaauuaauugguauaagaaggggagcaguauaggaaaaauguuugaagcuacagcccgcggugcaagaaggauggccauccugggcgacacugcuugggauuucgggucugugggaggcguucucaacucccuggguaagauggugcaccagauuuuugggagcgccuacaccgcacuuuucucgggcgucucuugggugaugaaaaucggaaucggcguacuguugacguggauugggcucaauuccaagaacacaucaaugaguuuuagcugcauagcgaucggaauuaucacccuguauuuaggcgcugugguucaggccgacauggguugugucauuaauuggaaagggaaggagcugaagugcggauccggcaucuucgugacuaacgaggugcauacauggaccgaacaguacaaauuucaagcagauucucccaagcggcuagccacugcuauagccggugcaugggagaauggcgucugugggauccgaagcaccacacgcauggaaaaccuccuguggaaacagauugcuaaugagcuuaacuauaucuugugggaaaauaacauuaagcugacgguuguggugggagacaucauaggcguacucgagcaggggaaaagaacccugacuccacagccuauggaguuaaaguacucauggaaaacauggggaaaggccaagauugucaccgcggaaacacaaaacaguuccuucaucauugauggccccaauacuccagagugccccagcgccucuagggcuuggaacgugugggaaguugaggacuaugguuuugggguguucaccacgaauaucuggcugaaacuucgggaagucuacacacaguugugugaccaccgccucaugucagcagccgugaaggaugagagagcuguucacgccgacaugggauacuggauagagagucagaaaaacggcagcuggaagcuggaaaaagcaucccuaaucgaggugaagaccugcacuuggccuaagucucauacccuguggucgaaugguguacucgaaagcgauaugauuaucccaaaaucccuggcgggcccgauuucacagcacaacuauaggcccggguaccauacacaaacugccggaccuuggcaccuuggcaaguuggagcuggacuuuaauuauugcgaggggaccacagucgugaucacggaaaacuguggaacccguggcccaaguuuacggacuacaaccgugucugguaaacucauacacgaguggugcugucgaagcugcacucugcccccucuuagauacaugggggaagauggauguugguauggcauggagauuaggccaaucuccgaaaaggaggagaauauggucaaaucacugguuagcgcugguucuggcgaaguggacaacuucacaauggggguauugugccucgccauccuguuugaggaagugaugcgcggaaaguucggcaagaaacauaugauugcagggaucuucuuuaccuucguccuacugcucuccggacagauuacguggcgggauauggcucacacucugauaaugaucggcaguaaugccagcgacagaauggguaugggggugaccuaccuugcauugauugccacauuuaagauccagcccuuccuggcuuuaggauuuuuccucaggaaacugaccucucgcgagaaccuucugcuaggcguuggccucgcgauggccacuacacugcaauugccggaagauauugagcagauggcaaaugggaucgcucugggauuaauggcccucaagcugauaacccaguuugagacauaucagcuuuggacugcccugaucuccuugaccuguucaaacacgauuuucacacucaccguggcuuggcgaacugcaacccugauccuagccggugucagucugcuuccugugugccaaagcucguccaugcggaaaacagacuggcucccaaugacuguugcggcuaugggcgugcccccucugcccuuguuuauuuucucucugaaggauaccuuaaagcguagaagcuggccacucaaugaaggggucauggccguaggacuggugucaauccuugcaaguucccuguugaggaacgacguuccuauggccggcccccucguggcuggugggcugcuaauagcauguuacgucauuacgggaacaucugccgaucugaccguggagaaagcggcugacguaacuugggaagaggaagccgagcagacaggcgugagccauaaccuuaugaucaccgucgacgaugacggcacuaugcgcaucaaggaugacgagacagaaaauauucucaccguucuguugaaaacggcauuacugauaguguccgggaucuuuccauacucaauuccggccacucuccugguguggcacaccuggcagaagcagacacaacggagcggaguccuuugggaugugccuagucccccagagacccagaaagcugaacuggaggaggguguuuauagaaucaagcagcagggcauuuucgggaaaacacaaguaggagugggcguccagaaggaagguguguuucauacuauguggcacguuaccagaggggccguguugacguacaacggaaagcgacuagagcccaauugggcaucugucaaaaaggaccugaucuccuauggcggcggguggcgccucagcgcucaguggcaaaaaggagaagaggugcagguaauagccgucgaaccugguaagaaccccaagaauuuccagacaaugcccggcacuuuccagaccacaaccggggagaucggagcgauugcccuggauuuuaagccuggcacuucggguucaccgaucauuaaccgggaggggaagaucgugggacuuuacggcaauggcguugugaccaaaaacgggggauaugucucugguauagcacaaacaaaugcugaaccagacggccccacgccugaguuagaagaggaaauguucaagaaaagaaaccugacuauuauggaucuccacccagggaguggaaagaccaggaaauacuugcccgccaucgugcgugaggcuaucaagcgccggcugagaacacucauucuggcaccuaccaggguuguggccgccgagauggaagaggcucuuaagggccugccgauccgauaucagacuacagcgaccaaauccgaacauacgggucgggagauagucgacuugaugugccacgcaacuuuuacaaugcgccuacugagccccgugagaguaccaaauuacaaccucauuaucauggaugaagcccauuucaccgacccugcuucuauugccgcaaggggguacaucagcacccgggugggaaugggcgaggccgcugcgauauuuaugacugccacacccccaggcaccgcagaugcuuucccucaguccaaugcccccauucaggacgaggaacgagacaucccagagagaucauggaacagugggaaugaauggaucacagauuuugcaggaaagacuguuugguucgucccgagcauuaaagccgguaacgacaucgcuaacuguuuacgcaagaauggcaaaaaggugauucaacugucuaggaagacguuugauaccgaguaucagaaaacaaaacuuaacgacugggauuucguggucacuaccgacauauccgagaugggggccaauuuuaaagcggaucguguaaucgacccucggagaugccugaagcccgugauucucacagauggaccagaaaggguuaucuuggcaggccccaugccugugaccgccgcuucagccgcucagcgccgagguagagucgggcggaacccacagaaagagaaugaccaauacaucuucacuggccagccccugaacaaugaugaagaccacgcacauuggacggaggccaagaugcuccuggacaacauuaauaccccugaaggaauaaucccggcucuuuucgagccagagagggaaaagagugccgcaauugauggcgaguaucgccuaaaaggggaaagccguaagacauuuguggagcugaugagacggggagacuugcccguuugguuagcgcacaaaguggccuccgaagguaucaaguacacugauaggaaauggugcuucgacggccagcgcaacaaucagauucuggaggagaacauggaugucgaaaucuggaccaaggagggggagaagaagaagcuccgaccuagauggcuggacgcucggacauauucugauccccuugcccugaaagaguuuaaggacuucgcagcuggaaggaaaucgauagcccucgauuuggugaccgaaaucggccgcguaccaacucaccuggcacauagaacaaggaaugcccuagacaaccuggugaugcuccacacgagcgagcauggugggaaggcuuaccggcacgcgguugaggaacuuccugagaccauggaaacucuguuauugcugggccucaugauucugcuuacaggaggcgccaugcuguuucucaucucagggaaaggaauugguaagaccuccaucggcuugauaugugucauugcaaguucugggaugcuguggauggcugagauccccuuacaauggauugccagcgccaucgugcuagaguucuuuaugauggugcugcucauaccagaaccugagaagcagcguaccccgcaggauaaucaacuugcauaugucguuaucggcauucugacauuggcugccaucauugcggcuaacgaaaugggccugcucgagacuacgaaacgcgaccuggguauguccaaggaacccggggugguaucaccaaccucuuaccuugauguggaccuccacccugccagcgcauggacacuguacgccgucgcuacuaccgugaucacacccauguugcgacauaccauagagaauaguacugcaaacguuucccuggccgcgauugcuaaccaggccguggucuuaaugggccuagacaaaggauggccaaucagcaagauggaucugggcguaccucuccuugcacuggggugcuauucucaggugaaucccuugacgcugacagccgcuguucuccugcuuaucacccacuacgccauuaucggaccgggcuuacaggcaaaagcuacuagagaggcccaaaagaggaccgcggccgguauaaugaagaacccaacaguggacgggauuaugacuaucgaucuggacccugucauuuaugauucaaaauucgaaaagcagcucggacaggugauguugcugguccuaugugcagugcagcugcuccuuaugcggaccuccugggcucugugcgaggccuugacacuggcaacgggccccaucaccacucucugggaagguaguccaggcaaauuuuggaauacaaccauagcuguuagcauggccaacaucuuccgcgggucguaccuggccggagcgggcuuagcuuuuucuauuaugaaguccguggggacuggaaaaagaggcacagguagccaaggggagacccuuggagaaaaguggaagaaaaagcugaaucagcucucaaggaaagaguucgaccuauauaagaaaaguggcaucacggagguagaucggaccgaagcaaaggagggucugaaacgaggcgaaauuacacaucacgccgugucuagaggguccgcuaaguugcagugguuugucgagcgcaacaugguuauccccgaaggaagggugauugaccugggcugugggcggggaggcuggagcuacuauugcgccggucucaagaaagucacugaggugcguggguacaccaagggaggcccuggccaugaggaaccgguacccaugucaacauacggguggaauaucgugaaacuuaugaguggaaaggauguuuucuaucugccaccugagaaaugugacacuuugcugugcgauauaggugaaagcucccccucuccuaccguggaggagagcagaacaauuaggguccucaagaugguggaaccaugguuaaagaacaaucaguucuguaucaaaguccugaaccccuacaugccuaccgugaucgagcaccuugaacgccugcaacggaagcacggcgggaugcuaguucgaaauccacucuccagaaacucaacucaugagauguauuggauuucuaauggaacgggcaacauaguagcaagugugaauauggucucgaggcuguugcugaaccgcuuuacaaugacccaccggagacccacuaucgaaaaagacguggaucucggugccgggacccgucauguuaacgcugagccggagacaccuaauauggacgugauuggagaaaggaucaagcggauuaaagaggaacacaacagcacguggcacuacgacgaugagaauccauauaagaccugggcguaccauggcuccuaugaagucaaggccacuggcucugcaucaagcaugaucaacggggugguaaaacuucugacaaagcccugggacgugguuccuauggucacccagauggcuaugacugauacaaccccauucggacagcaacgcguguuuaaagagaagguggacacacgaacucccagauccaugccggguaccaggcgggucaugggcauaacggccgagugguuauggcgcacccuggggagaaauaaaaagccuagguugugcacacgagaagaguucacuaagaaaguucggaccaacgcagccaugggagcuguguuuacagaagagaaucagugggauagugccaaggcggcaguagaagacgaggauuucuggaaacucguggaccgugagagagaacugcacaagcuaggcaaaugugguucuugcgucuacaacaugauggggaagcgcgagaagaaacuuggagaauuuggcaaagccaaaggcagcagggcuaucugguacauguggcugggggcccgguaucucgaguucgaggcacugggauuuuugaaugaagaucauugguucucaagagagaacuccuacagugguguggaaggcgaggggcugcacaagcucggauauauucuucgcgacaucagcaaaauucccggcggugcuauguacgccgaugacacugcugggugggacaccaggaucacggaagaugaccugcauaaugaggagaagauaacacagcagauggauccagaacaccgacaauuagccaacgcaauuuuuaaacugaccuaucagaauaagguugugaagguccagcggccuacucccacaggaaccgugauggacaucaucucuagaaaagaucagaggggcuccggccaaguagggacuuacggauugaacaccuucacaaauauggaggcgcagcucauucgccagauggaaggugagggcguucugucaaaggccgaccuagaaaacccacaccuucccgagaaaaagauaacgcaguggcuggagaccaaagggguggaacgucucaagcggauggcuaucagcggagaugacugcgucgugaagccuauugaugacagauuugccaacgcacuguuggcuuuaaaugauaugggcaaagugaggaaggacaucccacaauggcagccgucgaaagguuggcaugauuggcagcagguccccuucuguucucaccauuuccacgagcugauuaugaaggacgggcgcaaacucguugugccuugccgaccacaagacgaacuuaucggacgggccagaauaagucagggcgcaggcuggucccugagggagacugccugucuagggaaggcguaugcucagauguggagccugauguacuuucaccgcagagaucuccgguuggccucaaacgcaaucugcuccgccguacccgugcauugggucccuacaucuaggaccacuuggagcauucacgcucaucaccaauggaugacaaccgaagacaugcugacgguguggaaucguguuuggaucgaggauaacccauggauggaggacaagacacccgugaccacuugggaaaaugucccuuaccuuggaaaacgagaggaucaguggugugguagucugauuggccucaccucccgcgccacaugggcacagaacaucccgacugcuauucagcaagugaggagcuuaauagggaaugaagaguuccuggacuauaugccaucuaugaagcgguuuaggaaagaggaagagucagaaggagccaucugguga

SEQ ID NO: 15496 - RNA, 9873 nt, Artificial Sequence
  derived and/or modified CDS sequence (opt3) from DENV-3__FJ639763__SS-prME
accagccugugccucaugaugauccuucccgcagcucuggcauuccacuugacuuccagggacggcgaaccuaggaugauuguggggaagaacgaacggggaaagucuuuacuguuuaagacugcaucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaaggccguuauauucaucuuacugaugcuugugaccccaucgaugacaaugcgcugugucggcguggggaacagagacuuuguagaaggauugucaggugcgaccuggguugaugugguccuggagcacggcgggugcgugacgacuauggcaaagaauaaacccacacuagacauugagcuccagaagaccgaagccacucagcuggcuacacuuaggaaacuguguaucgagggaaagauuaccaacaucacgaccgauagccggugcccuacacagggcgaagccguguugccagaggaacaggaccagaauuaugucuguaaacacacuuacguugaucgcgguugggggaacggaugcggccucuucggcaaggggagucuggugaccugcgcaaaguuucaauguuuagagcccauagagggaaaaguagugcaguaugaaaaucugaaguacacagucauuaucacugugcauaccggugaccagcaccagguuggcaacgagacacaaggggugaccgcugaaauuacuccucaggccuccacgacagaggcgauccucccagaauauggaacccuuggccuggagugcucuccgcgaacugguuuggacuucaaugagaugauccuacugaccaugaaaaacaaggccuggaugguccauagacagugguuuuucgaucucccccugccuuggacaagcggggcaaccacugaaacaccaacguggaauaggaaagagcuucuggugaccuuuaagaacgcucacgccaaaaagcaagaaguaguuguguugggcucccaggagggagcuaugcacacugcccucacaggcgcaaccgaaauucaaaauucagggggaacaaguauauucgccggucaucugaagugucgguuaaaaauggacaagcuggagcuaaaaggcaugagcuacgcuaugugcacuaacaccuuuguccucaagaaagaggugucugaaacgcagcacgggaccauccugauuaaggucgaguacaagggagaagaugugcccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgccggugcuugggagaauggcgucugugggauacgaagcaccacacgcauggaaaaccuccuguggaaacagaucgccaaugagcuuaacuauauuuugugggaaaauaacaucaagcugacgguuguggugggagacauuaucggcguacucgagcaggggaaaagaacccugacuccacagccuauggaguuaaaguacucauggaaaacauggggaaaggcgaagauagucaccgccgaaacacaaaacaguuccuucauuaucgauggccccaauacuccagagugccccagcgcuucuagggcauggaacgugugggaaguugaggacuaugguuuugggguguucaccacgaauauuuggcugaaacuucgggaagucuacacacaguugugugaccaccgccucaugucagccgcugugaaggaugagagagccguucacgcagacaugggauacuggaucgagagucagaaaaacggcagcuggaagcuggaaaaagcgucccuaauagaggugaagaccugcacuuggccuaagucucauacccuguggucgaaugguguacucgaaagcgauaugaucauuccaaaaucccuggccggcccgaucucacagcacaacuauaggcccggguaccauacacaaacugcuggaccuuggcaccuuggcaaguuggagcuggacuuuaauuauugcgaggggaccacagucgugauuacggaaaacuguggaacccguggcccaaguuuacggacuacaaccgugucugguaaacucauccacgaguggugcugucgaagcugcacucugcccccucuuagauacaugggggaagauggauguugguauggcauggagauaaggccaauuuccgaaaaggaggagaauauggucaaaucacugguuagcgccgguucuggcgaaguggacaacuucacaauggggguauugugccucgcaauccuguuugaggaagugaugcgcggaaaguucggcaagaaacauaugaucgcuggggucuucuuuaccuucgugcuacugcucuccggacagauuacguggcgggauauggcccacacucugaucaugauuggcaguaaugcaagcgacagaauggguauggggguuaccuaccuugccuugauagcuacauuuaagauccagcccuuccuggcguuaggauuuuuccucaggaaacugaccucucgcgagaaccuucugcuaggcgugggccucgccauggcaacuacacugcaauugccggaagauauugagcagauggcuaaugggaucgcccugggauuaauggcccucaagcugauuacccaguuugagacauaucagcuuuggacugcucugaucuccuugaccuguucaaacacgauauucacacucaccgucgcauggcgaacugccacccugauccuagcgggugugagucugcuuccuguuugccaaagcucguccaugcggaaaacagacuggcucccaaugacuguggcugccaugggcgucccaccucugcccuuguuuauuuucucucugaaggauaccuuaaagcguagaagcuggccacucaaugaagggguaauggcagugggacugguuucaauccuugccaguucccuguugaggaacgacgugccuauggcuggcccccucgucgccggugggcugcuaauugccuguuacgugaucacgggaacaucugcggaucugaccguagagaaagcugccgacgugacuugggaagaggaagcagagcagacaggcgucagccauaaccuuaugauaaccguugacgaugacggcacuaugcgcauuaaggaugacgagacagaaaauauccucaccgugcuguugaaaacggccuuacugaucguguccgggauuuuuccauacucaauaccggcuacucuccuggucuggcacaccuggcagaagcagacacaacggagcggagugcuuugggauguuccuagucccccagagacccagaaagccgaacuggaggaggguguauauagaaucaagcagcagggcauuuucgggaaaacacaagugggagucggcgugcagaaggaagguguuuuucauacuauguggcacgugaccagaggggcagucuugacguacaacggaaagcgacuagagcccaauugggcuucugugaaaaaggaccugaucuccuauggcggcggguggcgccucagcgcccaguggcaaaaaggagaagagguacaggucauugcgguggaaccugguaagaaccccaagaauuuccagacaaugcccggcacuuuccagaccacaaccggggagaucggagccauagcacuggauuuuaagccuggcacuucggguucaccgaucauuaaccgggaggggaagguugugggacuuuacggcaauggcgucgugaccaaaaacgggggauauguuucugguaucgcucaaacaaaugccgaaccagacggccccacgccugaguuagaagaggaaauguucaagaaaagaaaccugacuauuauggaucuccacccagggaguggaaagaccaggaaauacuugcccgcuaucgugcgugaggcaauaaagcgccggcugagaacacucauucuggccccuaccagggucguggccgcugagauggaagaggcgcuuaagggccugccgauccgauaucagacuacagcaaccaaauccgaacauacgggucgggagaucguagacuugaugugccacgccacuuuuacaaugcgccuacugagccccgugagaguuccaaauuacaaccucauuaucauggaugaagcucauuucaccgacccugccucuauagcagccaggggguacauuagcacccgggucggaaugggcgaggcugcggccaucuuuaugacugcaacacccccaggcaccgcugaugccuucccucaguccaaugcacccauucaggacgaggaacgagacaucccagagagaucauggaacagugggaaugaauggauaacagauuuugccggaaagacugugugguucgugccgagcauuaaagcugguaacgacaucgccaacuguuuacgcaagaauggcaaaaaggucauccaacugucuaggaagacguuugauaccgaguaucagaaaacaaaacuuaacgacugggauuucguagugacuaccgacauuuccgagaugggggcgaauuuuaaagcagaucguguuaucgacccucggagaugccugaagcccgugauucucacagauggaccagaaagggucauauuggccggccccaugccugugaccgcugccucagcugcacagcgccgagguagaguugggcggaacccacagaaagagaaugaccaauacaucuucacuggccagccccugaacaaugaugaagaccacgcccauuggacggaggcuaagaugcuccuggacaacauuaauaccccugaaggaaucaucccggcccuuuucgagccagagagggaaaagagugcagcgauugauggcgaguaucgccuaaaaggggaaagccguaagacauuuguggagcugaugagacggggagacuugcccgucugguuagcccacaaaguggcuuccgaagguauaaaguacacugauaggaaauggugcuucgacggccagcgcaacaaucagauccuggaggagaacauggauguagaaauuuggaccaaggagggggagaagaaaaagcuccgaccuagauggcuggacgcccggacauauucugauccccuugcacugaaagaguuuaaggacuucgcugccggaaggaaaucgaucgcacucgauuuggugaccgaaauuggccgcguuccaagccaccuggcccauagaacuaggaaugcucuagacaaccuggucaugcuccacacaucagagcauggugggaaggcguaccggcacgccguggaggaacuuccugagacgauggaaacccuguuauugcugggccucaugauccugcuuacuggaggcgcaaugcuguuucucauauccgggaaaggaaucgguaagacaaguauuggcuugaucugugugauugcuucuagcgggaugcuguggauggccgagauccccuuacaauggauagccuccgcaauuguccuagaguucuuuaugaugguucugcucaucccagaaccugagaagcagcguaccccgcaggauaaucaacuugcuuaugugguaauuggaauccugaccuuggccgcgauaaucgcugccaacgaaaugggccugcucgagacaacuaaacgcgaccuggguaugucaaaggaacccgggguggucucuccaacgagcuaccuugauguggaccuccacccugcaagugccuggacccuguacgcuguugcaacaacugugauuacccccauguugcgacauacaaucgaaaauuccaccgccaacgucagccuggcggcuauugccaaccaggcaguaguguuaaugggccuagacaaaggauggccaaucucuaagauggaucugggcguuccucuccuugcccuggggugcuauucacaggugaaucccuugacucugacggcugccguccuccugcuuauaacacacuacgcaauuaucggaccgggcuuacaggcuaaagccaccagagaggcgcaaaagaggacugccgcagguaucaugaagaacccaaccguggacgggauuaugacaaucgaucuggacccugucauauaugauuccaaauucgagaagcagcucggacaggugauguugcugguucuaugugcugugcagcugcuccuuaugcggacaaguugggcccugugcgaggcauugacccuggcuacaggccccauuacgacccucugggaagguagcccaggcaaauuuuggaauacuacaaucgccguaucgauggccaacauuuuccgcgggucuuaccuggcgggagcuggcuuagcauuuuccaucaugaaaagcguggggaccggaaaaagaggcacugguucacaaggggagacacuuggagaaaaguggaagaaaaagcugaaucagcucaguaggaaagaguucgaccuauauaagaaaucuggcauaaccgaggucgaucggacggaagccaaggagggucugaaacgaggcgaaaucacccaucacgcuguuuccagagggagcgccaaguugcagugguuuguggagcgcaacauggucauucccgaaggaagggugaucgaccugggcugugggcggggaggcuggucauacuauugcgcaggucucaagaaaguaacagaggugcguggguacacuaagggaggcccuggccaugaggaaccgguucccaugaguaccuacggguggaauauugugaaacuuaugagcggaaaggaugucuucuaucugccaccugagaaaugugacacauugcugugcgauaucggugaauccucucccagcccuacuguggaggaguccagaaccauuaggguccucaagaugguggaaccaugguuaaagaacaaucaguucuguaucaaaguucugaaccccuacaugccuacaguaauagagcaccuugaacgccugcaacggaagcacggcgggaugcuagugcgaaauccacucucaagaaacucuacccaugagauguauuggauuaguaauggaacuggcaacaucgucgccucggugaauaugguuagcaggcuguugcugaaccgcuuuacgaugacacaccggagacccaccaucgaaaaagacguggaucucggugcugggacucgucaugucaacgcggagccggagaccccuaauauggacgugauuggagaaaggauaaagcggaucaaagaggaacacaacuccacauggcacuacgacgaugagaauccauauaagacgugggccuaccauggcucuuaugaaguaaaggcaaccggcucagcuagcuccaugauuaacggggugguuaaacuucugacuaagcccugggacgucgugccuauggugacacagauggccaugaccgauacuacaccauucggacagcaacgcgucuuuaaagagaagguugacacccgaacacccagaaguaugccggguacuaggcgggugaugggcaucaccgcagagugguuauggcgcacgcuggggagaaauaaaaagccuagguugugcacccgagaagaguucacaaagaaaguacggacuaacgccgcuaugggagccguguuuaccgaagagaaucagugggauucugcgaaggcagccgucgaagacgaggauuucuggaaacucguggaccgugagagagaacugcacaagcuaggcaaaugugguagcugcguuuacaacaugauggggaagcgcgagaagaaacuuggagaauuuggcaaagcuaaaggcucaagggccauuugguacauguggcugggggcacgguaucucgaguucgaggcucugggauuuuugaaugaagaucauugguucuccagagagaacaguuacagcgguguggaaggcgaggggcugcacaagcucggauauauccuucgcgacauaucuaaaauccccggcggugccauguacgcugaugacacagccgggugggacacuaggauuaccgaagaugaccugcauaaugaggagaagaucacgcagcagauggauccagaacaccgacaauuagcaaacgcgauuuuuaaacugacauaucagaauaaggucgugaagguacagcggccuacccccacuggaacaguuauggacaucauauccagaaaagaucagaggggcucaggccaaguggggaccuacggauugaacacuuucaccaauauggaggcccagcucauucgccagauggaaggugagggcguccugagcaaggcugaccuagaaaacccacaccuucccgagaaaaagaucacacaguggcuggagacgaacgggguggaacgucucaaacggauggccaucucgggagaugacugcguggucaagccuauugaugacagauuugcaaaugcucuguuggccuuaaacgauaugggcaagguuaggaaagacauaccacaauggcagccgucuaaggguuggcaugauuggcaacaggugcccuucuguagucaccauuuccacgagcugaucaugaaagacgggcgcaagcucguagugccuugccgaccacaagacgaacuuauuggacgggcaagaaucucccagggcgccggcuggagccugagggagaccgcgugucuagggaaggcuuaugcccagauguggucacugauguacuuucaccgcagagaucuccgguuggcauccaaugccauuugcucugcuguccccgugcauuggguuccuacuagcaggacaaccuggaguauccacgcccaucaccaauggaugacuacagaagacaugcugaccguguggaaccgugucuggauagaggauaauccauggauggaggacaagacgcccgugacaaccugggaaaacguaccuuaccuuggaaagcgagaggaucaguggugugguucccugaucggccucacuagccgcgcaaccugggcucagaauauuccgacagccauccagcaaguuagaucuuuaauugggaacgaagaguuccuggacuauaugccaucaaugaaacgguuuaggaaggaggaagagagugaaggagcgaucugguga

SEQ ID NO: 15497 - RNA, 9873 nt, Artificial Sequence
  derived and/or modified CDS sequence (opt3) from DENV-3__FJ639765__SS-prME
accagccugugccucaugaugauccuuccagccgcucuggcauuccacuugacauccagagacggcgagccuaggaugauuguggggaagaacgaacggggaaaaucuuuacuguuuaagacugccucagguauaaauauguguacgcuaaucgcgauggaucucggcgaaaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucucucugaaggauaccuuaaagcguagaagcuggccacucaaugaaggggugauggccguuggacuggugucaauccuugcaaguucccuguugaggaacgacgucccuauggccggcccccucguggcuggugggcugcuaauugcauguuacguaaucacgggaacaucugccgaucugaccguggagaaagcggcugacgucacuugggaagaggaagccgagcagacaggcguuagccauaaccuuaugauaaccguggacgaugacggcacuaugcgcauuaaggaugacgagacagaaaauauccucaccgugcuguugaaaacggcauuacugaucgucuccgggauuuuuccauacucaauaccggccacucuccugguguggcacaccuggcagaagcagacacaacggagcggaguucuuugggauguaccuagucccccagagacccagaaagcugaacuggaggaggguguguauagaaucaagcagcagggcauuuucgggaaaacacaagucggagugggcguucagaaggaagguguguuucauacuauguggcacgucaccagaggggccguguugacguacaacggaaagcgacuagagcccaauugggcaucugucaagaaggaccugaucuccuauggcggcggguggcgccucagcgcucaguggcaaaaaggagaagagguccaggugauugccguugaaccugguaagaaccccaagaauuuccagacaaugcccggcacuuuccagaccacaaccggggagaucggagcgauagcccuggauuuuaagccuggcacuucggguucaccgaucauuaaccgggaggggaagguggucggacuuuacggcaauggcgugguuaccaaaaacgggggauaugugucugguaucgcacaaacaaaugcugaaccagacggccccacgccugaguuagaagaggaaauguucaagaaaagaaaccugacuauuauggaucuccacccagggaguggaaagaccaggaaauacuugcccgccaucguccgugaggcuauaaagcgccggcugagaacacucauucuggcaccuaccagggugguagccgccgagauggaagaggcucuuaagggccugccgauccgauaucagacuacagcgaccaaauccgaacauacgggucgggagaucguggacuugaugugccacgcaacuuuuacaaugcgccuacugagccccguuagagucccaaauuacaaccucauuaucauggaugaagcccauuucaccgacccugcuucuauagccgcaaggggguacauuagcacccgggugggaaugggcgaggccgcugcgaucuuuaugacugccacacccccaggcaccgcagaugcuuucccucaguccaaugcccccauucaggacgaggaacgagacaucccagagagaucauggaacagugggaaugaauggauaacagauuuugcaggaaagacugugugguucgucccgagcauuaaagccgguaacgacaucgcuaacuguuuacgcaagaauggcaaaaagguaauccaacugucuaggaagacguuugauaccgaguaucagaaaacaaaacuuaacgacugggauuucgugguuacuaccgacauuuccgagaugggggccaauuuuaaagcggaucgugugaucgacccucggagaugccugaagcccgucauucucacagauggaccagaaagggugauauuggcaggccccaugccuguuaccgccgcuucagccgcucagcgccgagguagaguggggcggaacccacagaaagagaaugaccaauacaucuucacuggccagccccugaacaaugaugaagaccacgcacauuggacggaggccaagaugcuccuggacaacauuaauaccccugaaggaaucaucccggcucuuuucgagccagagagggaaaagagugccgcaauugauggcgaguaucgccuaaaaggggaaagccguaagacauuugucgagcugaugagacggggagacuugcccgugugguuagcgcacaaaguagccuccgaagguauaaaguacacugauaggaaauggugcuucgacggccagcgcaacaaucagauccuggaggagaacauggauguggaaauuuggaccaaggagggggagaaaaagaagcuccgaccuagauggcuggacgcucggacauauucugauccccuugcccugaaagaguuuaaggacuucgcagcuggaaggaaaucgaucgcccucgauuugguuaccgaaauuggccgcgucccaacucaccuggcacauagaacaaggaaugcccuagacaaccuggugaugcuccacacgagcgagcauggugggaaggcuuaccggcacgcgguggaggaacuuccugagaccauggaaacucuguuauugcugggccucaugauccugcuuacaggaggcgccaugcuguuucucauaucagggaaaggaaucgguaagaccuccauuggcuugaucugugucauugcaaguucugggaugcuguggauggcugagauccccuuacaauggauagccagcgccauuauccuagaguucuuuaugaugguucugcucauuccagaaccugagaagcagcguaccccgcaggauaaucaacuugcauaugugguaaucggaauacugacauuggcugccaucauugcggcuaacgaaaugggccugcucgagacuacgaaacgcgaccuggguauguccaaggaacccgggguggucucaccaaccucuuaccuugauguggaccuccacccugccagcgcauggacacuguacgccguugcuacuaccgugaucacacccauguugcgacauaccauugagaauaguacugcaaacgucucccuggccgcgaucgcuaaccaggccguaguguuaaugggccuagacaaaggauggccaauaagcaagauggaucugggcguuccucuccuugcacuggggugcuauucucaggugaaucccuugacgcugacagccgcuguccuccugcuuauuacccacuacgccaucaucggaccgggcuuacaggcaaaagcuacuagagaggcccaaaagaggaccgcggccgguauuaugaagaacccaacaguggacgggaucaugacuauagaucuggacccugucauuuaugauucaaaauucgaaaagcagcucggacaggugauguugcugguucuaugugcagugcagcugcuccuuaugcggaccuccugggcucugugcgaggccuugacacuggcaacgggccccaucaccacucucugggaagguaguccaggcaaauuuuggaauacaaccauugcuguaagcauggccaacaucuuccgcgggucguaccuggccggagcgggcuuagcuuuuucuauaaugaaguccguggggacuggaaaaagaggcacagguagccaaggggagacccuuggagaaaaguggaagaaaaagcugaaucagcucucaaggaaagaguucgaccuauauaagaaaaguggcaucacggaggucgaucggaccgaagcaaaggagggucugaaacgaggcgaaauuacacaucacgccguuucuagaggguccgcuaaguugcagugguuuguggagcgcaacauggucauccccgaaggaagggugauugaccugggcugugggcggggaggcuggagcuacuauugcgccggucucaagaaaguaacugaggugcguggguacaccaagggaggcccuggccaugaggaaccgguucccaugucaacauacggguggaauaucgugaaacuuaugaguggaaaggaugucuucuaucugccaccugagaaaugugacacuuugcugugcgauauuggugaaagcucccccucuccuaccguggaggagagcagaacaaucaggguccucaagaugguggaaccaugguuaaagaacaaucaguucuguauaaaaguucugaaccccuacaugccuaccguaauugagcaccuugaacgccugcaacggaagcacggcgggaugcuagugcgaaauccacucuccagaaacucaacucaugagauguauuggaucucuaauggaacgggcaacaucgucgcaagugugaauaugguuucgaggcuguugcugaaccgcuuuacaaugacccaccggagacccacuauugaaaaagacguggaucucggugccgggacccgucaugucaacgcugagccggagacaccuaauauggacgugauaggagaaaggaucaagcggauuaaagaggaacacaacagcacguggcacuacgacgaugagaauccauauaagaccugggcguaccauggcuccuaugaaguaaaggccacuggcucugcaucaagcaugaucaacggggugguuaaacuucugacaaagcccugggacgucgugccuauggugacccagauggcuaugacugauacaaccccauucggacagcaacgcgucuuuaaagagaagguugacacacgaacucccagauccaugccggguaccaggcgggugaugggcauuacggccgagugguuauggcgcacccuggggagaaauaaaaagccuagguugugcacacgagaagaguucacuaagaaaguacggaccaacgcagccaugggagcuguguuuacagaagagaaucagugggauagugccaaggcggcagucgaagacgaggauuucuggaaacucguggaccgugagagagaacugcacaagcuaggcaaaugugguucuugcguuuacaacaugauggggaagcgcgagaagaaacuuggagaauuuggcaaagccaaaggcagcagggcuaucugguacauguggcugggggcccgguaucucgaguucgaggcacugggauuuuugaaugaagaucauugguucucaagagagaacuccuacagugguguggaaggcgaggggcugcacaagcucggauauauacuucgcgacaucagcaaaauucccggcggugcuauguacgccgaugacacugcugggugggacaccaggaucacggaagaugaccugcauaaugaggagaagauuacacagcagauggauccagaacaccgacaauuagccaacgcaaucuuuaaacugaccuaucagaauaaggucgugaagguacagcggccuacucccacaggaaccguuauggacauaauuucuagaaaagaucagaggggcuccggccaaguggggacuuacggauugaacaccuucacaaauauggaggcgcagcucauccgccagauggaaggugagggcguccugucaaaggccgaccuagaaaacccacaccuucccgagaaaaagaucacgcaguggcuggagaccaaagggguggaacgucucaagcggauggcuauuagcggagaugacugcguggucaagccuauagaugacagauuugccaacgcacuguuggcuuuaaaugauaugggcaaaguuaggaaggacaucccacaauggcagccgucgaaagguuggcaugauuggcaacaggugcccuucuguucucaccauuuccacgagcugauuaugaaggacgggcgcaaacucguagugccuugccgaccacaagacgaacuuaucggacgggccagaauuagucagggcgcaggcuggucccugagggagacugccugucuagggaaggcguaugcucagauguggagccugauguacuuucaccgcagagaucuccgguuggccucaaacgcaaucugcuccgccguccccgugcauuggguuccuacaucuaggaccacuuggagcauacacgcucaucaccaauggaugacaaccgaagacaugcugacgguguggaaucgugucuggaucgaggauaacccauggauggaggacaagacacccgugaccacuugggaaaauguaccuuaccuuggaaaacgagaggaucaguggugugguagucugauuggccucaccucccgcgccacaugggcacagaacaucccgacugcuauucagcaaguuaggagcuuaaucgggaaugaagaguuccuggacuauaugccaucuaugaagcgguuuaggaaagaggaagagucagaaggagccauuugguga

SEQ ID NO: 15498 - RNA, 9873 nt, Artificial Sequence
  derived and/or modified CDS sequence (opt3) from DENV-3__FJ639766__SS-prME
accagccugugccucaugaugauccuucccgccgcucuggcauuccacuugacauccagggacggcgaaccuaggaugauuguggggaagaacgaacggggaaaaucuuuacuguuuaagacugccucagguauaaauauguguacgcuaaucgcgauggaucucggcgagaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucaaucugaaggauaccuuaaagcguagaucuuggccacucaacgaaggggugauggccguuggacuggugagcauccuugcaucaagucuguugaggaacgacgucccuauggccggcccccucguggcuggugggcugcuaauugcauguuacguaaucacgggaacauccgccgaucugaccguggagaaagcggcugacgucacuugggaagaggaagccgagcagacaggcguuucucauaaucuuaugauaaccguggacgaugacggcacuaugcgcauuaaggaugacgagacagaaaacauccucaccgugcuguugaaaacggcauuacugaucgucagcgggauuuuuccauacuccauaccggccacucuccugguguggcacaccuggcagaagcagacacaacggucaggaguucuuugggauguaccuagcccaccagagacccagaaagcugaacuggaggaggguguguauagaaucaagcagcagggcauuuucgggaaaacacaagucggagugggcguucagaaggaagguguguuucauacuauguggcacgucaccagaggggccguguugacguacaauggaaagcgacuagagcccaacugggcaagugucaagaaggaccugaucucuuauggcggcggguggcgccucuccgcucaguggcaaaaaggagaagagguccaggugauugccguugaaccugguaagaaucccaagaauuuccagacaaugcccggcacuuuccagaccacaaccggggagaucggagcgauagcccuggauuuuaagccuggcacuagcgguucgccgaucauuaaucgggaggggaagguggucggacuuuacggcaacggcgugguuaccaaaaaugggggauaugugucagguaucgcacaaacaaacgcugaaccagacggccccacgccugaguuagaagaggaaauguucaagaaaagaaaucugacuauuauggaucuccacccagggucuggaaagaccaggaaauacuugcccgccaucguccgugaggcuauaaagcgccggcugagaacacucauucuggcaccuaccagggugguagccgccgagauggaagaggcucuuaagggccugccgauccgauaucagacuacagcgaccaaaagugaacauacgggucgggagaucguggacuugaugugccacgcaacuuuuacaaugcgccuacugucccccguuagagucccaaacuacaaucucauuaucauggaugaagcccauuucaccgacccugcuagcauagccgcaaggggguacauuucuacccgggugggaaugggcgaggccgcugcgaucuuuaugacugccacacccccaggcaccgcagaugcuuucccucagagcaacgcccccauucaggacgaggaacgagacaucccagagagauccuggaacucagggaacgaauggauaacagauuuugcaggaaagacugugugguucgucccgaguauuaaagccgguaacgacaucgcuaauuguuuacgcaagaacggcaaaaagguaauccaacugagcaggaagacguuugauaccgaguaucagaaaacaaaacuuaaugacugggauuucgugguuacuaccgacauuucugagaugggggccaacuuuaaagcggaucgugugaucgacccucggagaugccugaagcccgucauucucacagauggaccagaaagggugauauuggcaggccccaugccuguuaccgccgcuuccgccgcucagcgccgagguagaguggggcggaauccacagaaagagaacgaccaauacaucuucacuggccagccccugaauaacgaugaagaccacgcacauuggacggaggccaagaugcuccuggacaauauuaacaccccugaaggaaucaucccggcucuuuucgagccagagagggaaaagucagccgcaauugauggcgaguaucgccuaaaaggggaaagucguaagacauuugucgagcugaugagacggggagacuugcccgugugguuagcgcacaaaguagccagcgaagguauaaaguacacugauaggaaauggugcuucgacggccagcgcaauaaccagauccuggaggagaauauggauguggaaauuuggaccaaggagggggagaaaaagaagcuccgaccuagauggcuggacgcucggacauauuccgauccccuugcccugaaagaguuuaaggacuucgcagcuggaaggaaaucuaucgcccucgauuugguuaccgaaauuggccgcgucccaacucaccuggcacauagaacaaggaacgcccuagacaaucuggugaugcuccacacgucggagcauggugggaaggcuuaccggcacgcgguggaggaacuuccugagaccauggaaacucuguuauugcugggccucaugauccugcuuacaggaggcgccaugcuguuucucauaagcgggaaaggaaucgguaagaccucaauuggcuugaucugugucauugcauccagugggaugcuguggauggcugagauccccuuacaauggauagccucugccauuguucuagaguucuuuaugauggugcugcucaucccagaaccugagaagcagcguaccccgcaggauaaccaacuugcauauguagugauuggaauccugacauuggcugccauaaucgcggcuaaugaaaugggccugcucgagacuacgaaacgcgaccuggguaugagcaaggaacccggggucguguccccaaccucauaccuugauguugaccuccacccugccucugcauggacacuguacgccguggcuacuaccgucauuacacccauguugcgacauaccaucgagaacagcacugcaaacguaagucuggccgcgauugcuaaucaggccgugguuuuaaugggccuagacaaaggauggccaaucuccaagauggaucugggcgugccucuccuugcacuggggugcuauagccaggucaaccccuugacgcugacagccgcugugcuccugcuuauaacccacuacgccauuaucggaccgggcuuacaggcaaaagcuacuagagaggcccaaaagaggaccgcggccgguaucaugaagaauccaacagucgacgggauuaugacuaucgaucuggacccugugauauaugauucuaaauucgaaaagcagcucggacagguuauguugcuggugcuaugugcaguacagcugcuccuuaugcggaccucaugggcucugugcgaggccuugacacuggcaacgggccccauuaccacucucugggaagguuccccaggcaaauuuuggaacacaaccaucgcugugaguauggccaauauuuuccgcgggagcuaccuggccggagcgggcuuagcuuuuucgaucaugaagucugucgggacuggaaaaagaggcacagguucccaaggggagacccuuggagaaaaguggaagaaaaagcugaaccagcucagcaggaaagaguucgaccuauauaagaaaucaggcauaacggagguugaucggaccgaagcaaaggagggucugaaacgaggcgaaaucacacaucacgccgugaguagagggucugcuaaguugcagugguuugucgagcgcaauauggugauucccgaaggaaggguaaucgaccugggcugugggcggggaggcugguccuacuauugcgccggucucaagaaagugacugagguucguggguacaccaagggaggcccuggccaugaggaaccggugcccaugagcacauacggguggaacauugucaaacuuaugucaggaaaggauguguucuaucugccaccugagaaaugugacacuuugcugugcgauaucggugaaaguagccccuccccuaccgucgaggagucuagaacaauuagggugcucaagaugguugaaccaugguuaaagaauaaccaguucuguaucaaaguacugaaucccuacaugccuaccgugauagagcaccuugaacgccugcaacggaagcacggcgggaugcuaguccgaaacccacucagcagaaauuccacucaugagauguauuggauuucaaacggaacgggcaauaucguggcaucuguuaacauggugaguaggcuguugcugaaccgcuuuacaaugacccaccggagacccacuaucgaaaaagacgucgaucucggugccgggacccgucaugugaaugcugagccggagacaccuaacauggacguaauuggagaaaggauaaagcggaucaaagaggaacacaauucgacguggcacuacgacgaugagaacccauauaagaccugggcguaccauggcagcuaugaagugaaggccacuggcuccgcaucuucaaugauuaaugggguugucaaacuucugacaaagcccugggacguggugccuauggucacccagauggcuaugacugauacaaccccauucggacagcaacgcguuuuuaaagagaagguggacacacgaacucccagaagcaugccggguaccaggcggguaaugggcaucacggccgagugguuauggcgcacccuggggagaaacaaaaagccuagguugugcacacgagaagaguucacuaagaaagugcggaccaaugcagccaugggagcugucuuuacagaagagaaccagugggauuccgccaaggcggcaguggaagacgaggauuucuggaaacucguugaccgugagagagaacugcacaagcuaggcaaaugugguaguugcguguacaauaugauggggaagcgcgagaagaaacuuggagaauuuggcaaagccaaaggcucuagggcuauuugguacauguggcugggggcccgguaucucgaguucgaggcacugggauuuuugaacgaagaucauugguucagcagagaaaauucauacuccggugucgagggcgaggggcugcacaagcucggauauauccuucgcgacauaaguaaaauccccggcggugcuauguacgccgaugacacugcugggugggacaccaggauuacggaagaugaccugcauaacgaggagaagaucacacagcagauggauccagaacaccgacaauuagccaaugcaauuuuuaaacugaccuaucagaacaaggugguaaagguucagcggccuacucccacaggaaccgugauggacaucauaagcagaaaagaucagaggggcucuggccaagucgggacuuacggauugaauaccuucacaaacauggaggcgcagcucauucgccagauggaaggugagggcgugcuguccaaggccgaccuagaaaacccacaccuucccgagaaaaagaucacgcaguggcuggagaccaaagggguggaacgucucaagcggauggcuaucucaggagaugacugcgucguuaagccuauugaugacagauuugccaaugcacuguuggcuuuaaacgauaugggcaaagugaggaaggacauaccacaauggcagccgagcaaagguuggcaugauuggcagcagguacccuucuguucgcaccauuuccacgagcugaucaugaaggacgggcgcaaacucguggucccuugccgaccacaagacgaacuuauuggacgggccagaaucucucagggcgcaggcuggagucugagggagacugccugucuagggaaggcguaugcucagauguggucccugauguacuuucaccgcagagaucuccgguuggccagcaaugcaauuugcucagccgugcccguucauugggugccuacauccaggaccacuuggucuauccacgcucaucaccaauggaugacaaccgaagacaugcugacggucuggaaccguguguggauagaggauaauccauggauggaggacaagacacccguaaccacuugggaaaacguuccuuaccuuggaaaacgagaggaucaguggugugguagccugaucggccucaccagucgcgccacaugggcacagaauauuccgacugcuauccagcaagugagauccuuaauugggaacgaagaguuccuggacuauaugccaagcaugaagcgguuuaggaaagaggaagagucugaaggagccaucugguga

SEQ ID NO: 15499 - RNA, 9873 nt, Artificial Sequence
  derived and/or modified CDS sequence (opt3) from DENV-3__FJ639767__SS-prME
accagccugugccucaugaugauccuuccagccgcucuggcauuccacuugacauccagggacggcgaaccuaggaugauuguggggaagaacgaacggggaaaaucuuuacuguuuaagacugccucagguauaaauauguguacgcuaaucgcgauggaucucggcgagaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucucucugaaggauaccuuaaagcguagaagcuggccacucaaugaaggggugauggccguuggacuggugucaauccuugcaaguucccuguugaggaacgacgucccuauggccggcccccucguggcuggugggcugcuaauugcauguuacguaaucacgggaacaucugccgaucugaccguggagaaagcggcugacgucacuugggaagaggaagccgagcagacaggcguuagccauaaccuuaugauaaccguggacgaugacggcacuaugcgcauuaaggaugacgagacagaaaauauccucaccgugcuguugaaaacggcauuacugaucgucuccgggauuuuuccauacucaauaccggccacucuccugguguggcacaccuggcagaagcagacacaacggagcggaguucuuugggauguaccuagucccccagagacccagaaagcugaacuggaggaggguguguauagaaucaagcagcagggcauuuucgggaaaacacaagucggagugggcguucagaaggaagguguguuucauacuauguggcacgucaccagaggggccguguugacguacaacggaaagcgacuagagcccaauugggcaucugucaagaaggaccugaucuccuauggcggcggguggcgccucagcgcucaguggcaaaaaggagaagagguccaggugauugccguugaaccugguaagaaccccaagaauuuccagacaaugcccggcacuuuccagaccacaaccggggagaucggagcgauagcccuggauuuuaagccuggcacuucggguucaccgaucauuaaccgggaggggaagguggucggacuuuacggcaauggcgugguuaccaaaaacgggggauaugugucugguaucgcacaaacaaaugcugaaccagacggccccacgccugaguuagaagaggaaauguucaagaaaagaaaccugacuauuauggaucuccacccagggaguggaaagaccaggaaauacuugcccgccaucguccgugaggcuauaaagcgccggcugagaacacucauucuggcaccuaccagggugguagccgccgagauggaagaggcucuuaagggccugccgauccgauaucagacuacagcgaccaaauccgaacauacgggucgggagaucguggacuugaugugccacgcaacuuuuacaaugcgccuacugagccccguuagagucccaaauuacaaccucauuaucauggaugaagcccauuucaccgacccugcuucuauagccgcaaggggguacauuagcacccgggugggaaugggcgaggccgcugcgaucuuuaugacugccacacccccaggcaccgcagaugcuuucccucaguccaaugcccccauucaggacgaggaacgagacaucccagagagaucauggaacagugggaaugaauggauaacagauuuugcaggaaagacugugugguucgucccgagcauuaaagccgguaacgacaucgcuaacuguuuacgcaagaauggcaaaaagguaauccaacugucuaggaagacguuugauaccgaguaucagaaaacaaaacuuaacgacugggauuucgugguuacuaccgacauuuccgagaugggggccaauuuuaaagcggaucgugugaucgacccucggagaugccugaagcccgucauucucacagauggaccagaaagggugauauuggcaggccccaugccuguuaccgccgcuucagccgcucagcgccgagguagaguggggcggaacccacagaaagagaaugaccaauacaucuucacuggccagccccugaacaaugaugaagaccacgcacauuggacggaggccaagaugcuccuggacaacauuaauaccccugaaggaaucaucccggcucuuuucgagccagagagggaaaagagugccgcaauugauggcgaguaucgccuaaaaggggaaagccguaagacauuugucgagcugaugagacggggagacuugcccgugugguuagcgcacaaaguagccuccgaagguauaaaguacacugauaggaaauggugcuucgacggccagcgcaacaaucagauccuggaggagaacauggauguggaaauuuggaccaaggagggggagaagaagaagcuccgaccuagauggcuggacgcucggacauauucugauccccuugcccugaaagaguuuaaggacuucgcagcuggaaggaaaucgaucgcccucgauuugguuaccgaaauuggccgcgucccaagccaccuggcacauagaacuaggaaugcccuagacaaccuggugaugcuccacacaucagagcauggugggaaggcuuaccggcacgcgguggaggaacuuccugagacgauggaaacccuguuauugcugggccucaugauccugcuuacuggaggcgccaugcuguuucucauauccgggaaaggaaucgguaagacaaguauuggcuugaucugugucauugcaucuagcgggaugcuguggauggcugagauccccuuacaauggauagccuccgccauuguucuagaguucuuuaugauggugcugcucaucccagaaccugagaagcagcguaccccgcaggauaaucaacuugcauauguagugauuggaauccugaccuuggcugccauaaucgcggcuaacgaaaugggccugcucgagacaacuaaacgcgaccuggguaugucaaaggaacccggggucgugucuccaauuagcuaccuugauguugaccuccacccugccagugcauggacgcuguacgccguggcuaccacagucaucacucccauguugcgacauaccauugaaaauuccacagcaaacguaagccuggccgcgaucgcuaaccaggccgugguuuuaaugggccuagacaaaggauggccaauaucuaagauggaucugggcgugccucuccuugcacuggggugcuauucacaggucaaucccuugacccugacugccgcugugcuccugcuuauuacgcacuacgccaucaucggaccgggcuuacaggcaaaagcuacaagagaggcccaaaagaggaccgcggccgguauuaugaagaacccaacugucgacgggaucaugaccauagaucuggacccugugauuuaugauuccaaauucgagaagcagcucggacagguuauguugcuggugcuaugugcaguacagcugcuccuuaugcggacaaguugggcucugugcgaggccuugacucuggcaaccggccccaucacaacgcucugggaagguagcccaggcaaauuuuggaauaccacuauugcugugucgauggccaacaucuuccgcgggucuuaccuggccggagcgggcuuagcuuuuuccauaaugaaaagcgucgggacaggaaaaagaggcaccgguucacaaggggagacucuuggagaaaaguggaagaaaaagcugaaucagcucaguaggaaagaguucgaccuauauaagaaaucuggcaucacagagguugaucggaccgaagcaaaggagggucugaaacgaggcgaaauuacgcaucacgccguguccagagggagcgcuaaguugcagugguuugucgagcgcaacauggugauccccgaaggaaggguaauugaccugggcugugggcggggaggcuggucauacuauugcgccggucucaagaaagugaccgagguucguggguacacaaagggaggcccuggccaugaggaaccggugcccaugaguacuuacggguggaauaucgucaaacuuaugagcggaaaggauguguucuaucugccaccugagaaaugugacaccuugcugugcgauauuggugaauccucucccagcccuacagucgaggaguccagaacuaucagggugcucaagaugguugaaccaugguuaaagaacaaucaguucuguauaaaaguacugaaccccuacaugccuaccgugauugagcaccuugaacgccugcaacggaagcacggcgggaugcuaguccgaaauccacucucaagaaacucuacacaugagauguauuggaucaguaauggaaccggcaacaucguggcaucgguuaauauggugagcaggcuguugcugaaccgcuuuacuaugacgcaccggagacccacaauugaaaaagacgucgaucucggugccgggacccgucaugugaacgcugagccggagacuccuaauauggacguaauaggagaaaggaucaagcggauuaaagaggaacacaacuccaccuggcacuacgacgaugagaauccauauaagacaugggcguaccauggcucuuaugaagugaaggccacgggcucagcaagcuccaugaucaacgggguugucaaacuucugaccaagcccugggacguggugccuauggucacucagauggcuaugacagauaccacuccauucggacagcaacgcguuuuuaaagagaagguggacacacgaacccccagaaguaugccggguacaaggcggguaaugggcauuacugccgagugguuauggcgcacccuggggagaaauaaaaagccuagguugugcacgcgagaagaguucaccaagaaagugcggacaaacgcagccaugggagcugucuuuacugaagagaaucagugggauucugccaaggcggcaguggaagacgaggauuucuggaaacucguugaccgugagagagaacugcacaagcuaggcaaaugugguagcugcguguacaacaugauggggaagcgcgagaagaaacuuggagaauuuggcaaagccaaaggcucaagggcuaucugguacauguggcugggggcccgguaucucgaguucgaggcacugggauuuuugaaugaagaucauugguucuccagagagaacaguuacagcggugucgaaggcgaggggcugcacaagcucggauauauacuucgcgacaucucuaaaauucccggcggugcuauguacgccgaugacaccgcugggugggacacaaggaucacugaagaugaccugcauaaugaggagaagauuacccagcagauggauccagaacaccgacaauuagccaacgcaaucuuuaaacugacguaucagaauaaggugguaaagguucagcggccuacacccaccggaacugugauggacauaauuuccagaaaagaucagaggggcucaggccaagucgggacauacggauugaacaccuucacuaauauggaggcgcagcucauccgccagauggaaggugagggcgugcugagcaaggccgaccuagaaaacccacaccuucccgagaaaaagaucacccaguggcuggagacaaaagggguggaacgucucaagcggauggcuauuucgggagaugacugcgucguuaagccuauagaugacagauuugccaacgcacuguuggcuuuaaaugauaugggcaaagugaggaaggacaucccacaauggcagccgucuaaagguuggcaugauuggcagcagguacccuucuguagucaccauuuccacgagcugauuaugaaggacgggcgcaaacucguggucccuugccgaccacaagacgaacuuaucggacgggccagaauuucccagggcgcaggcuggagccugagggagacggccugucuagggaaggcguaugcucagauguggucacugauguacuuucaccgcagagaucuccgguuggccuccaacgcaaucugcucugccgugcccguucauugggugccuaccagcaggacuacauggaguauacacgcucaucaccaauggaugaccacugaagacaugcugacagucuggaaucguguguggaucgaggauaacccauggauggaggacaagacccccguaacgacaugggaaaauguuccuuaccuuggaaaacgagaggaucaguggugugguucccugauuggccucaccagccgcgccacuugggcacagaacaucccgaccgcuauucagcaagugagaucuuuaaucgggaaugaagaguuccuggacuauaugccaucaaugaagcgguuuaggaaagaggaagagagugaaggagccauuugguga

SEQ ID NO: 15500 - RNA, 9873 nt, Artificial Sequence
  derived and/or modified CDS sequence (opt3) from DENV-3__FJ639768__SS-prME
accagccugugccucaugaugauccuuccagccgcucuggcauuccacuugacauccagggacggcgaaccuaggaugauuguggggaagaacgaacggggaaaaucuuuacuguuuaagacugccucagguauaaauauguguacgcuaaucgcgauggaucucggcgagaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucucucugaaggauaccuuaaagcguagaagcuggccacucaaugaaggggugauggccguuggacuggugucaauccuugcaaguucccuguugaggaacgacgucccuauggccggcccccucguggcuggugggcugcuaauugcauguuacguaaucacgggaacaucugccgaucugaccguggagaaagcggcugacgucacuugggaagaggaagccgagcagacaggcguuagccauaaccuuaugauaaccguggacgaugacggcacuaugcgcauuaaggaugacgagacagaaaauauccucaccgugcuguugaaaacggcauuacugaucgucuccgggauuuuuccauacucaauaccggccacucuccugguguggcacaccuggcagaagcagacacaacggagcggaguucuuugggauguaccuagucccccagagacccagaaagcugaacuggaggaggguguguauagaaucaagcagcagggcauuuucgggaaaacacaagucggagugggcguucagaaggaagguguguuucauacuauguggcacgucaccagaggggccguguugacguacaacggaaagcgacuagagcccaauugggcaucugucaagaaggaccugaucuccuauggcggcggguggcgccucaacgcucaguggcaaaaaggagaagagguccaggugauugccguugaaccugguaagaaucccaagaauuuccagacaaugcccggcacuuuccagaccacaaccggggagaucggagcgauagcccuggauuuuaagccuggcacuagcgguucgccgaucauuaaucgggaggggaagguggucggacuuuacggcaacggcgugguuaccaaaaaugggggauaugugucagguaucgcacaaacaaacgcugaaccagacggccccacgccugaguuagaagaggaaauguucaagaaaagaaaucugacuauuauggaucuccacccagggucuggaaagaccaggaaauacuugcccgccaucguccgugaggcuauaaagcgccggcugagaacacucauucuggcaccuaccagggugguagccgccgagauggaagaggcucuuaagggccugccgauccgauaucagacuacagcgaccaaaagugaacauacgggucgggagaucguggacuugaugugccacgcaacuuuuacaaugcgccuacugucccccguuagagucccaaacuacaaucucauuaucauggaugaagcccauuucaccgacccugcuagcauagccgcaaggggguacauuucuacccgggugggaaugggcgaggccgcugcgaucuuuaugacugccacacccccaggcaccgcagaugcuuucccucagagcaacgcccccauucaggacgaggaacgagacaucccagagagauccuggaacucagggaacgaauggauaacagauuuugcaggaaagacugugugguucgucccgaguauuaaagccgguaacgacaucgcuaauuguuuacgcaagaacggcaaaaagguaauccaacugagcaggaagacguuugauaccgaguaucagaaaacaaaacuuaaugacugggauuucgugguuacuaccgacauuucugagaugggggccaacuuuaaagcggaucgugugaucgacccucggagaugccugaagcccgucauucucacagauggaccagaaagggugauauuggcaggccccaucccuguuaccgccgcuuccgccgcucagcgccgagguagaguggggcggaauccacagaaagagaacgaccaauacauuuucacuggccagccccugaauaacgaugaagaccacgcacauuggacggaggccaagaugcuccuggacaauaucaacaccccugaaggaaucauuccggcucuuuucgagccagagagggaaaagucagccgcaauagauggcgaguaucgccuaaaaggggaaagucguaagacauuugucgagcugaugagacggggagacuugcccgugugguuagcgcacaaaguagccagcgaagguaucaaguacacugauaggaaauggugcuucgacggccagcgcaauaaccagauucuggaggagaauauggauguggaaaucuggaccaaggagggggagaaaaagaagcuccgaccuagauggcuggacgcucggacauauuccgauccccuugcccugaaagaguuuaaggacuucgcagcuggaaggaaaucuauugcccucgauuugguuaccgaaaucggccgcgucccaucgcaccuggcacauagaacuaggaacgcccuagacaaucuggugaugcuccacacaagcgagcauggugggaaggcuuaccggcacgcgguggaggaacuuccugagacgauggaaacccuguuauugcugggccucaugauacugcuuacuggaggcgccaugcuguuucucaucucagggaaaggaauugguaagacauccaucggcuugauuugugucaucgcaaguucugggaugcuguggauggcugagauacccuuacaauggauugccagcgccaucguucuagaguucuuuaugauggugcugcucauuccagaaccugagaagcagcguaccccgcaggauaaccaacuugcauauguagugaucggaauacugaccuuggcugccaucauugcggcuaaugaaaugggccugcucgagacaacuaaacgcgaccuggguauguccaaggaacccggggucgugucaccaacgucuuaccuugauguugaccuccacccugccagcgcauggacccuguacgccguggcuacaacugucaucacccccauguugcgacauacaauugagaacaguaccgcaaacguaucccuggccgcgaucgcuaaucaggccgugguuuuaaugggccuagacaaaggauggccaauaagcaagauggaucugggcgugccucuccuugcacuggggugcuauucucaggucaaccccuugacucugacggccgcugugcuccugcuuauuacacacuacgccaucaucggaccgggcuuacaggcaaaagcuaccagagaggcccaaaagaggacugcggccgguauuaugaagaauccaaccgucgacgggaucaugacaauagaucuggacccugugauuuaugauucaaaauucgaaaagcagcucggacagguuauguugcuggugcuaugugcaguacagcugcuccuuaugcggacuuccugggcucugugcgaggccuugacccuggcaacaggccccaucacgacccucugggaagguaguccaggcaaauuuuggaacacuacaauugcugugagcauggccaauaucuuccgcgggucguacauagccggagcgggccuggcuuuuucuaucaugaaguccgucgggaccggaaaaagaggcacugguagccaaggggagacauuaggagaaaaguggaagaagaaacuuaaccagcugucaaggaaagaguucgaccucuauaagaaaaguggcauuaccgagguugaucggacggaagcaaaagagggucuaaaacgaggcgaaaucacccaucacgccgugucuagaggguccgcuaagcugcagugguuugucgagcgcaauauggugauucccgaaggaaggguaaucgacuugggcugugggcggggaggcuggagcuacuauugcgccggucugaagaaagugacagagguucguggguacacuaagggaggcccuggccaugaggaaccggugcccaugucaaccuacggguggaacauugucaaacucaugaguggaaaggauguguucuaucuuccaccugagaaaugugacacacuguugugcgauaucggugaaagcucccccucuccuacugucgaggagagcagaaccauaagggugcugaagaugguugaaccauggcucaagaauaaccaguucuguauuaaaguauuaaaucccuacaugccuacagugaucgagcaccuggaacgccuucaacggaagcacggcgggaugcugguccgaaacccacuauccagaaauucaacccaugagauguauuggaucucuaacggaacuggcaauauuguggcaaguguuaacauggugucgaggcuccuguugaaccgcuuuacgaugacacaccggagacccaccauagaaaaagacgucgaucugggugccgggacucgucaugugaaugcugagccggagaccccuaacauggacguaaucggagaaaggauuaagcggaucaaagaggaacacaauagcacauggcacuacgacgaugagaacccauauaagacgugggcguaccauggcuccuaugaagugaaggccaccggcucugcaucaagcaugauuaaugggguugucaaacuccuuacuaagcccugggacguggugccuauggucacacagauggcuaugaccgauacuacaccauucggacagcaacgcguuuuuaaagagaagguggacacccgaacacccagauccaugccggguacuaggcggguaaugggcaucaccgccgaguggcuguggcgcacguuagggagaaacaaaaagccuaggcugugcacccgagaagaguucacaaagaaagugcggacuaaugcagccaugggagcugucuuuaccgaagagaaccagugggauagugccaaggcggcaguggaagacgaggauuucuggaaauugguugaccgugagagagaacuccacaagcugggcaaaugugguucuugcguguacaauaugauggggaagcgcgagaaaaagcuaggagaauuuggcaaggccaaaggcagcagggcuauaugguacauguggcuuggggcccgguaucuggaguucgaggcacucggauuucugaacgaagaucauugguucucaagagaaaauuccuacaguggugucgagggcgagggguugcacaagcugggauauauccuccgcgacauuagcaaaauccccggcggugcuauguacgccgaugacacagcugggugggacacuaggauuaccgaagaugaccuucauaacgaggagaagaucacgcagcagauggauccagaacaccgacaacuggccaaugcaauauuuaaauuaacauaucagaacaaggugguaaagguucagcggccuacccccacuggaacagugauggacauuaucucuagaaaagaucagaggggcuccggccaagucgggaccuacggacugaauacuuucaccaacauggaggcgcaguugauccgccagauggaaggugagggcgugcucucaaaggccgaccuggaaaacccacaccuacccgagaaaaagauuacacaguggcuugagacgaaagggguggaacgucugaagcggauggcuauaagcggagaugacugcgucguuaagccuaucgaugacagauuugccaaugcacuccuggcuuugaacgauaugggcaaagugaggaaggacauuccacaauggcagccgucgaaagguuggcaugauuggcagcagguacccuucuguucucaccauuuccacgaguuaaucaugaaggacgggcgcaaacugguggucccuugccgaccacaagacgaacucauuggacgggccagaaucagucagggcgcaggcuggucccuuagggagaccgccugucuggggaaggcguaugcucagauguggagccuaauguacuuucaccgcagagaucugcggcucgccucaaaugcaauaugcuccgccgugcccguucauugggugccuacuucuaggacaaccuggagcauccacgcucaucaccaauggaugacuacagaagacauguugaccgucuggaaccguguguggauugaggauaauccauggauggaggacaagacgcccguaacaaccugggaaaacguuccuuaccugggaaaacgagaggaucaguggugugguagucuuaucggccugacuucccgcgccaccugggcacagaauauuccgacagcuauccagcaagugagaagccucauugggaacgaagaguucuuagacuauaugccaucuaugaagcgguuuaggaaagaggaagagucagaaggagccauaugguga

SEQ ID NO: 15501 - RNA, 9873 nt, Artificial Sequence
  derived and/or modified CDS sequence (opt3) from DENV-3__FJ639769__SS-prME
accagccugugccucaugaugauccuuccagccgcucuggcauuccacuugacauccagagacggcgagccuaggaugauuguggggaagaacgaacggggaaaaucuuuacuguuuaagacugccucagguauaaauauguguacgcuaaucgcgauggaucucggcgaaaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucucucugaaggauaccuuaaagcguagaagcuggccacucaaugaaggggugauggccguuggacuggugucaauccuugcaaguucccuguugaggaacgacgucccuauggccggcccccucguggcuggugggcugcuaauugcauguuacguaaucacgggaacaucugccgaucugaccguggagaaagcggcugacgucacuugggaagaggaagccgagcagacaggcguuagccauaaccuuaugauaaccguggacgaugacggcacuaugcgcauuaaggaugacgagacagaaaauauccucaccgugcuguugaaaacggcauuacugaucgucuccgggauuuuuccauacucaauaccggccacucuccugguguggcacaccuggcagaagcagacacaacggagcggaguucuuugggauguaccuagucccccagagacccagaaagcugaacuggaggaggguguguauagaaucaagcagcagggcauuuucgggaaaacacaagucggagugggcguucagaaggaagguguguuucauacuauguggcacgucaccagaggggccguguugacguacaacggaaagcgacuagagcccaauugggcaucugucaagaaggaccugaucuccuauggcggcggguggcgccucagcgcucaguggcaaaaaggagaagagguccaggugauugccguugaaccugguaagaaccccaagaauuuccagacaaugcccggcacuuuccagaccacaaccggggagaucggagcgauagcccuggauuuuaagccuggcacuucggguucaccgaucauuaaccgggaggggaagguggucggacuuuacggcaauggcgugguuaccaaaaacgggggauaugugucugguaucgcacaaacaaaugcugaaccagacggccccacgccugaguuagaagaggaaauguucaagaaaagaaaccugacuauuauggaucuccacccagggaguggaaagaccaggaaauacuugcccgccaucguccgugaggcuauaaagcgccggcugagaacacucauucuggcaccuaccagggugguagccgccgagauggaagaggcucuuaagggccugccgauccgauaucagacuacagcgaccaaauccgaacauacgggucgggagaucguggacuugaugugccacgcaacuuuuacaaugcgccuacugagccccguuagagucccaaauuacaaccucauuaucauggaugaagcccauuucaccgacccugcuucuauagccgcaaggggguacauuagcacccgggugggaaugggcgaggccgcugcgaucuuuaugacugccacacccccaggcaccgcagaugcuuucccucaguccaaugcccccauucaggacgaggaacgagacaucccagagagaucauggaacagugggaaugaauggauaacagauuuugcaggaaagacugugugguucgucccgagcauuaaagccgguaacgacaucgcuaacuguuuacgcaagaauggcaaaaagguaauccaacugucuaggaagacguuugauaccgaguaucagaaaacaaaacuuaacgacugggauuucgugguuacuaccgacauuuccgagaugggggccaauuuuaaagcggaucgugugaucgacccucggagaugccugaagcccgucauucucacagauggaccagaaagggugauauuggcaggccccaugccuguuaccgccgcuucagccgcucagcgccgagguagaguggggcggaacccacagaaagagaaugaccaauacaucuucacuggccagccccugaacaaugaugaagaccacgcacauuggacggaggccaagaugcuccuggacaacauuaauaccccugaaggaaucaucccggcucuuuucgagccagagagggaaaagagugccgcaauugauggcgaguaucgccuaaaaggggaaagccguaagacauuugucgagcugaugagacggggagacuugcccgugugguuagcgcacaaaguagccuccgaagguauaaaguacacugauaggaaauggugcuucgacggccagcgcaacaaucagauccuggaggagaacauggauguggaaauuuggaccaaggagggggagaaaaagaagcuccgaccuagauggcuggacgcucggacauauucugauccccuugcccugaaagaguuuaaggacuucgcagcuggaaggaaaucgaucgcccucgauuugguuaccgaaauuggccgcgucccaacucaccuggcacauagaacaaggaaugcccuagacaaccuggugaugcuccacacgagcgagcauggugggaaggcuuaccggcacgcgguggaggaacuuccugagaccauggaaacucuguuauugcugggccucaugauccugcuuacaggaggcgccaugcuguuucucauaucagggaaaggaaucgguaagaccuccauuggcuugaucugugucauugcaaguucugggaugcuguggauggcugagauccccuuacaauggauagccagcgccauuguucuagaguucuuuaugauggugcugcucaucccagaaccugagaagcagcguaccccgcaggauaaucaacuugcauauguagugauuggaauccugacauuggcugccauaaucgcggcuaacgaaaugggccugcucgagacuacgaaacgcgaccuggguauguccaaggaacccggggucgugucaccaaccucuuaccuugauguugaccuccacccugccagcgcauggacacuguacgccguggcuacuaccgucauuacacccauguugcgacauaccaucgagaauaguacugcaaacguaucccuggccgcgauugcuaaccaggccgugguuuuaaugggccuagacaaaggauggccaaucagcaagauggaucugggcgugccucuccuugcacuggggugcuauucucaggucaaucccuugacgcugacagccgcugugcuccugcuuauaacccacuacgccauuaucggaccgggcuuacaggcaaaagcuacuagagaggcccaaaagaggaccgcggccgguaucaugaagaacccaacagucgacgggauuaugacuaucgaucuggacccugugauauaugauucaaaauucgaaaagcagcucggacagguuauguugcuggugcuauguguagugcagcugcuccuuaugcggaccuccugggcacugugcgaggcuuugacacuggccacgggccccauuaccacucucugggaagguaguccaggcaaauuuuggaauacaaccaucgcagucagcauggcuaacauuuuccgcgggucguaccuggccggagccggcuuagcguuuucuaucaugaaguccguugggacuggaaaaagaggcacagguagccaaggggagacccuuggagaaaaguggaagaaaaagcugaaucagcucucaaggaaagaguucgaccuauauaagaaaaguggcauaacggagguggaucggaccgaagcuaaggagggucugaaacgaggcgaaaucacacaucacgcagucucuagaggguccgccaaguugcagugguuuguggagcgcaacaugguaauucccgaaggaagggugaucgaccugggcugugggcggggaggcuggagcuacuauugcgcuggucucaagaaaguuacugaggugcguggguacaccaagggaggcccuggccaugaggaaccgguccccaugucaacauacggguggaauauugugaaacuuaugaguggaaaggaugucuucuaucugccaccugagaaaugugacacuuugcugugcgauaucggugaaagcucccccucuccuaccguggaggagagcagaacaauuaggguucucaagaugguagaaccaugguuaaagaacaaucaguucuguaucaaagugcugaaccccuacaugccuaccgucauagagcaccuugaacgccugcaacggaagcacggcgggaugcuagugcgaaauccacucuccagaaacucaacucaugagauguauuggauuucuaauggaacgggcaacaucguugccagugugaauauggucucgaggcuguugcugaaccgcuuuacaaugacccaccggagacccacuaucgaaaaagacguggaucucggugcagggacccgucauguaaacgccgagccggagacaccuaauauggacgugauuggagaaaggauaaagcggaucaaagaggaacacaacagcacguggcacuacgacgaugagaauccauauaagaccugggcuuaccauggcuccuaugaaguuaaggcgacuggcucugccucaagcaugauuaacggggucgugaaacuucugacaaagcccugggacguggucccuaugguuacccagauggcaaugacugauacaaccccauucggacagcaacgcguguuuaaagagaagguagacacacgaacucccagauccaugccggguaccaggcgggugaugggcaucacggcugagugguuauggcgcacccuggggagaaauaaaaagccuagguugugcacacgagaagaguucacuaagaaaguccggaccaacgccgcaaugggagccguguuuacagaagagaaucagugggauagugcuaaggccgcgguugaagacgaggauuucuggaaacucguggaccgugagagagaacugcacaagcuaggcaaaugugguucuugcgucuacaacaugauggggaagcgcgagaagaaacuuggagaauuuggcaaagcaaaaggcagcagggccauuugguacauguggcugggggcucgguaucucgaguucgaggcccugggauuuuugaaugaagaucauugguucucaagagagaacuccuacagugguguggaaggcgaggggcugcacaagcucggauauauccuucgcgacauaagcaaaauccccggcggugcaauguacgcugaugacacugccgggugggacaccaggauuacggaagaugaccugcauaaugaggagaagaucacacagcagauggauccagaacaccgacaauuagcuaacgccauuuuuaaacugaccuaucagaauaagguaguuaaggugcagcggccuacucccacaggaaccgucauggacaucauaucuagaaaagaucagaggggcuccggccaaguggggacuuacggauugaacaccuucacaaauauggaggcacagcucauucgccagauggaaggugagggcgugcugucaaaggcggaccuagaaaacccacaccuucccgagaaaaagaucacgcaguggcuggagaccaaaggggucgaacgucucaagcggauggccaucagcggagaugacugcguugugaagccuauugaugacagauuugcuaacgcccuguuggcauuaaaugauaugggcaaaguaaggaaggacauaccacaauggcagccgucgaaagguuggcaugauuggcaacaggugcccuucuguucucaccauuuccacgagcugaucaugaaggacgggcgcaaacucgucgugccuugccgaccacaagacgaacuuauuggacgggcuagaaucagucagggcgccggcuggucccugagggagacugcaugucuagggaaggccuaugcgcagauguggagccugauguacuuucaccgcagagaucuccgguuggcuucaaacgccauuugcuccgcaguucccgugcauugggucccuacaucuaggaccacuuggagcauccacgcccaucaccaauggaugacaaccgaagacaugcugacgguguggaaucguguauggauagaggauaacccauggauggaggacaagacacccguuaccacuugggaaaaugugccuuaccuuggaaaacgagaggaucaguggugugguagucugaucggccucaccucccgcgcuacaugggcccagaacauuccgacugcaauccagcaagucaggagcuuaauugggaaugaagaguuccuggacuauaugccaucuaugaagcgguuuaggaaagaggaagagucagaaggagcuaucugguga

SEQ ID NO: 15502 - RNA, 9873 nt, Artificial Sequence
  derived and/or modified CDS sequence (opt3) from DENV-3__FJ882577__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgaaaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggauuuucuuuaccuucgugcuacugcucuccggacagaucacguggcgggauauggcucacacucugauuaugauaggcaguaaugccagcgacagaauggguauggggguuaccuaccuugcauugaucgccacauuuaagauucagcccuuccuggcuuuaggauuuuuccucaggaaacugaccucucgcgagaaccuucugcuaggcgugggccucgcgauggccacuacacugcaauugccggaagauaucgagcagauggcaaaugggauugcucugggauuaauggcccucaagcugaucacccaguuugagacauaucagcuuuggacugcccugauauccuugaccuguucaaacacgaucuucacacucaccgucgcuuggcgaacugcaacccugauucuagccggugugagucugcuuccuguuugccaaagcucguccaugcggaaaacagacuggcucccaaugacuguggcggcuaugggcgucccaccucugcccuuguuuaucuucucucugaaggauaccuuaaagcguagaagcuggccacucaaugaagggguaauggccgugggacugguuucaauucuugcaaguucccuguugaggaacgacgugccuauggccggcccccucgucgcuggugggcugcuaaucgcauguuacgugauaacgggaacaucugccgaucugaccguagagaaagcggcugacgugacuugggaagaggaagccgagcagacaggcgucagccauaaccuuaugauuaccguugacgaugacggcacuaugcgcaucaaggaugacgagacagaaaauauccucaccgugcuguugaaaacggcauuacugauuguguccgggauauuuccauacucaaucccggccacucuccuggucuggcacaccuggcagaagcagacacaacggagcggagugcuuugggauguuccuagucccccagagacccagaaagcugaacuggaggaggguguauauagaauuaagcagcagggcaucuucgggaaaacacaagugggagucggcgugcagaaggaagguguuuuucauacuauguggcacgugaccagaggggccgucuugacguacaacggaaagcgacuagagcccaauugggcaucugugaaaaaggaccugauuuccuauggcggcggguggcgccucagcgcucaguggcaaaaaggagaagagguacaggucaucgccguggaaccugguaagaaccccaagaauuuccagacaaugcccggcacuuuccagaccacaaccggggagauaggagcgaucgcccuggauuuuaagccuggcacuucggguucaccgauuaucaaccgggaggggaagauuguuggacuuuacggcaauggcguggucaccaaaaacgggggauaugugucugguaucgcacaaacaaaugcugaaccagacggccccacgccugaguuagaagaggaaauguucaagaaaagaaaccugacuauaauggaucuccacccagggaguggaaagaccaggaaauacuugcccgccauuguucgugaggcuaucaagcgccggcugagaacacucauccuggcaccuaccaggguggucgccgccgagauggaagaggcucuuaagggccugccgauucgauaucagacuacagcgaccaaauccgaacauacgggucgggagaucguggacuugaugugccacgcaacuuuuacaaugcgccuacugagccccguaagagugccaaauuacaaccucauaauuauggaugaagcccauuucaccgacccugcuucuaucgccgcaaggggguacauuagcacccggguuggaaugggcgaggccgcugcgaucuuuaugacugccacacccccaggcaccgcagaugcuuucccucaguccaaugcccccauacaggacgaggaacgagacauuccagagagaucauggaacagugggaaugaauggaucacagauuuugcaggaaagacugucugguucgugccgagcaucaaagccgguaacgacauugcuaacuguuuacgcaagaauggcaaaaaggugauccaacugucuaggaagacguuugauaccgaguaucagaaaacaaaacuuaacgacugggauuucgucguaacuaccgacauuuccgagaugggggccaauuuuaaagcggaucgugugauagacccucggagaugccugaagcccguuauccucacagauggaccagaaagggugauuuuggcaggccccaugccugucaccgccgcuucagccgcucagcgccgagguagaguggggcggaacccacagaaagagaaugaccaauacaucuucacuggccagccccugaacaaugaugaagaccacgcacauuggacggaggccaagaugcuccuggacaacaucaauaccccugaaggaauuauaccggcucuuuucgagccagagagggaaaagagugccgcaaucgauggcgaguaucgccuaaaaggggaaagccguaagacauuuguugagcugaugagacggggagacuugcccgugugguuagcgcacaaagucgccuccgaagguauuaaguacacugauaggaaauggugcuucgacggccagcgcaacaaucagauccuggaggagaacauggauguggaaauuuggaccaaggagggggagaagaagaagcuccgaccuagauggcuggacgcucggacauauucugauccccuugcccugaaagaguuuaaggacuucgcagcuggaaggaaaucgaucgcccucgauuugguaaccgaaauaggccgcgugccaacucaccuggcacauagaacaaggaaugcccuagacaaccugguuaugcuccacacgagcgagcauggugggaaggcuuaccggcacgcggucgaggaacuuccugagaccauggaaacucuguuauugcugggccucaugauccugcuuacaggaggcgccaugcuguuucucauuucagggaaaggaaucgguaagaccuccauuggcuugaucugugugauagcaaguucugggaugcuguggauggcugagauucccuuacaauggaucgccagcgccauugugcuagaguucuuuaugaugguccugcucaucccagaaccugagaagcagcguaccccgcaggauaaucaacuugcauauguugugauaggaauccugacauuggcugccauuaucgcggcuaacgaaaugggccugcucgagacuacgaaacgcgaccuggguauguccaaggaacccgggguagugucaccaaccucuuaccuugaugucgaccuccacccugccagcgcauggacacuguacgccguggcuacuaccguuauuacacccauguugcgacauaccaucgagaauaguacugcaaacgugucccuggccgcgauagcuaaccaggccgucguauuaaugggccuagacaaaggauggccaauuagcaagauggaucugggcgugccucuccuugcacuggggugcuauucucagguuaaucccuugacgcugacagccgcugugcuccugcuuaucacccacuacgccaucauuggaccgggcuuacaggcaaaagcuacuagagaggcccaaaagaggaccgcggccgguaucaugaagaacccaacagucgacgggauaaugacuauugaucuggacccugugaucuaugauucaaaauucgaaaagcagcucggacaggucauguugcuggugcuaugugcaguucagcugcuccuuaugcggaccuccugggcucugugcgaggccuugacacuggcaacgggccccauuaccacucucugggaagguaguccaggcaaauuuuggaauacaaccaucgcugugagcauggccaacauauuccgcgggucguaccuggccggagcgggcuuagcuuuuucuaucaugaaguccguagggacuggaaaaagaggcacagguagccaaggggagacccuuggagaaaaguggaagaaaaagcugaaucagcucucaaggaaagaguucgaccuauauaagaaaaguggcauuacggagguggaucggaccgaagcaaaggagggucugaaacgaggcgaaaucacacaucacgccgucucuagaggguccgcuaaguugcagugguuuguugagcgcaacauggugauucccgaaggaagggucaucgaccugggcugugggcggggaggcuggagcuacuauugcgccggucucaagaaagugacugagguacguggguacaccaagggaggcccuggccaugaggaaccggugcccaugucaacauacggguggaauauuguuaaacuuaugaguggaaaggauguguucuaucugccaccugagaaaugugacacuuugcugugcgauaucggugaaagcucccccucuccuaccgucgaggagagcagaacaauaagggugcucaagauggucgaaccaugguuaaagaacaaucaguucuguauuaaagugcugaaccccuacaugccuaccguuaucgagcaccuugaacgccugcaacggaagcacggcgggaugcuaguacgaaauccacucuccagaaacucaacucaugagauguauuggaucucuaauggaacgggcaacauuguggcaagugucaauauggugucgaggcuguugcugaaccgcuuuacaaugacccaccggagacccacuauagaaaaagacguugaucucggugccgggacccgucaugugaacgcugagccggagacaccuaauauggacgucaucggagaaaggauuaagcggaucaaagaggaacacaacagcacguggcacuacgacgaugagaauccauauaagaccugggcguaccauggcuccuaugaagugaaggccacuggcucugcaucaagcaugauuaacgggguagugaaacuucugacaaagcccugggacguugucccuauggugacccagauggcuaugacugauacaaccccauucggacagcaacgcguguuuaaagagaaggucgacacacgaacucccagauccaugccggguaccaggcggguuaugggcaucacggccgagugguuauggcgcacccuggggagaaauaaaaagccuagguugugcacacgagaagaguucacuaagaaagugcggaccaacgcagccaugggagcuguauuuacagaagagaaucagugggauagugccaaggcggcaguggaagacgaggauuucuggaaacucgucgaccgugagagagaacugcacaagcuaggcaaaugugguucuugcguguacaacaugauggggaagcgcgagaagaaacuuggagaauuuggcaaagccaaaggcagcagggcuauaugguacauguggcugggggcccgguaucucgaguucgaggcacugggauuuuugaaugaagaucauugguucucaagagagaacuccuacagugguguugaaggcgaggggcugcacaagcucggauauauccuucgcgacauuagcaaaauccccggcggugcuauguacgccgaugacacugcugggugggacaccaggauuacggaagaugaccugcauaaugaggagaagaucacacagcagauggauccagaacaccgacaauuagccaacgcaauauuuaaacugaccuaucagaauaagguggucaaggugcagcggccuacucccacaggaaccguaauggacauuaucucuagaaaagaucagaggggcuccggccaaguugggacuuacggauugaacaccuucacaaauauggaggcgcagcucauccgccagauggaaggugagggcgugcugucaaaggccgaccuagaaaacccacaccuucccgagaaaaagauuacgcaguggcuggagaccaaaggggucgaacgucucaagcggauggcuauaagcggagaugacugcguggugaagccuaucgaugacagauuugccaacgcacuguuggcuuuaaaugauaugggcaaagucaggaaggacauuccacaauggcagccgucgaaagguuggcaugauuggcagcagguucccuucuguucucaccauuuccacgagcugaucaugaaggacgggcgcaaacucgugguaccuugccgaccacaagacgaacuuauuggacgggccagaaucagucagggcgcaggcuggucccugagggagacugccugucuagggaaggcguaugcucagauguggagccugauguacuuucaccgcagagaucuccgguuggccucaaacgcaauaugcuccgccgugcccguccauugggugccuacaucuaggaccacuuggagcauccacgcucaucaccaauggaugacaaccgaagacaugcugacgguuuggaaucguguguggauugaggauaacccauggauggaggacaagacacccgucaccacuugggaaaaugugccuuaccuuggaaaacgagaggaucaguggugugguagucugaucggccucaccucccgcgccacaugggcacagaacauuccgacugcuauccagcaaguaaggagcuuaauugggaaugaagaguuccuggacuauaugccaucuaugaagcgguuuaggaaagaggaagagucagaaggagccauaugguga

SEQ ID NO: 15503 - RNA, 9873 nt, Artificial Sequence
  derived and/or modified CDS sequence (opt3) from DENV-3__FJ850096__SS-prME
accagccugugccucaugaugauccuucccgccgcucuggcauuccacuugacauccagggacggcgaaccuaggaugauuguggggaagaacgaacggggaaagucuuuacuguuuaagacugccucagguauaaauauguguacgcugaucgcgauggaucucggcgagaugugcgacgauaccgucacauacaaguguccacacauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggccuguugcucacguggaucgggcuaaauuccaagaacacaucaaugaguuuuagcugcauugcgauaggaaucauuaccuuauaucugggcgcugugguucaggccgacauggguugugucaucaauuggaaagggaaggagcuaaagugcggauccggcauuuucgugacuaacgaggugcauacauggaccgaacaguacaaauuucaagcagauucucccaagcggcucgccacugcuaucgccggugcaugggagaauggcgucugugggauacgaagcaccacacgcauggaaaaccugcuuuggaaacagaucgcuaaugaguugaacuauauucugugggaaaauaacaucaagcucacgguuguggugggagacauuaucggcguacuggagcaggggaaaagaaccuuaacuccacagccuauggagcugaaguacucauggaaaacauggggaaaggccaagauagucaccgcggaaacacaaaacaguuccuucauuaucgauggccccaauacuccagagugccccagcgccucuagggcuuggaacgugugggaaguugaggacuaugguuuugggguguucaccacgaauauuuggcuuaaauugcgggaagucuacacacagcucugugaccaccgccugaugucagcagccgugaaggaugagagagcuguucacgccgacaugggauacuggaucgagagucagaaaaacggcagcuggaagcuagaaaaagcaucccugauagaggugaagaccugcacuuggccuaagucucauacccucuggucgaaugguguacuggaaagcgauaugaucauuccaaaaucccuugcgggcccgaucucacagcacaacuauaggcccggguaccauacacaaacugccggaccuuggcacuugggcaagcuggaguuagacuuuaauuauugcgaggggaccacagucgugauuacggaaaacuguggaacccguggcccaagucuccggacuacaaccgugucugguaaacugauccacgaguggugcugucgaagcugcacucuucccccucugagauacaugggggaagauggauguugguauggcauggagauaaggccaauuuccgaaaaggaggagaauauggucaaaucauugguuagcgcugguucuggcgaaguggacaacuucacaauggggguacucugccuggccauccuauuugaggaagugaugcgcggaaaguucggcaagaaacauaugaucgcaggggucuucuuuaccuucgugcugcuccuguccggacagauuacguggcgggauauggcucacacucuuaucaugauuggcaguaaugccagcgacagaauggguauggggguuaccuacuuggcacugauagccacauuuaagauccagcccuucuuagcucucggauuuuuccugaggaaacuuaccucucgcgagaaccugcuacucggcgugggccuggcgauggccacuacauugcaacugccggaagauauugagcagauggcaaaugggaucgcuuuaggacucauggcccugaaacuuauuacccaguuugagacauaucagcuguggacugccuugaucucccucaccuguucaaacacgauauucacacugaccgucgcuuggcgaacugcaacccuaauccuggccggugugagucuucucccuguuugccaaagcucguccaugcggaaaacagacuggcugccaaugacuguggcggcuaugggcgucccaccuuugccccuguuuauuuucucuuuaaaggauacccucaagcguagaagcuggccacugaaugaagggguaauggccgugggacuuguuucaauccuggcaaguuccuugcucaggaacgacgugccuauggccggcccccuggucgcuggugggcuacugauugcauguuacgugaucacgggaacaucugccgaucuuaccguagagaaagcggcugacgugacuugggaagaggaagccgagcagacaggcgucagccauaaccucaugauaaccguugacgaugacggcacuaugcgcauuaaggaugacgagacagaaaauauccugaccguguuguuaaaaacggcacugcucaucguguccgggauuuuuccauacucaauaccggccacucugcuugucuggcacaccuggcagaagcagacacaacggagcggagugcugugggauguuccuagucccccagagacccagaaagcugaauuggaggaggguguauauagaaucaagcagcagggcauuuucgggaaaacacaagugggagucggcgugcagaaggaagguguuuuucauacuauguggcacgugaccagaggggccguccuaacguacaacggaaagcgacuggagcccaauugggcaucugugaaaaaggaccucaucuccuauggcggcggguggcgccugagcgcucaguggcaaaaaggagaagagguacaggucauugccguggaaccugguaagaaccccaagaauuuccagacaaugcccggcacuuuccagaccacaaccggggagaucggagcgauagcccuugauuuuaagccuggcacuucggguucaccgaucauuaaccgggaggggaagguugugggauuauacggcaauggcgucgugaccaaaaacgggggauauguuucugguaucgcacaaacaaaugcugaaccagacggccccacgccugagcuggaagaggaaauguucaagaaaagaaaccucacuauuauggauuugcacccagggaguggaaagaccaggaaauaccugcccgccaucgugcgugaggcuauaaagcgccggcucagaacacugauucuugcaccuaccagggucguggccgccgagauggaagaggcucugaagggcuugccgauccgauaucagacuacagcgaccaaauccgaacauacgggucgggagaucguagaccuaaugugccacgcaacuuuuacaaugcgccugcucagccccgugagaguuccaaauuacaacuuaauuaucauggaugaagcccauuucaccgacccugcuucuauagccgcaaggggguacauuagcacccgggucggaaugggcgaggccgcugcgaucuuuaugacugccacacccccaggcaccgcagaugcuuucccucaguccaaugcccccauucaggacgaggaacgagacaucccagagagaucauggaacagugggaaugaauggauaacagauuuuacuggaaagacggugugguucgugccgagcauuaaagcagguaacgacaucgccaacugucugcgcaagaauggcaaaaaggucauccaacuuucuaggaagaccuuugauacagaguaucagaaaacuaagcugaacgacugggauuucguagugaccacagacauuuccgagaugggggcuaauuuuaaagccgaucguguuaucgacccucggagaugccucaagcccgugauuuugaccgauggaccagaaagggucauacuggcgggccccaugccugugacugcagccucagcugcccagcgccgagguagaguugggcggaacccacagaaagagaaugaccaauacaucuucacgggccagccccucaacaaugaugaagaccacgcucauuggaccgaggcaaagaugcugcuugacaacauuaauacaccugaaggaaucaucccggcccuauucgagccagagagggaaaagagugcugccauugauggcgaguaucgccugaaaggggaaagccguaagacuuuuguggaguugaugagacggggagacuuacccgucuggcuggcacacaaaguggcguccgaagguauaaaguacaccgauaggaaauggugcuucgacggccagcgcaacaaucagauccucgaggagaacauggauguagaaauuuggacaaaggagggggagaagaagaagcugcgaccuagauggcuugacgcccggaccuauucugauccccuggcucucaaagaguuuaaggacuucgccgcaggaaggaaaucgaucgcuuuggaucuggugacugaaauuggccgcguuccaagccaccuagcccauagaacaaggaaugcacuggacaaccucgucaugcuucacacgucagagcauggugggaaggccuaccggcacgcuguggaggaacugccugagaccauggaaacuuuauugcugcucggccugaugauccuucugacaggaggcgcgaugcucuuuuugauauccgggaaaggaaucgguaagaccaguauuggccugaucugugugauugccucuagcgggauguuauggauggcagagaucccccuacaauggauagcuuccgccauuguccuggaguucuuuaugaugguucuccuuaucccagaaccugagaagcagcguaccccgcaggauaaucaacuggccuaugugguaauuggaaucuugacacuggcagcuauaaucgccgcgaacgaaaugggccuccuggagacuacgaaacgcgaccuugguaugucaaaggaacccgggguggucucuccaaccagcuaccucgauguggaccugcacccugcuagugccuggacauuguacgcaguugccacuaccgugauuacacccaugcugcgacauaccaucgaaaauuccacugcuaacgucagcuuagcagccauugcgaaccaggcuguagugcuaaugggccuggacaaaggauggccaaucucuaagauggaucucggcguuccucuucuggccuuggggugcuauucacaggugaauccccugacgcucacagcagccguccugcuuuuaauaacccacuacgcuauuaucggaccgggccugcaggccaaagcaacuagagaggcucaaaagaggaccgccgcggguaucaugaagaacccaacaguggacgggauuaugacuaucgaucucgacccugucauauaugauuccaaauucgagaagcaguugggacaggugaugcugcuaguucugugugccgugcagcuccuucugaugcggaccaguugggcauugugcgaggcucugacacucgccacgggccccauuaccacucugugggaagguagcccaggcaaauuuuggaauacaaccaucgcaguaucgauggcuaacauuuuccgcgggucuuacuuagccggagccggccuugcguuuuccaucaugaaaagcguggggacuggaaaaagaggcacagguucacaaggggagacccugggagaaaaguggaagaaaaagcucaaucagcuaaguaggaaagaguucgaccuguauaagaaaucuggcauaacggaggucgaucggaccgaagcuaaggaggguuugaaacgaggcgaaaucacacaucacgcaguuuccagagggagcgccaagcugcagugguuuguggagcgcaacauggucauucccgaaggaagggugaucgaccucggcugugggcggggaggcuggucauacuauugcgcuggucuuaagaaaguaacugaggugcguggguacaccaagggaggcccuggccaugaggaaccgguucccaugaguacauacggguggaauauugugaaacugaugagcggaaaggaugucuucuauuugccaccugagaaaugugacacucugcucugcgauaucggugaauccucucccagcccuaccguggaggaguccagaacaauuagggucuuaaagaugguggaaccauggcugaagaacaaucaguucuguaucaaaguucuuaaccccuacaugccuaccguaauagagcaccuggaacgccuacaacggaagcacggcgggaugcucgugcgaaauccacugucaagaaacucuacucaugagauguauuggauuaguaauggaacgggcaacaucgucgccucggugaauaugguuagcagguugcugcucaaccgcuuuacaaugacccaccggagacccacuaucgaaaaagacguggaucuuggugcagggacccgucaugucaacgccgagccggagacaccuaauauggacgugauuggagaaaggauaaagcggaucaaagaggaacacaacuccacguggcacuacgacgaugagaauccauauaagaccugggcuuaccauggcucuuaugaaguaaaggcgacuggcucagccagcuccaugauuaacggggugguuaaacuguuaacaaagcccugggacgucgugccuauggugacccagauggcaaugacugauacaaccccauucggacagcaacgcgucuuuaaagagaagguugacacacgaacucccagaaguaugccggguaccaggcgggugaugggcaucacggcugaguggcuguggcgcaccuuggggagaaauaaaaagccuaggcucugcacacgagaagaguucacuaagaaaguacggaccaacgccgcaaugggagccguguuuacagaagagaaucagugggauucugcuaaggccgcggucgaagacgaggauuucuggaaacugguggaccgugagagagaacuacacaaacuuggcaaaugugguagcugcguuuacaacaugauggggaagcgcgagaaaaagcugggagaauuuggcaaggcaaaaggcucaagggccauuugguacauguggcucggggcucgguaucuggaguucgaggccuugggauuucugaaugaagaucauugguucuccagagagaacaguuacagcgguguggaaggcgaggggcuccacaaacuuggauauauccugcgcgacauaucuaaaauccccggcggugcaauguacgcugaugacacugccgggugggacaccaggauuacggaagaugacuuacauaaugaggagaagaucacacagcagauggauccagaacaccgacaacuggcuaacgccauuuuuaaauugaccuaucagaauaaggucgugaagguacagcggccuacucccacaggaaccguuauggacaucauauccagaaaagaucagaggggcucaggccaaguggggacuuacggacucaacaccuucacaaauauggaggcacagcugauucgccagauggaaggugagggcguccuaagcaaggcggaccuugaaaacccacaucugcccgagaaaaagaucacgcaguggcucgagaccaaagggguggaacgucugaagcggauggccaucucgggagaugacugcguggucaagccuauugaugacagauuugcuaacgccuuguuagcacugaaugauaugggcaaaguuaggaaggacauaccacaauggcagccgucuaaagguuggcaugauuggcaacaggugcccuucuguagucaccauuuccacgagcucaucaugaaggacgggcgcaaacuuguagugccuugccgaccacaagacgaacugauuggacgggcuagaaucucccagggcgccggcuggagccuaagggagacugcaugucuggggaaggccuaugcgcagauguggucacucauguacuuucaccgcagagauuugcggcuggcuuccaacgccauuugcucugcaguccccgugcauuggguuccuacaagcaggaccacuuggaguauccacgcccaucaccaauggaugacaaccgaagacaugcuuacgguguggaaucgugucuggauagaggauaacccauggauggaggacaagacacccgugaccacuugggaaaauguaccuuaccugggaaaacgagaggaucaguggugugguucccucaucggcuuaaccagccgcgcuacaugggcccagaacauuccgacugcaauccagcaaguuagaucucugauugggaaugaagaguucuuggacuauaugccaucaaugaagcgguuuaggaaagaggaagagagugaaggagcuaucugguga

SEQ ID NO: 15504 - RNA, 9873 nt, Artificial Sequence
  derived and/or modified CDS sequence (opt3) from DENV-3__FJ882578__SS-prME
accagccugugccucaugaugauccuuccagccgcucuggcauuccacuugacauccagagacggcgagccuaggaugauuguggggaagaacgaacggggaaaaucuuuacuguuuaagacugccucagguauaaauauguguacgcuaaucgcgauggaucucggcgaaaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacaccauuggcguccucgagcaggggaaaagaauccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucucucugaaggauaccuuaaagcguagaagcuggccacucaaugaaggggugauggccguuggacuggugucaauccuugcaaguucccuguugaggaacgacgucccuauggccggcccccucguggcuggugggcugcuaauugcauguuacguaaucacgggaacaucugccgaucugaccguggagaaagcggcugacgucacuugggaagaggaagccgagcagacaggcguuagccauaaccuuaugauaaccguggacgaugacggcacuaugcgcauuaaggaugacgagacagaaaauauccucaccgugcuguugaaaacggcauuacugaucgucuccgggauuuuuccauacucaauaccggccacucuccugguguggcacaccuggcagaagcagacacaacggagcggaguucuuugggauguaccuagucccccagagacccagaaagcugaacuggaggaggguguguauagaaucaagcagcagggcauuuucgggaaaacacaagucggagugggcguucagaaggaagguguguuucauacuauguggcacgucaccagaggggccguguugacguacaacggaaagcgacuagagcccaauugggcaucugucaagaaggaccugaucuccuauggcggcggguggcgccucagcgcucaguggcaaaaaggagaagagguccaggugauugccguugaaccugguaagaaccccaagaauuuccagacaaugcccggcacuuuccagaccacaaccggggagaucggagcgauagcccuggauuuuaagccuggcacuucggguucaccgaucauuaaccgggaggggaagguggucggacuuuacggcaauggcgugguuaccaaaaacgggggauaugugucugguaucgcacaaacaaaugcugaaccagacggccccacgccugaguuagaagaggaaauguucaagaaaagaaaccugacuauuauggaucuccacccagggaguggaaagaccaggaaauacuugcccgccaucguccgugaggcuauaaagcgccggcugagaacacucauucuggcaccuaccagggugguagccgccgagauggaagaggcucuuaagggccugccgauccgauaucagacuacagcgaccaaauccgaacauacgggucgggagaucguggacuugaugugccacgcaacuuuuacaaugcgccuacugagccccguuagagucccaaauuacaaccucauuaucauggaugaagcccauuucaccgacccugcuucuauagccgcaaggggguacauuagcacccgggugggaaugggcgaggccgcugcgaucuuuaugacugccacacccccaggcaccgcagaugcuuucccucaguccaaugcccccauucaggacgaggaacgagacaucccagagagaucauggaacagugggaaugaauggauaacagauuuugcaggaaagacugugugguucgucccgagcauuaaagccgguaacgacaucgcuaacuguuuacgcaagaauggcaaaaagguaauccaacugucuaggaagacguuugauaccgaguaucagaaaacaaaacuuaacgacugggauuucgugguuacuaccgacauuuccgagaugggggccaauuuuaaagcggaucgugugaucgacccucggagaugccugaagcccgucauucucacagauggaccagaaagggugauauuggcaggccccaugccuguuaccgccgcuucagccgcucagcgccgagguagaguggggcggaacccacagaaagagaaugaccaauacaucuucacuggccagccccugaacaaugaugaagaccacgcacauuggacggaggccaagaugcuccuggacaacauuaauaccccugaaggaaucaucccggcucuuuucgagccagagagggaaaagagugccgcaauugauggcgaguaucgccuaaaaggggaaagccguaagacauuugucgagcugaugagacggggagacuugcccgugugguuagcgcacaaaguagccuccgaagguauaaaguacacugauaggaaauggugcuucgacggccagcgcaacaaucagauccuggaggagaacauggauguggaaauuuggaccaaggagggggagaaaaagaagcuccgaccuagauggcuggacgcucggacauauucugauccccuugcccugaaagaguuuaaggacuucgcagcuggaaggaaaucgaucgcccucgauuugguuaccgaaauuggccgcgucccaacucaccuggcacauagaacaaggaaugcccuagacaaccuggugaugcuccacacgagcgagcauggugggaaggcuuaccggcacgcgguggaggaacuuccugagaccauggaaacucuguuauugcugggccucaugauccugcuuacaggaggcgccaugcuguuucucauaucagggaaaggaaucgguaagaccuccauuggcuugaucugugucauugcaaguucugggaugcuguggauggcugagauccccuuacaauggauagccagcgccauuguucuagaguucuuuaugauggugcugcucaucccagaaccugagaagcagcguaccccgcaggauaaucaacuugcauauguagugauuggaauccugacauuggcugccauaaucgcggcuaacgaaaugggccugcucgagacuacgaaacgcgaccuggguauguccaaggaacccggggucgugucaccaaccucuuaccuugauguugaccuccacccugccagcgcauggacacuguacgccguggcuacuaccgucauuacacccauguugcgacauaccaucgagaauaguacugcaaacguaucccuggccgcgauugcuaaccaggccgugguuuuaaugggccuagacaaaggauggccaaucagcaagauggaucugggcgugccucuccuugcacuggggugcuauucucaggucaaucccuugacgcugacagccgcugugcuccugcuuauaacccacuacgccauuaucggaccgggcuuacaggcaaaagcuacuagagaggcccaaaagaggaccgcggccgguaucaugaagaacccaacagucgacgggauuaugacuaucgaucuggacccugugauauaugauucaaaauucgaaaagcagcucggacagguuauguugcuggugcuaugugcaguacagcugcuccuuaugcggaccuccugggcucugugcgaggccuugacacuggcaacgggccccauuaccacucucugggaagguaguccaggcaaauuuuggaauacaaccaucgcugugagcauggccaacauuuuccgcgggucguaccuggccggagcgggcuuagcuuuuucuaucaugaaguccgucgggacuggaaaaagaggcacagguagccaaggggagacccuuggagaaaaguggaagaaaaagcugaaucagcucucaaggaaagaguucgaccuauauaagaaaaguggcauaacggagguugaucggaccgaagcaaaggagggucugaaacgaggcgaaaucacacaucacgccgugucuagaggguccgcuaaguugcagugguuugucgagcgcaacauggugauucccgaaggaaggguaaucgaccugggcugugggcggggaggcuggagcuacuauugcgccggucucaagaaagugacugagguucguggguacaccaagggaggcccuggccaugaggaaccggugcccaugucaacauacggguggaauauugucaaacuuaugaguggaaaggauguguucuaucugccaccugagaaaugugacacuuugcugugcgauaucggugaaagcucccccucuccuaccgucgaggagagcagaacaauuagggugcucaagaugguugaaccaugguuaaagaacaaucaguucuguaucaaaguacugaaccccuacaugccuaccgugauagagcaccuugaacgccugcaacggaagcacggcgggaugcuaguccgaaauccacucuccagaaacucaacucaugagauguauuggauuucuaauggaacgggcaacaucguggcaaguguuaauauggugucgaggcuguugcugaaccgcuuuacaaugacccaccggagacccacuaucgaaaaagacgucgaucucggugccgggacccgucaugugaacgcugagccggagacaccuaauauggacguaauuggagaaaggauaaagcggaucaaagaggaacacaacagcacguggcacuacgacgaugagaauccauauaagaccugggcguaccauggcuccuaugaagugaaggccacuggcucugcaucaagcaugauuaacgggguugucaaacuucugacaaagcccugggacguggugccuauggucacccagauggcuaugacugauacaaccccauucggacagcaacgcguuuuuaaagagaagguggacacacgaacucccagauccaugccggguaccaggcggguaaugggcaucacggccgagugguuauggcgcacccuggggagaaauaaaaagccuagguugugcacacgagaagaguucacuaagaaagugcggaccaacgcagccaugggagcugucuuuacagaagagaaucagugggauagugccaaggcggcaguggaagacgaggauuucuggaaacucguugaccgugagagagaacugcacaagcuaggcaaaugugguucuugcguguacaacaugauggggaagcgcgagaagaaacuuggagaauuuggcaaagccaaaggcagcagggcuauuugguacauguggcugggggcccgguaucucgaguucgaggcacugggauuuuugaaugaagaucauugguucucaagagagaacuccuacaguggugucgaaggcgaggggcugcacaagcucggauauauccuucgcgacauaagcaaaauccccggcggugcuauguacgccgaugacacugcugggugggacaccaggauuacggaagaugaccugcauaaugaggagaagaucacacagcagauggauccagaacaccgacaauuagccaacgcaauuuuuaaacugaccuaucagaauaaggugguaaagguucagcggccuacucccacaggaaccgugauggacaucauaucuagaaaagaucagaggggcuccggccaagucgggacuuacggauugaacaccuucacaaauauggaggcgcagcucauucgccagauggaaggugagggcgugcugucaaaggccgaccuagaaaacccacaccuucccgagaaaaagaucacgcaguggcuggagaccaaagggguggaacgucucaagcggauggcuaucagcggagaugacugcgucguuaagccuauugaugacagauuugccaacgcacuguuggcuuuaaaugauaugggcaaagugaggaaggacauaccacaauggcagccgucgaaagguuggcaugauuggcagcagguacccuucuguucucaccauuuccacgagcugaucaugaaggacgggcgcaaacucguggucccuugccgaccacaagacgaacuuauuggacgggccagaaucagucagggcgcaggcuggucccugagggagacugccugucuagggaaggcguaugcucagauguggagccugauguacuuucaccgcagagaucuccgguuggccucaaacgcaauuugcuccgccgugcccguucauugggugccuacaucuaggaccacuuggagcauccacgcucaucaccaauggaugacaaccgaagacaugcugacggucuggaaucguguguggauagaggauaacccauggauggaggacaagacacccguaaccacuugggaaaauguuccuuaccuuggaaaacgagaggaucaguggugugguagucugaucggccucaccucccgcgccacaugggcacagaacauuccgacugcuauccagcaagugaggagcuuaauugggaaugaagaguuccuggacuauaugccaucuaugaagcgguuuaggaaagaggaagagucagaaggagccaucugguga

SEQ ID NO: 15505 - RNA, 9873 nt, Artificial Sequence
  derived and/or modified CDS sequence (opt3) from DENV-3__FJ639770__SS-prME
accagccugugccucaugaugauccuucccgccgcucuggcauuccacuugacuuccagagacggcgaaccuaggaugauuguggggaagaacgaacggggaaagucuuuacuguuuaagacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaagguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacgucauuggcgugcucgagcaggggaaaagaacccugacuuuacagccaauggagcugaaguacucauggaaaacauggggaaaggccaagaucguuaccgcggaaacacaaaacaguuccuucauaauugauggcccuaauacucccgagugcccaagcgccucuagggcuuggaacgugugggaagucgaggacuaugguuuugggguguucaccacgaauaucuggcuuaaauugcgggaaguuuacacacagcucugugaccaccgccugaugucagcagccgugaaggaugagagagcuguacacgccgacaugggauacuggauugagagucagaaaaacggcagcuggaagcuagaaaaagcaucccugaucgaggucaagaccugcacuuggcccaagucucauacccucuggucgaauggugugcuggaaagcgauaugauaaucccuaaaucccuugcgggcccaauuucacagcacaacuauaggccgggguaccauacacaaacugccggacccuggcacuugggcaagcuggaguuagacuuuaauuauugcgaggggaccacaguggucaucacggaaaacuguggaacccguggcccuagucuccggacuacaaccguuucugguaaacugauucacgaguggugcugucgaagcugcacucuuccaccccugagauacaugggggaagauggauguugguauggcauggagaucaggccuauauccgaaaaggaggagaauauggugaaaucauugguaagcgcugguucuggcgaaguggacaacuucacaauggggguccucugccuggccauucuauuugaggaagugaugcgcggaaaguucggcaagaaacauaugaucgcagggguuuucuuuaccuucgugcugcuccuguccggacagaucacguggcgggauauggcucacacucuuauuaugaucggcaguaaugccagcgacagaauggguaugggggucaccuacuuggcacugauugccacauuuaagauacagccauucuuagcucucggauuuuuccugaggaaacuuaccucucgcgagaaccugcuacucggcgugggccuggcgauggccacuacauugcaacugcccgaagauaucgagcagauggcaaaugggauugcuuuaggacucauggcccugaaacuuaucacccaguuugagacauaucagcuguggacugccuugauuucccucaccuguucaaacacgaucuucacacugaccguugcuuggcgaacugcaacccuaauacuggccggugugagucuucucccggucugccaaagcucguccaugcggaaaacagacuggcugccuaugacuguagcggcuaugggcgugccacccuugccucuguuuaucuucucuuuaaaggauacccucaagcguagaagcuggccccugaaugaagggguuauggccgugggacuugucucaauucuggcaaguuccuugcucaggaacgacgugccaauggccggcccucugguagcuggugggcuacugaucgcauguuacgugauuacgggaacaucugccgaucuuaccgucgagaaagcggcugacguuacuugggaagaggaagccgagcagacaggcgugagccauaaccucaugaucaccguggacgaugacggcacuaugcgcauaaaggaugacgagacagaaaauauucugaccgucuuguuaaaaacggcacugcucaucguguccgggaucuuucccuacucaauuccagccacucugcuuguuuggcacaccuggcagaagcagacacaacggagcggaguacugugggaugugccgaguccucccgagacccagaaagcugaauuggaggagggugucuauagaauaaagcagcagggcaucuucgggaaaacacaagugggaguuggcgugcagaaggaaggugucuuucauacuauguggcacgugaccagaggggccguacuaacguacaacggaaagcgacuggagccaaauugggcaucugucaaaaaggaccucauuuccuauggcggcggguggcgccugagcgcucaguggcaaaaaggagaagaggugcagguuaucgccguggaacccgguaagaacccuaaaaauuuccagacaaugccaggcacuuuccagaccacaaccggggagauuggagcgaucgcccuugauuuuaagcccggcacuucggguucaccuauaaucaaccgggaggggaaggucgugggauuauacggcaauggcguugugaccaaaaacgggggauaugucucugguauugcacaaacaaaugcugaaccggacggcccaacgcccgagcuggaagaggaaauguucaagaaaagaaaccucacuaucauggauuugcacccugggaguggaaagaccaggaaauaccugccagccauugugcgugaggcuaucaagcgccggcucagaacacugauacuugcacccaccaggguaguggccgccgagauggaagaggcucugaagggcuugccuauucgauaucagacuacagcgaccaaauccgaacauacgggucgggagaucguugaccuaaugugccacgcaacuuuuacaaugcgccugcucagcccggucagagugcccaauuacaacuuaaucauuauggaugaagcccauuucaccgacccagcuucuaucgccgcaaggggguacauaagcacccgggugggaaugggcgaggccgcugcgauuuuuaugacugccacaccucccggcaccgcagaugcuuucccacaguccaaugccccuauccaggacgaggaacgagacauucccgagagaucauggaacagugggaaugaauggaucacagauuuugcaggaaagacugucugguucguaccaagcauaaaagccgguaacgacauugcuaacugucugcgcaagaauggcaaaaaggugauccaacuuucuaggaagacguuugauaccgaguaucagaaaacaaagcugaacgacugggauuucguugugacuaccgacaucuccgagaugggggccaauuuuaaagcggaucgugucauugacccgcggagaugccucaagccugugaucuugacagauggacccgaaaggguuauucuggcaggcccaaugcccgugaccgccgcuucagccgcucagcgccgagguagagucgggcggaacccucagaaagagaaugaccaauacauauucacuggccagccacucaacaaugaugaagaccacgcacauuggacggaggccaagaugcugcuugacaacaucaauacccccgaaggaauuaucccugcucuauucgagccggagagggaaaagagugccgcaaucgauggcgaguaucgccugaaaggggaaagccguaagacauuuguggaguugaugagacggggagacuuaccaguauggcuggcgcacaaaguggccuccgaagguauuaaguacacugauaggaaauggugcuucgacggccagcgcaacaaucagauacucgaggagaacauggauguugaaaucuggaccaaggagggggagaagaagaagcugcgacccagauggcuugacgcucggacauauucugauccucuggcccucaaagaguuuaaggacuucgcagcuggaaggaaaucgauugccuuggaucuggucaccgaaaucggccgcgugcccagccaccuagcacauagaacuaggaaugcccuggacaaccucgugaugcuucacacaucagagcauggugggaaggcuuaccggcacgcggucgaggaacugccagagacgauggaaaccuuauugcugcucggccugaugauucuucugacuggaggcgccaugcucuuuuugaucuccgggaaaggaauagguaagacaaguaucggccugauuuguguuaucgcaucuagcgggauguuauggauggcugagauuccucuacaauggaucgccuccgccauagugcuggaguucuuuaugaugguacuccuuauucccgaaccagagaagcagcguaccccucaggauaaucaacuggcauauguggucaucggaauuuugacccuggcugccaucauagcggcuaacgaaaugggccuccuggagacaacuaaacgcgaccuugguaugucaaaggaaccgggggugguuucucccacgagcuaccucgauguggaccugcacccagccagugcauggaccuuguacgccgucgcuacaacuguaaucaccccuaugcugcgacauacaauugaaaauuccaccgcaaacgugagcuuagccgcgaucgcuaaccaggccguugugcuaaugggccuggacaaaggauggcccauuucuaagauggaucucggcgucccacuucuggcauuggggugcuauucacaggugaauccucugacucucacggccgcuguccugcuuuuaaucacacacuacgccauaauuggacccggccugcaggcaaaagcuaccagagaggcccaaaagaggacugcggccgguaucaugaagaacccgaccguggacgggaucaugacaauugaucucgacccaguuaucuaugauuccaaauucgagaagcaguugggacaggugaugcugcuaguacugugugcagugcagcuccuucugaugcggacaaguugggcuuugugcgaggcccugacccucgcaacaggcccuauaacgacccugugggaagguagccccggcaaauuuuggaauacuacaauugcugucucgauggccaacaucuuccgcgggucuuacuuagccggagcgggccuugcuuuuuccauuaugaaaagcguugggaccggaaaaagaggcacugguucacaaggggagacacugggagaaaaguggaagaaaaagcucaaucagcuaaguaggaaagaguucgaccuguauaagaaaucuggcaucaccgagguggaucggacggaagcaaaggaggguuugaaacgaggcgaaauaacccaucacgccgucuccagagggagcgcuaagcugcagugguuuguggagcgcaacaugguaaucccagaaggaagggugauugaccucggcugugggcggggaggcuggucauacuauugcgccggucuuaagaaaguuacagaggugcguggguacacuaagggaggccccggccaugaggaaccugucccgaugaguaccuacggguggaauaucgugaaacugaugagcggaaaggaugucuucuauuugcccccagagaaaugugacacacugcucugcgauauuggugaauccucuccuagccccacuguggaggaguccagaaccaucaggguuuuaaagaugguagaaccuuggcugaagaacaaucaguucuguauuaaagugcuuaacccauacaugcccacagucguggagcaccuggaacgccuacaacggaagcacggcgggaugcucguucgaaauccucugucaagaaacucuacccaugagauguauuggaucaguaauggaacuggcaacauaguggcaucggucaauauggugagcagguugcugcucaaccgcuuuacgaugacacaccggagaccaaccauugaaaaagacguagaucuuggugccgggacucgucaugugaacgcugagcccgagaccccgaauauggacguuaucggagaaaggaucaagcggauuaaagaggaacacaacuccacauggcacuacgacgaugagaauccuuauaagacgugggcguaccauggcucuuaugaagucaaggccaccggcucagcaagcuccaugauaaacgggguggugaaacuguuaacuaagccaugggacgucguucccauggugacacagauggcuaugaccgauacuacaccuuucggacagcaacgcguauuuaaagagaagguggacacccgaacaccaagaaguaugcccgguacuaggcgggucaugggcaucaccgccgaguggcuguggcgcacguuggggagaaauaaaaagccgaggcucugcacccgagaagaguucacaaagaaagugcggacuaacgcagccaugggagcuguuuuuaccgaagagaaucagugggauucugccaaggcggcaguggaagacgaggauuucuggaaacuggucgaccgugagagagaacuacacaaacuuggcaaaugugguagcugcguguacaacaugauggggaagcgcgagaaaaagcugggagaauuuggcaaggccaaaggcucaagggcuauuugguacauguggcucggggcccgguaucuggaguucgaggcauugggauuucugaaugaagaucauugguucuccagagagaacaguuacagcgguguagaaggcgaggggcuccacaaacuuggauauauccugcgcgacauuucuaaaaucccuggcggugcuauguacgccgaugacacagcugggugggacacuaggauaaccgaagaugacuuacauaaugaggagaagaucacgcagcagauggaucccgaacaccgacaacuggccaacgcaauuuuuaaauugacauaucagaauaagguugugaagguccagcggccaaccccuacuggaacagugauggacaucauuuccagaaaagaucagaggggcucaggccaaguggggaccuacggacucaacacuuucaccaauauggaggcgcagcugauccgccagauggaaggugagggcguccuaagcaaggccgaccuugaaaacccccgucugccagagaaaaagauaacacaguggcucgagacgaaagggguugaacggcugaagagaauggcuauuucgggagaugacugcgugguaaagcccaucgaugacagguuugccaacgcauuguuagcucugaaugauaugggcaaagugcgcaaggacaucccucaauggcagccaucuaaagguuggcacgauuggcagcaggucccguucuguagucaucacuuccaugagcucauuaugaaggacgggcgaaaacuugugguucccugccggccucaagacgaacugauaggaagggccaggaucucccagggcgcaggcuggagccuacgcgagaccgccugucuggggaaggcguaugcucagauguggucacucauguacuuucacagacgggauuugaggcuggccuccaacgcaauuugcucugccgugccaguccacugggugcccacuagccguacaaccuggaguauccaugcucaccaucaauggaugacuacagaagacaugcuuaccguauggaaucgaguuuggauugaggauaacccuuggauggaggacaagacgccagugacaaccugggaaaauguccccuaccugggaaaacgcgaggaucaguggugugguucccucaucggcuuaacuagcagagccaccugggcacagaacauaccuacagcuauccagcaagugcggucucugauugggaaugaagaguucuuggacuauaugccgucaaugaagagguuucgcaaagaggaagagagugaaggagccaucugguga

SEQ ID NO: 15506 - RNA, 9873 nt, Artificial Sequence
  derived and/or modified CDS sequence (opt3) from DENV-3__FJ639771__SS-prME
accagccugugccucaugaugauccuuccagccgcucuggcauuccacuugacuuccagagacggcgaaccuaggaugauuguggggaagaacgaacggggaaagucuuuacuguuuaagacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugagagaaaauaacaucaagcugacgguggugguaggagacgucauuggcgugcucgagcaggggaaaaggacccugacuccacagccuauggaguuaaaguacucauggaaaacauggggaaaggccaagaucguuaccgcggaaacacaaaacaguuccuucauaauugauggccccaauacuccagagugccccagcgccucucgggcuuggaacgugugggaagucgaggacuaugguuuugggguguucaccacgaauaucuggcugaaacuucgcgaaguuuacacacaguugugugaccacagacucaugucagcagccgugaaggaugagagggcuguacacgccgacaugggauacuggauugagagucagaaaaacggcagcuggaagcuggaaaaagcaucccuaaucgaggucaagaccugcacuuggccuaagucucauacccuguggucgaauggugugcucgaaagcgauaugauaaucccaaaaucccuggcgggcccgauuucacagcacaacuaucgucccggguaccauacacaaacugccggaccuuggcaccuuggcaaguuggagcuggacuuuaauuauugcgaggggaccacaguggucaucacggaaaacuguggaacccggggcccaaguuuacgaacuacaaccguuucugguaaacucauucacgaguggugcuguagaagcugcacucugcccccucuuagguacaugggggaagauggauguugguauggcauggagauccgcccaauauccgaaaaggaggagaauauggugaaaucacugguaagcgcugguucuggcgaaguggacaacuucacaaugggggucuugugccucgccauucuguuugaggaagugaugcggggaaaguucggcaagaaacauaugaucgcagggguuuucuuuaccuucgugcuacugcucuccggacagaucacguggagagauauggcucacacucugauuaugaucggcaguaaugccagcgacaggauggguaugggggucaccuaccuugcauugauugccacauuuaagauacagcccuuccuggcuuuaggauuuuuccuccgcaaacugaccucucgagagaaccuucugcuaggcgugggccucgcgauggccacuacacugcaauugccggaagauaucgagcagauggcaaaugggauugcucugggauuaauggcccucaagcugaucacccaguuugagacauaucagcuuuggacugcccugauuuccuugaccuguucaaacacgaucuucacacucaccguugcuuggcggacugcaacccugauacuagccggugugagucugcuuccugucugccaaagcucguccaugcguaaaacagacuggcucccaaugacuguagcggcuaugggcgugcccccucugcccuuguuuaucuucucucugaaggauaccuuaaagagaaggagcuggccacucaaugaagggguuauggccgugggacuggucucaauucuugcaaguucccuguugcgcaacgacgugccuauggccggcccccucguagcuggugggcugcuaaucgcauguuacgugauuacgggaacaucugccgaucugaccgucgagaaagcggcugacguuacuugggaagaggaagccgagcagacaggcgugagccauaaccuuaugaucaccguggacgaugacggcacuaugcggauaaaggaugacgagacagaaaauauucucaccguccuguugaaaacggcauuacugaucguguccgggaucuuuccauacucaauuccggccacucuccugguuuggcacaccuggcagaagcagacacaaagaagcggaguacuuugggaugugccuagucccccagagacccagaaagcugaacuggaggagggugucuauaggauaaagcagcagggcaucuucgggaaaacacaagugggaguuggcgugcagaaggaaggugucuuucauacuauguggcacgugacccgaggggccguauugacguacaacggaaagcgccuagagcccaauugggcaucugucaaaaaggaccugauuuccuauggcggcggguggcggcucagcgcucaguggcaaaaaggagaagaggugcagguuaucgccguggaaccugguaagaaccccaagaauuuccagacaaugcccggcacuuuccagaccacaaccggggagauuggagcgaucgcccuggauuuuaagccuggcacuucggguucaccgauaaucaacagagaggggaaggucgugggacuuuacggcaauggcguugugaccaaaaacgggggauaugucucugguauugcacaaacaaaugcugaaccagacggccccacgccugaguuagaagaggaaauguucaagaaaaggaaccugacuaucauggaucuccacccagggaguggaaagacccguaaauacuugcccgccauugugcgcgaggcuaucaagcggagacugaggacacucauacuggcaccuacccgaguaguggccgccgagauggaagaggcucuuaagggccugccgauucgguaucagacuacagcgaccaaauccgaacauacgggucgcgagaucguugacuugaugugccacgcaacuuuuacaaugagacuacugagccccgucagggugccaaauuacaaccucaucauuauggaugaagcccauuucaccgacccugcuucuaucgccgcacggggguacauaagcacccgagugggaaugggcgaggccgcugcgauuuuuaugacugccacacccccaggcaccgcagaugcuuucccucaguccaaugcccccauccaggacgaggaaagagacauuccagagcgcucauggaacagugggaaugaauggaucacagauuuugcaggaaagacugucugguucguaccgagcauaaaagccgguaacgacauugcuaacuguuuaaggaagaauggcaaaaaggugauccaacugucucguaagacguuugauaccgaguaucagaaaacaaaacuuaacgacugggauuucguugugacuaccgacaucuccgagaugggggccaauuuuaaagcggaucgggucauugacccuagaaggugccugaagcccgugauccucacagauggaccagaacgcguuauuuuggcaggccccaugccugugaccgccgcuucagccgcucagcgaagaggucgggucgggaggaacccacagaaagagaaugaccaauacauauucacuggccagccccugaacaaugaugaagaccacgcacauuggacggaggccaagaugcuccuggacaacaucaauaccccugaaggaauuaucccggcucuuuucgagccagagcgcgaaaagagugccgcaaucgauggcgaguaucgucuaaaaggggaaagcagaaagacauuuguggagcugaugcggaggggagacuugcccguaugguuagcgcacaaaguggccuccgaagguauuaaguacacugaucgcaaauggugcuucgacggccagcgaaacaaucagauacuggaggagaacauggauguugaaaucuggaccaaggagggggagaagaagaagcucagaccucgguggcuggacgcuaggacauauucugauccccuugcccugaaagaguuuaaggacuucgcagcuggacgcaaaucgauugcccucgauuuggucaccgaaaucggcagagugccaagccaccuggcacauaggacucggaaugcccuagacaaccuggugaugcuccacacaucagagcauggugggaaggcuuaccgucacgcggucgaggaacuuccugagacgauggaaacccuguuauugcugggccucaugauucugcuuacuggaggcgccaugcuguuucucaucuccgggaaaggaauagguaagacaaguaucggcuugauuuguguuaucgcaucuagcgggcuguuauggauggcugagauuccccuacaauggaucgccuccgccauagugcuggaguucuuuaugaugguacuccuuauuccagaaccugagaagcagcgcaccccgcaggauaaucaacuggcauauguggucaucggaauuuugacccuggcugccaucauagcggcuaacgaaaugggccuccuggagacaacuaaacgagaccuugguaugucaaaggaacccggggugguuucuccaacgagcuaccucgauguggaccugcacccugccagugcauggaccuuguacgccgucgcuacaacuguaaucacccccaugcugagacauacaauugaaaauuccaccgcaaacgugagcuuagccgcgaucgcuaaccaggccguugugcuaaugggccuggacaaaggauggccaauuucuaagauggaucucggcgucccucuucuggcauuggggugcuauucacaggugaauccccugacucucacggccgcuguccugcuuuuaaucacacacuacgccauaauuggaccgggccugcaggcaaaagcuaccagggaggcccaaaagcggacugcggccgguaucaugaagaacccaaccguggacgggaucaugacaauugaucucgacccuguuaucuaugauuccaaauucgagaagcaguugggacaggugaugcugcuaguacugugugcagugcagcuccuucugaugcgcacaaguugggcuuugugcgaggcccugacccucgcaacaggccccauaacgacccugugggaagguagcccaggcaaauuuuggaauacuacaauugcugucucgauggccaacaucuucagagggucuuacuuagccggagcgggccuugcuuuuuccauuaugaaaagcguugggaccggaaaaaggggcacugguucacaaggggagacacugggagaaaaguggaagaaaaagcucaaucagcuaagucggaaagaguucgaccuguauaagaaaucuggcaucaccgagguggaucgaacggaagcaaaggaggguuugaaaagaggcgaaauaacccaucacgccgucucccgcgggagcgcuaagcugcagugguuuguggagaggaacaugguaauccccgaaggacgggugauugaccucggcugugggcguggaggcuggucauacuauugcgccggucuuaagaaaguuacagaggugagaggguacacuaagggaggcccuggccaugaggaaccgguccccaugaguaccuacggguggaauaucgugaaacugaugagcggaaaggaugucuucuauuugccaccugagaaaugugacacacugcucugcgauauuggugaauccucucccagcccuacuguggaggaguccaggaccauccgcguuuuaaagaugguagaaccauggcugaagaacaaucaguucuguauuaaagugcuuaaccccuacaugccuacagucguggagcaccuggaacggcuacaacgaaagcacggcgggaugcucguuagaaauccacugucaaggaacucuacccaugagauguauuggaucaguaauggaacuggcaacauaguggcaucggucaauauggugagccgcuugcugcucaaccgguuuacgaugacacacagacgucccaccauugaaaaagacguagaucuuggugccgggacuaggcaugugaacgcugagccggagaccccuaauauggacguuaucggagaacggaucaagcgcauuaaagaggaacacaacuccacauggcacuacgacgaugagaauccauauaagacgugggcguaccauggcucuuaugaagucaaggccaccggcucagcaagcuccaugauaaacgggguggugaaacuguuaacuaagcccugggacgucguuccuauggugacacagauggcuaugaccgauacuacaccauucggacagcaacgaguauuuaaagagaagguggacaccagaacacccaggaguaugccggguacucggcgcgucaugggcaucaccgccgaguggcuguggagaacguuggggaggaauaaaaagccucgacucugcacccgggaagaguucacaaagaaagugcguacuaacgcagccaugggagcuguuuuuaccgaagagaaucagugggauucugccaaggcggcaguggaagacgaggauuucuggaaacuggucgacagagagcgcgaacuacacaaacuuggcaaaugugguagcugcguguacaacaugauggggaagagggagaaaaagcugggagaauuuggcaaggccaaaggcucacgggcuauuugguacauguggcucggggccagauaucuggaguucgaggcauugggauuucugaaugaagaucauugguucucccgcgagaacaguuacagcgguguagaaggcgaggggcuccacaaacuuggauauauccugagggacauuucuaaaauccccggcggugcuauguacgccgaugacacagcugggugggacacucgaauaaccgaagaugacuuacauaaugaggagaagaucacgcagcagauggauccagaacaccggcaacuggccaacgcaauuuuuaaauugacauaucagaauaagguugugaagguccagagaccuacccccacuggaacagugauggacaucauuuccaggaaagaucagcgcggcucaggccaaguggggaccuacggacucaacacuuucaccaauauggaggcgcagcugauccgucagauggaaggugagggcguccuaagcaaggccgaccuugaaaacccacggcugcccgagaaaaagauaacacaguggcucgagacgaaagggguugaaagacugaagaggauggcuauuucgggagaugacugcgugguaaagccuaucgaugaccgcuuugccaacgcauuguuagcucugaaugauaugggcaaagugcgaaaggacaucccacaauggcagccgucuaaagguuggcacgauuggcagcagguccccuucuguagucaucacuuccaugagcucauuaugaaggacgggcggaaacuugugguuccuugcagaccacaagacgaacugauaggaagggcccgcaucucccagggcgcaggcuggagccuaagagagaccgccugucuggggaaggcguaugcucagauguggucacucauguacuuucaccggagggauuugcgucuggccuccaacgcaauuugcucugccgugcccguccacugggugccuacuagccgaacaaccuggaguauccaugcucaccaucaauggaugacuacagaagacaugcuuaccguauggaaucgcguuuggauugaggauaacccauggauggaggacaagacgcccgugacaaccugggaaaaugucccuuaccugggaaaaagagaggaucaguggugugguucccucaucggcuuaacuagccgggccaccugggcacagaacauaccgacagcuauccagcaagugaggucucugauugggaaugaagaguucuuggacuauaugccaucaaugaagcgcuuuagaaaagaggaagagagugaaggagccaucugguga

SEQ ID NO: 15507 - RNA, 9873 nt, Artificial Sequence
  derived and/or modified CDS sequence (opt3) from DENV-3__FJ639772__SS-prME
accagccugugccucaugaugauccuucccgcagcucuggcauuccacuugacuuccagggacggcgaaccuaggaugauuguggggaagaacgaacggggaaaaucuuuacuguuuaagacugcaucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgccggugcuugggagaauggcgucugugggauacgaagcaccacacgcauggaaaaccuccuguggaaacagaucgccaaugagcuuaacuauauuuugugggaaaauaacaucaagcugacgguuguggugggagacauuaucggcguacucgagcaggggaaaagaacccugacuccacagccuauggaguuaaaguacucauggaaaacauggggaaaggcgaagauagucaccgccgaaacacaaaacaguuccuucauuaucgauggccccaauacuccagagugccccagcgcuucuagggcauggaacgugugggaaguugaggacuaugguuuugggguguucaccacgaauauuuggcugaaacuucgggaagucuacacacaguugugugaccaccgccucaugucagccgcugugaaggaugagagagccguucacgcagacaugggauacuggaucgagagucagaaaaacggcagcuggaagcuggaaaaagcgucccuaauagaggugaagaccugcacuuggccuaagucucauacccuguggucgaaugguguacucgaaagcgauaugaucauuccaaaaucccuggccggcccgaucucacagcacaacuauaggcccggguaccauacacaaacugcuggaccuuggcaccuuggcaaguuggagcuggacuuuaauuauugcgaggggaccacagucgugauuacggaaaacuguggaacccguggcccaaguuuacggacuacaaccgugucugguaaacucauccacgaguggugcugucgaagcugcacucugcccccucuuagauacaugggggaagauggauguugguauggcauggagauaaggccaauuuccgaaaaggaggagaauauggucaaaucacugguuagcgccgguucuggcgaaguggacaacuucacaauggggguauugugccucgcaauccuguuugaggaagugaugcgcggaaaguucggcaagaaacauaugaucgcuggggucuucuuuaccuucgugcuacugcucuccggacagauuacguggcgggauauggcccacacucugaucaugauuggcaguaaugcaagcgacagaauggguauggggguuaccuaccuugccuugauagcuacauuuaagauccagcccuuccuggcguuaggauuuuuccucaggaaacugaccucucgcgagaaccuucugcuaggcgugggccucgccauggcaacuacacugcaauugccggaagauauugagcagauggcuaaugggaucgcccugggauuaauggcccucaagcugauuacccaguuugagacauaucagcuuuggacugcucugaucuccuugaccuguucaaacacgauauucacacucaccgucgcauggcgaacugccacccugauccuagcgggugugagucugcuuccuguuugccaaagcucguccaugcggaaaacagacuggauuccaaugacuguggcugccaugggcgucccaccucucccccuguuuaucuucucuuugaaggauacccugaagcguagaagcuggccauuaaaugaagggguaauggcagugggacucguuucaauucuggccaguucccuucugaggaacgacgugccuauggcuggccccuuggucgccggugggcuccugaucgccuguuacgugauaacgggaacaucugcggaucuaaccguagagaaagcugccgacgugacuugggaagaggaagcagagcagacaggcgucagccauaaccugaugauuaccguugacgaugacggcacuaugcgcaucaaggaugacgagacagaaaauauccuuaccgugcuccugaaaacggccuuguuaauuguguccgggauauuuccauacucaaucccggcuacucugcucgucuggcacaccuggcagaagcagacacaacggagcggagugcugugggauguuccuagucccccagagacccagaaagccgaacuugaggaggguguauauagaauuaagcagcagggcaucuucgggaaaacacaagugggagucggcgugcagaaggaagguguuuuucauacuauguggcacgugaccagaggggcaguccugacguacaacggaaagcgauuggagcccaauugggcuucugugaaaaaggaccuaauuuccuauggcggcggguggcgccugagcgcccaguggcaaaaaggagaagagguacaggucaucgcgguggaaccugguaagaaccccaagaauuuccagacaaugcccggcacuuuccagaccacaaccggggagauaggagccaucgcacucgauuuuaagccuggcacuucggguucaccgauuaucaaccgggaggggaagauuguuggacuguacggcaauggcguggucaccaaaaacgggggauaugugucugguaucgcucaaacaaaugccgaaccagacggccccacgccugagcuugaagaggaaauguucaagaaaagaaacuuaacuauaauggaucugcacccagggaguggaaagaccaggaaauaccuccccgcuauuguucgugaggcaaucaagcgccgguugagaacacugauccucgccccuaccaggguggucgccgcugagauggaagaggcgcugaagggccuuccgauucgauaucagacuuccgcaacaaaaagcgaacauaccggucgggagaucguggaccugaugugccacgccacguuuacuaugcgcuugcuaucucccguaagagugccaaauuacaaccugauaauuauggaugaagcucauuucacagacccugccagcaucgcagccaggggguacauuuccacccggguuggaaugggcgaggcugcggccaucuuuaugaccgcaacucccccaggcacagcugaugccuucccucagucaaaugcacccauacaggacgaggaacgagacauuccagagagaaguuggaacagcgggaaugaauggaucaccgauuuugccggaaagacagucugguucgugccgucuaucaaagcugguaacgacauugccaacugucuccgcaagaauggcaaaaaggugauccaauuauccaggaagacuuuugauacggaguaucagaaaaccaagcugaacgacugggauuucgucguaacaacugacauuucagagaugggggcgaauuuuaaagcagaucgugugauagacccucggagaugccuuaagcccguuauccugaccgauggaccagaaagggugauucucgccggccccaugccugucacagcugccagugcugcacagcgccgagguagaguggggcggaacccacagaaagagaaugaccaauacaucuucaccggccagcccuugaacaaugaugaagaccacgcccauuggacugaggcuaagaugcugcucgacaacaucaauacgccugaaggaauuauaccggcccuguucgagccagagagggaaaagagcgcagcgaucgauggcgaguaucgccuuaaaggggaaucccguaagaccuuuguugagcuaaugagacggggagaccugcccgugugguuggcccacaaagucgcuucugaagguauuaaguacacagauaggaaauggugcuucgacggccagcgcaacaaucagaucuuagaggagaacauggauguggaaauuuggacuaaggagggggagaagaagaagcugcgaccuagauggcucgacgcccggaccuauucggauccccuggcacuuaaagaguuuaaggacuucgcugccggaaggaaaagcaucgcacuggaucucguaacagaaauaggccgcgugccaacccacuuggcccauagaacuaggaaugcucuggacaaccuaguuaugcugcacacaucagagcauggugggaaggcguaccggcacgccgucgaggaacucccugagacgauggaaacccuucuguuauugggccugaugauccuccugacuggaggcgcaaugcuuuuucugauuuccgggaaaggaaucgguaagacaaguauuggccucaucugugugauagcuucuagcgggauguuguggauggccgagauuccccugcaauggaucgccuccgcaauuguguuagaguucuuuaugaugguccuacugaucccagaaccugagaagcagcguaccccgcaggauaaucaacucgcuuauguugugauaggaauccuuacccuggccgcgauuaucgcugccaacgaaaugggcuugcuggagacaacuaaacgcgaccucgguaugucaaaggaacccgggguagugucuccaacgagcuaccuggaugucgaccuucacccugcaagugccuggacccucuacgcuguggcaacaacuguuauuacccccaugcugcgacauacaaucgaaaauuccaccgccaacgugagcuuggcggcuauagccaaccaggcagucguacugaugggcuuagacaaaggauggccaauuucuaagauggaucuaggcgugccucugcucgcccuugggugcuauucacagguuaauccccugacuuugacggcugccgugcugcuccugaucacacacuacgcaaucauuggaccgggccuucaggcuaaagccaccagagaggcgcaaaagaggacugccgcagguaucaugaagaacccaaccgucgacgggauaaugacaauugauuuagacccugugaucuaugauuccaaauucgagaagcagcugggacaggucaugcucuuggugcugugugcuguucagcuacugcucaugcggacaaguugggcccuuugcgaggcacugaccuuggcuacaggccccauuacgacccugugggaagguagcccaggcaaauuuuggaauacuacaaucgccgugucgauggccaacauauuccgcgggucuuaccucgcgggagcuggccuggcauuuuccaucaugaaaagcguagggaccggaaaaagaggcacugguucacaaggggagacauuaggagaaaaguggaagaagaaacuuaaucagcugaguaggaaagaguucgaccucuauaagaaaucuggcauuaccgagguggaucggacggaagccaaagagggucuaaaacgaggcgaaaucacccaucacgcugucuccagagggagcgccaagcugcagugguuuguugagcgcaacauggugauucccgaaggaagggucaucgacuugggcugugggcggggaggcuggucauacuauugcgcaggucugaagaaagugacagagguacguggguacacuaagggaggcccuggccaugaggaaccggugcccaugaguaccuacggguggaauauuguuaaacucaugagcggaaaggauguguucuaucuuccaccugagaaaugugacacacuguugugcgauaucggugaauccucucccagcccuacugucgaggaguccagaaccauaagggugcugaagauggucgaaccauggcucaagaacaaucaguucuguauuaaaguguuaaaccccuacaugccuacaguuaucgagcaccuggaacgccuucaacggaagcacggcgggaugcugguacgaaauccacuaucaagaaacucuacccaugagauguauuggaucaguaauggaacuggcaacauuguggccucggucaauauggugagcaggcuccuguugaaccgcuuuacgaugacacaccggagacccaccauagaaaaagacguugaucugggugcugggacucgucaugugaacgcggagccggagaccccuaauauggacgucaucggagaaaggauuaagcggaucaaagaggaacacaacuccacauggcacuacgacgaugagaauccauauaagacgugggccuaccauggcucuuaugaagugaaggcaaccggcucagcuagcuccaugauuaacgggguagugaaacuccuuacuaagcccugggacguugucccuauggugacacagauggccaugaccgauacuacaccauucggacagcaacgcguguuuaaagagaaggucgacacccgaacacccagaaguaugccggguacuaggcggguuaugggcaucaccgcagaguggcuguggcgcacguuagggagaaauaaaaagccuaggcugugcacccgagaagaguucacaaagaaagugcggacuaacgccgcuaugggagccguauuuaccgaagagaaucagugggauucugcgaaggcagccguggaagacgaggauuucuggaaauuggucgaccgugagagagaacuccacaagcugggcaaaugugguagcugcguguacaacaugauggggaagcgcgagaaaaagcuaggagaauuuggcaaggcuaaaggcucaagggccauaugguacauguggcuuggggcacgguaucuggaguucgaggcucucggauuucugaaugaagaucauugguucuccagagagaacaguuacagcgguguugaaggcgagggguugcacaagcugggauauauccuccgcgacauuucuaaaauccccggcggugccauguacgcugaugacacagccgggugggacacuaggauuaccgaagaugaccuucauaaugaggagaagaucacgcagcagauggauccagaacaccgacaacuggcaaacgcgauauuuaaauuaacauaucagaauaagguggucaaggugcagcggccuacccccacuggaacaguaauggacauuaucuccagaaaagaucagaggggcucaggccaaguugggaccuacggacugaacacuuucaccaauauggaggcccaguugauccgccagauggaaggugagggcgugcucagcaaggcugaccuggaaaacccacaccuacccgagaaaaagauuacacaguggcuugagacgaaaggggucgaacgucugaagcggauggccauaucgggagaugacugcguggugaagccuaucgaugacagauuugcaaacgcucuccuggccuugaaugauaugggcaaagucaggaaggacauuccacaauggcagccgucuaaagguuggcaugauuggcagcagguucccuucuguagucaccauuuccacgaguuaaucaugaaggacgggcgcaaacuggugguaccuugccgaccacaagacgaacucauuggacgggcaagaaucucccagggcgccggcuggagccuuagggagaccgcgugucuggggaaggcuuaugcccagauguggucacuaauguacuuucaccgcagagaucugcggcucgcauccaacgccauaugcucugcugugcccguccauugggugccuacuagcaggacaaccuggaguauccacgcccaucaccaauggaugacuacagaagacauguugaccguuuggaaucguguguggauugaggauaacccauggauggaggacaagacgcccgucacaaccugggaaaaugugccuuaccugggaaaacgagaggaucaguggugugguucccuuaucggccugacuagccgcgcaaccugggcucagaacauuccgacagccauccagcaaguaagaucucucauugggaaugaagaguucuuagacuauaugccaucaaugaagcgguuuaggaaagaggaagagagugaaggagcgauaugguga

SEQ ID NO: 15508 - RNA, 9873 nt, Artificial Sequence
  derived and/or modified CDS sequence (opt3) from DENV-3__FJ639774__SS-prME
accagccugugccucaugaugauccuucccgcagcucuggcauuccacuugaccuccagggacggcgagccuaggaugauuguggggaagaacgagcggggaaaaucuuuacuguuuaagacugccucagguauaaauauguguacgcuaaucgcgauggaucucggcgagaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaaggacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcgggaccacuacagaaacgccaaccuggaauaggaaagagcuucugguaacuuuuaagaacgcccacgccaagaagcaagaaguuguggucuugggcucccaggagggagcuaugcacacagcccucaccggcgcuacagaaauucaaaauucagggggaacaaguauauucgccggucaucugaagugucgguuaaaaauggacaagcuggagcuaaaaggcaugagcuacgcaaugugcaccaacacguuugugcucaagaaagaggucucugaaacccagcacgggacaauccugauuaagguggaguacaagggagaagauguucccuguaaaaucccuuucuccacugaggacggccaagguaaggcccauaacgggcgucuuauaaccgcuaauccagugguaacuaagaaggaggaacccgucaacauugaggcggaaccgccuuucggcgagucaaauaucgugaucggaauuggcgauaacgcauugaaaaucaauugguauaagaaggggagcaguauuggaaaaauguuugaagccacugcucgcggugccagaaggauggcaauacugggcgacaccgccugggauuucgggucuguuggaggcgugcucaacucccuggguaagaugguccaccagaucuuugggagcgcuuacacggcccuuuucucgggcgugucuuggguaaugaaaauuggaaucggcgugcuguugacauggaucgggcucaauuccaagaacaccucaaugaguuuuagcugcauugcaauaggaaucauuacucuguauuuaggcgcgguuguccaggcugacauggguugugugaucaauuggaaagggaaggagcugaagugcggauccggcauuuucgugacaaacgagguccauaccuggacugaacaguacaaauuucaagccgauucucccaagcggcuagcaaccgccaucgcuggugccugggagaauggcguuugugggauacgaagcacaacgcgcauggaaaaccuccuguggaaacagaucgcaaaugagcuuaacuauauuuugugggaaaauaacaucaagcugaccguggugguaggagacauuaucggcguccucgagcaggggaaaagaacucugacaccacagccuauggaguuaaaguacucauggaaaaccuggggaaaggcuaagauagugacagccgaaacucaaaacaguuccuucauuaucgauggccccaauaccccagagugccccaacgcgagcagggccuggaauguuugggaaguggaggacuaugguuuuggggucuucacgacaaacauuuggcugaaacuucgggaaguguacacccaguugugugaccaccgccucaugucugcugcaguuaaggaugagagagccgugcacgcugacaugggauacuggaucgagucacagaaaaauggcaguuggaagcuggaaaaagccagccuaauagagguaaagacuugcaccuggccuaagucccauacacuguggucuaacgguguccucgaaucggauaugaucauuccaaaaagccuggcaggcccgaucucccagcacaauuauaggcccggguaccauacucaaaccgcgggaccuuggcaccuuggcaaguuggagcuggacuuuaacuauugcgaggggacaacgguggugauuaccgaaaauuguggaacucguggcccaucauuacggacaaccacugucagugguaaacucauccacgaguggugcugucgaucuugcacacugcccccucuuagauacaugggggaagauggauguugguauggcauggagauaaggccaauuagcgaaaaggaggagaacaugguuaaaucccuggugucagccgguagcggcgaaguagacaauuucaccauggggguguugugccucgcuauccuguuugaggaagucaugcgcggaaaguucggcaagaaacauaugaucgccgggguguucuuuacguucguucuacugcucucuggacagauuacuuggcgggauauggcacacacccugaucaugauuggcuccaacgcuagugacagaauggguaugggggugacauaccuugccuugauagcaaccuuuaagauccagcccuuccuggccuuaggauuuuuccucaggaaacugacuagccgcgagaaucuucugcuaggcgucggccucgcuauggcgacaacccugcaauugccggaagauauugagcagauggccaacgggaucgcacugggauuaauggcucucaagcugauuacacaguuugagacuuaucagcuuuggaccgcccugaucucuuugacguguuccaauacaauauucacccucacuguggccuggcgaaccgcuacacugauccuagccgguguuucacugcuuccugugugccaaaguagcucgaugcggaaaacugacuggcucccaaugaccgucgccgcgaugggcguacccccucugcccuuguuuauuuucucccugaaggauacguuaaagcguagaucuuggccacucaacgaaggggugauggcuguuggacuggugagcauccuugccucaagucuguugaggaacgacgucccuauggcaggcccccucguggccggugggcugcuaauugcuuguuacguaaucacaggaaccuccgcagaucugacuguggagaaagccgcggacgucacaugggaagaggaagcugagcagaccggcguuucucauaaucuuaugauaacuguggacgaugacggcacaaugcgcauuaaggaugacgagaccgaaaacauccucacggugcuguugaaaacugccuuacugaucgucagcgggauuuuuccauacuccauaccggcaacccuccugguguggcacacauggcagaagcagacccaacggucaggaguucuuugggauguaccuagcccaccagagacacagaaagccgaacuggaggaggguguguauagaaucaagcagcagggcauuuucgggaaaacucaagucggagugggcguucagaaggaagguguguuucauaccauguggcacgucacgagaggggcuguguugacauacaauggaaagcgacuagagcccaacugggccagugucaagaaggaccugaucucuuauggcggcggguggcgccucuccgcacaguggcaaaaaggagaagagguccaggugauugcuguugaaccugguaagaaucccaaaaauuuccagacuaugcccggcaccuuccagacaaccacuggggagaucggagccauagcgcuggauuuuaagccuggcaccagcgguucgccgaucauuaaucgggaggggaagguggucggacuuuacggcaacggcgugguuaccaaaaaugggggauaugugucagguaucgcccaaacgaacgcagaaccagacggccccacuccugaguuagaagaggaaauguucaagaaaagaaaucugaccauuauggaucuccacccagggucuggaaagacaaggaaauacuugcccgcuaucguccgugaggccauaaagcgccggcugagaacccucauucuggcuccuacuagggugguagcagccgagauggaagaggcccuuaagggccugccgauccgauaucagacaaccgcuacgaaaagugaacauacuggucgggagaucguggacuugaugugccacgcgacauuuaccaugcgccuacugucccccguuagagucccaaacuacaaucucauuaucauggaugaagcacauuucaccgacccugccagcauagcugccaggggguacauuucuacucgggugggaaugggcgaggcagccgcuaucuuuaugacagcgacacccccaggcacagccgaugcauucccucagagcaacgcucccauucaggacgaggaacgagacaucccagagagauccuggaacucagggaacgaauggauaacugauuuugccggaaagacggugugguucgucccgaguauuaaagcagguaacgacaucgccaauuguuuacgcaagaacggcaaaaagguaauccaacugagcaggaagaccuuugauacagaguaucagaaaacuaaacuuaaugacugggauuucgugguuaccacagacauuucugagaugggggcuaacuuuaaagccgaucgugugaucgacccucggagaugccugaagcccgucauucucaccgauggaccagaaagggugauauuggcgggccccaugccuguuacugcagccuccgcugcccagcgccgagguagaguggggcggaauccacagaaagagaacgaccaauacaucuucacgggccagccccugaauaacgaugaagaccacgcucauuggaccgaggcaaagaugcuccuggacaauauuaacacaccugaaggaaucaucccggcccuuuucgagccagagagggaaaagucagcugccauugauggcgaguaucgccuaaaaggggaaagucguaagacuuuugucgagcugaugagacggggagacuugcccgugugguuagcacacaaaguagcgagcgaagguauaaaguacaccgauaggaaauggugcuucgacggccagcgcaauaaccagauccuggaggagaauauggauguggaaauuuggacaaaggagggggaacggaaaaagcucagaccuagauggcuggacgccaggaccuauuccgauccccuugcucugaaggaguuuaaagacuucgccgcaggacgcaagucuaucgcucucgauuugguuacugaaauuggcagagucccaacacaccuggcccauaggacgcggaacgcacuagacaaucuggugaugcuccacaccucggagcauggugggaaagccuaccgucacgcuguggaggaacuuccugagacuauggaaacacuguuauugcugggccucaugauccugcuuaccggaggcgcgaugcuguuucucauaagcgggaagggaaucgguaaaaccucaauuggcuugaucugugucauugccuccagugggaugcuguggauggcagagauccccuuacaauggauagcuucugccauuguucuagaguucuuuaugauggugcugcucaucccagaaccugagaagcagcgcacaccgcaggauaaccaacuugccuauguagugauuggaauccugacuuuggcagcuauaaucgccgcgaaugaaaugggccugcucgagacgaccaagcgagaccuggguaugagcaaagaacccggggucguguccccaacaucauaccuugauguugaccuccacccugcuucugccuggacucuguacgcaguggccaccacagucauuacccccauguugagacauacuaucgagaacagcacggcuaacguaagucuggcagccauugcgaaucaggcugugguuuuaaugggccuagacaagggauggccaaucuccaaaauggaucugggcgugccucuccuugcccuggggugcuauagccaggucaaccccuugacacugaccgcagccgugcuccugcuuauaacucacuacgcuauuaucggaccgggcuuacaggccaaggcaaccagggaggcucaaaaacggacagccgcggguaucaugaagaauccaacugucgacgggauuaugaccaucgaucuggacccugugauauaugauucuaaguucgaaaaacagcucggacagguuauguugcuggugcuaugugccguacagcugcuccuuaugcgcacaucaugggcacugugcgaggcuuugacgcuggccaccggccccauuacuacacucugggaagguuccccaggcaaguuuuggaacaccacuaucgcagugaguauggcuaauauuuucagagggagcuaccuggccggagccggcuuagcguuuucgaucaugaaaucugucgggacaggaaagaggggcaccgguucccaaggggagacgcuuggagaaaaauggaagaagaaacugaaccagcucagccggaaggaguucgaccuauauaaaaagucaggcauaaccgagguugaucgaacagaagcuaaagagggucugaagagaggcgaaaucacucaucacgcagugagucgcgggucugccaaauugcagugguuugucgagaggaauauggugauucccgaaggacggguaaucgaccugggcugugggcguggaggcugguccuacuauugcgcuggucucaagaaggugaccgagguuagaggguacacaaaaggaggcccuggccaugaggaaccggugcccaugagcacuuacggguggaacauugucaaacuuaugucaggaaaagauguguucuaucugccaccugagaagugugacaccuugcugugcgauaucggugaaaguagccccuccccuacagucgaggagucuaggaccauucgcgugcucaaaaugguugaaccaugguuaaagaauaaccaguucuguaucaagguacugaaucccuacaugccugccgugauagagcaccuugaacggcugcaacgaaaacacggcgggaugcuagucagaaacccacucagcagaaauuccacucaugagauguauuggauuucaaacggaacgggcaauaucguggcaucuguuaacauggugagucgccuguugcugaaccgguuuacaaugacccacagacgucccacuaucgaaaaggacgucgaucucggugccgggaccaggcaugugaaugcugagccggagacaccuaacauggacguaauuggagaacggauaaaacgcaucaaggaggaacacaauucgacguggcacuacgacgaugagaacccauauaaaaccugggcguaccauggcagcuaugaagugaaggccacuggcuccgcaucuucaaugauuaaugggguugucaaacuucugacaaaacccugggacguggugccuauggucacccagauggcuaugacugauacaaccccauucggacagcaacgaguuuuuaaggagaaaguggacacaagaacucccaggagcaugccggguacccggcgcguaaugggcaucacggccgagugguuauggagaacccuggggaggaacaagaaaccucgauugugcacacgggaagaguucacuaagaaggugcguaccaaugcagccaugggagcugucuuuacagaagagaaccagugggauuccgccaaagcggcaguggaagacgaggauuucuggaagcucguugacagagagcgcgaacugcacaaacuaggcaagugugguaguugcguguacaauaugauggggaaaagggagaagaaacuuggagaauuuggcaaggccaagggcucucgggcuauuugguacauguggcugggggccagauaucucgaguucgaggcacugggauuuuugaacgaagaucauugguucagccgcgaaaauucauacuccggugucgaaggcgaggggcugcacaaacucggauauauccuuagggacauaaguaagauccccggcggugcuauguacgccgaugacacugcugggugggacacccgaauuacggaagaugaccugcauaacgaggagaaaaucacacagcagauggauccagaacaccggcaauuagccaaugcaauuuuuaagcugaccuaucagaacaaagugguaaagguucagagaccuacucccacaggaaccgugauggacaucauaagcaggaaggaucagcgcggcucuggccaagucgggacuuacggauugaauaccuucacaaacauggaggcgcagcucauucgucagauggaaggugagggcgugcuguccaaagccgaccuagaaaacccacaccuucccgagaagaaaaucacgcaguggcuggagaccaaggggguggaacggcucaaaagaauggcuaucucaggagaugacugcgucguuaagccuauugaugacagguuugccaaugcacuguuggcuuuaaacgauaugggcaaggugcgcaaagacauaccacaauggcagccgagcaaggguuggcaugauuggcagcagguacccuucuguucgcaccauuuccacgagcugaucaugaaagacgggcgaaagcucguggucccuugccggccacaagacgaacuuauuggacgagcaaggaucucucagggcgcaggcuggagucugcgcgagacugccugucuagggaaagcguaugcucagauguggucccugauguacuuucacagacgggaucucagguuggccagcaaugcaauuugcucagccgugcccguucauugggugccuacaucccguaccacuuggucuauccacgcucaucaccaauggaugacaaccgaagacaugcugacggucuggaaccgaguguggauagaggauaauccauggauggaggacaagacacccguaaccacuugggaaaacguuccuuaccuuggaaagcgcgaggaucaguggugugguagccugaucggccucaccaguagagccacaugggcacagaauauuccgacugcuauccagcaagugcgguccuuaauugggaacgaagaguuccuggacuauaugccaagcaugaaaagguuucgcaaggaggaagagucugaaggagccaucugguga

SEQ ID NO: 15509 - RNA, 9873 nt, Artificial Sequence
  derived and/or modified CDS sequence (opt3) from DENV-3__FJ639775__SS-prME
accagccugugccucaugaugauccuuccagccgcucuggcauuccacuugacuuccagggacggcgaaccuaggaugauuguggggaagaacgaacggggaaaaucuuuacuguuuaagacugccucagguauaaauauguguacgcuaaucgcgauggaucucggcgagaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucucucugaaggauaccuuaaagcguagaagcuggccacucaaugaaggggugauggccguuggacuggugucaauccuugcaaguucccuguugaggaacgacgucccuauggccggcccccucguggcuggugggcugcuaauugcauguuacguaaucacgggaacaucugccgaucugaccguggagaaagcggcugacgucacuugggaagaggaagccgagcagacaggcguuagccauaaccuuaugauaaccguggacgaugacggcacuaugcgcauuaaggaugacgagacagaaaauauccucaccgugcuguugaaaacggcauuacugaucgucuccgggauuuuuccauacucaauaccggccacucuccugguguggcacaccuggcagaagcagacacaacggagcggaguucuuugggauguaccuagucccccagagacccagaaagcugaacuggaggaggguguguauagaaucaagcagcagggcauuuucgggaaaacacaagucggagugggcguucagaaggaagguguguuucauacuauguggcacgucaccagaggggccguguugacguacaacggaaagcgacuagagcccaauugggcaucugucaagaaggaccugaucuccuauggcggcggguggcgccucagcgcucaguggcaaaaaggagaagagguccaggugauugccguugaaccugguaagaaccccaagaauuuccagacaaugcccggcacuuuccagaccacaaccggggagaucggagcgauagcccuggauuuuaagccuggcacuucggguucaccgaucauuaaccgggaggggaagguggucggacuuuacggcaauggcgugguuaccaaaaacgggggauaugugucugguaucgcacaaacaaaugcugaaccagacggccccacgccugaguuagaagaggaaauguucaagaaaagaaaccugacuauuauggaucuccacccagggaguggaaagaccaggaaauacuugcccgccaucguccgugaggcuauaaagcgccggcugagaacacucauucuggcaccuaccagggugguagccgccgagauggaagaggcucuuaagggccugccgauccgauaucagacuacagcgaccaaauccgaacauacgggucgggagaucguggacuugaugugccacgcaacuuuuacaaugcgccuacugagccccguuagagucccaaauuacaaccucauuaucauggaugaagcccauuucaccgacccugcuucuauagccgcaaggggguacauuagcacccgggugggaaugggcgaggccgcugcgaucuuuaugacugccacacccccaggcaccgcagaugcuuucccucaguccaaugcccccauucaggacgaggaacgagacaucccagagagaucauggaacagugggaaugaauggauaacagauuuugcaggaaagacugugugguucgucccgagcauuaaagccgguaacgacaucgcuaacuguuuacgcaagaauggcaaaaagguaauccaacugucuaggaagacguuugauaccgaguaucagaaaacaaaacuuaacgacugggauuucgugguuacuaccgacauuuccgagaugggggccaauuuuaaagcggaucgugugaucgacccucggagaugccugaagcccgucauucucacagauggaccagaaagggugauauuggcaggccccaugccuguuaccgccgcuucagccgcucagcgccgagguagaguggggcggaacccacagaaagagaaugaccaauacaucuucacuggccagccccugaacaaugaugaagaccacgcacauuggacggaggccaagaugcuccuggacaacauuaauaccccugaaggaaucaucccggcucuuuucgagccagagagggaaaagagugccgcaauugauggcgaguaucgccuaaaaggggaaagccguaagacauuugucgagcugaugagacggggagacuugcccgugugguuagcgcacaaaguagccuccgaagguauaaaguacacugauaggaaauggugcuucgacggccagcgcaacaaucagauccuggaggagaacauggauguggaaauuuggaccaaggagggggagaagaagaagcuccgaccuagauggcuggacgcucggacauauucugauccccuugcccugaaagaguuuaaggacuucgcagcuggaaggaaaucgaucgcccucgauuugguuaccgaaauuggccgcgucccaagccaccuggcacauagaacuaggaaugcccuagacaaccuggugaugcuccacacaucagagcauggugggaaggcuuaccggcacgcgguggaggaacuuccugagacgauggaaacccuguuauugcugggccucaugauccugcuuacuggaggcgccaugcuguuucucauauccgggaaaggaaucgguaagacaaguauuggcuugaucugugucauugcaucuagcgggaugcuguggauggcugagauccccuuacaauggauagccuccgccauuguucuagaguucuuuaugauggugcugcucaucccagaaccugagaagcagcguaccccgcaggauaaucaacuugcauauguagugauuggaauccugaccuuggcugccauaaucgcggcuaacgaaaugggccugcucgagacaacuaaacgcgaccuggguaugucaaaggaacccggggucgugucuccaacgagcuaccuugauguugaccuccacccugccagugcauggacccuguacgccguggcuacaacugucauuacccccauguugcgacauacaaucgaaaauuccaccgcaaacguaagccuggccgcgauugcuaaccaggccgugguuuuaaugggccuagacaaaggauggccaaucucuaagauggaucugggcgugccucuccuugcacuggggugcuauucacaggucaaucccuugacucugacggccgcugugcuccugcuuauaacacacuacgccauuaucggaccgggcuuacaggcaaaagcuaccagagaggcccaaaagaggacugcggccgguaucaugaagaacccaaccgucgacgggauuaugacaaucgaucuggacccugugauauaugauuccaaauucgagaagcagcucggacagguuauguugcuggugcuaugugcaguacagcugcuccuuaugcggacaaguugggcucugugcgaggccuugacccuggcaacaggccccauuacgacccucugggaagguagcccaggcaaauuuuggaauacuacaaucgcugugucgauggccaacauuuuccgcgggucuuaccuggccggagcgggcuuagcuuuuuccaucaugaaaagcgucgggaccggaaaaagaggcacugguucacaaggggagacacuuggagaaaaguggaagaaaaagcugaaucagcucaguaggaaagaguucgaccuauauaagaaaucuggcauaaccgagguugaucggacggaagcaaaggagggucugaaacgaggcgaaaucacccaucacgccguguccagagggagcgcuaaguugcagugguuugucgagcgcaacauggugauucccgaaggaaggguaaucgaccugggcugugggcggggaggcuggucauacuauugcgccggucucaagaaagugacagagguucguggguacacuaagggaggcccuggccaugaggaaccggugcccaugaguaccuacggguggaauauugucaaacuuaugagcggaaaggauguguucuaucugccaccugagaaaugugacacauugcugugcgauaucggugaauccucucccagcccuacugucgaggaguccagaaccauuagggugcucaagaugguugaaccaugguuaaagaacaaucaguucuguaucaaaguacugaaccccuacaugccuacagugauagagcaccuugaacgccugcaacggaagcacggcgggaugcuaguccgaaauccacucucaagaaacucuacccaugagauguauuggauuaguaauggaacuggcaacaucguggcaucgguuaauauggugagcaggcuguugcugaaccgcuuuacgaugacacaccggagacccaccaucgaaaaagacgucgaucucggugccgggacucgucaugugaacgcugagccggagaccccuaauauggacguaauuggagaaaggauaaagcggaucaaagaggaacacaacuccacauggcacuacgacgaugagaauccauauaagacgugggcguaccauggcucuuaugaagugaaggccaccggcucagcaagcuccaugauuaacgggguugucaaacuucugacuaagcccugggacguggugccuauggucacacagauggcuaugaccgauacuacaccauucggacagcaacgcguuuuuaaagagaagguggacacccgaacacccagaaguaugccggguacuaggcgggccaugggcaucaccgcagagugguuauggcgcacgcuggggagaaauaaaaagccuagguugugcacccgagaagaguucacaaagaaaguacggacuaacgccgcuaugggagccguguuuaccgaagagaaucagugggauucugcgaaggcagccgucgaagacgaggauuucuggaaacucguggaccgugagagagaacugcacaagcuaggcaaaugugguagcugcguuuacaacaugauggggaagcgcgagaagaaacuuggagaauuuggcaaagcuaaaggcucaagggccauuugguacauguggcugggggcacgguaucucgaguucgaggcucugggauuuuugaaugaagaucauugguucuccagagagaacaguuacagcgguguggaaggcgaggggcugcacaagcucggauauauccuucgcgacauaucuaaaauccccggcggugccauguacgcugaugacacagccgggugggacacuaggauuaccgaagaugaccugcauaaugaggagaagaucacgcagcagauggauccagaacaccgacaauuagcaaacgcgauuuuuaaacugacauaucagaauaaggucgugaagguacagcggccuacccccacuggaacaguuauggacaucauauccagaaaagaucagaggggcucaggccaaguggggaccuacggauugaacacuuucaccaauauggaggcccagcucauucgccagauggaaggugagggcguccugagcaaggcugaccuagaaaacccacaccuucccgagaaaaagaucacacaguggcuggagacgaaagggguggaacgucucaagcggauggccaucucgggagaugacugcguggucaagccuauugaugacagauuugcaaacgcucuguuggccuuaaaugauaugggcaaaguuaggaaggacauaccacaauggcagccgucuaaagguuggcaugauuggcaacaggugcccuucuguagucaccauuuccacgagcugaucaugaaggacgggcgcaaacucguagugccuugccgaccacaagacgaacuuauuggacgggcaagaaucucccagggcgccggcuggagccugagggagaccgcgugucuagggaaggcuuaugcccagauguggucacugauguacuuucaccgcagagaucuccgguuggcauccaacgccauuugcucugcuguccccgugcauuggguuccuacuagcaggacaaccuggaguauccacgcccaucaccaauggaugacuacagaagacaugcugaccguguggaaucgugucuggauagaggauaacccauggauggaggacaagacgcccgugacaaccugggaaaauguaccuuaccuuggaaaacgagaggaucaguggugugguucccugaucggccucacuagccgcgcaaccugggcucagaacauuccgacagccauccagcaaguuagaucuuuaauugggaaugaagaguuccuggacuauaugccaucaaugaagcgguuuaggaaagaggaagagagugaaggagcgaucugguga

SEQ ID NO: 15510 - RNA, 9873 nt, Artificial Sequence
  derived and/or modified CDS sequence (opt3) from DENV-3__FJ639777__SS-prME
accagccugugccucaugaugacacuucccgccgcucuggcauuccacuugacuuccagagacggcgagccuaggaugaucguggggaagaacgaacggggaaaaucuuuacuguuuaagacggccucagguauuaauauguguacccuaauagcgauggaucucggcgagaugugcgacgauacagucacuuacaaauguccacauaucaccgaaguugagccggaagacauugauugcugguguaaccugacaaguaccugggugacuuaugggacaugcaaucaggcuggagagcaccgccgagacaagcguagcguagcccuugcaccccaugugggcaugggucuggauaccagaacgcaaacuuggauguccgccgagggggcuuggaggcaggucgaaaaaguggagaccugggcauugcggcacccuggauucacaauccucgcccuguuucuggcucauuacauuggcacuucucucacccagaagguugugaucuucauauuacugaugcuugucacaccaucgaugaccaugcgcugugugggcguagggaacagagacuuuguugaaggauugucaggugccacguggguggaugucgugcuggagcacggcgggugcgugacuacaauggcgaagaauaaacccacccuagacaucgagcuccagaagacugaagcaacacaacuggccacccuuaggaaacuguguauugagggaaagaucacgaacauuaccacagauagccggugcccuacucagggcgaagcugucuugccagaggaacaggaccagaauuauguuuguaaacacaccuacguggaucgcgguugggggaacggaugcggccucuucggcaaggggagucugguaacaugcgccaaguuucaauguuuagagcccaucgagggaaaagugguccaguaugaaaaucugaaguacacugugauaauuaccguucauacaggugaccagcaccaggugggcaacgagacccaaggggucacugcagaaaucacgccucaggcuuccacaaccgaggccauucucccagaauauggaacucuuggccuggagugcucuccgcgaaccgguuuggacuucaaugagaugauccuacugacaaugaaaaacaaggcguggauggugcauagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcacacagcucucaccggcgccacagaaauccagaauucagggggaacuaguauuuucgcaggucaucugaagugucgguuaaaaauggacaagcuggagcuaaaaggcaugagcuacgccaugugcaccaacacguuugugcucaagaaagaggucucugaaacccagcacgggacaauacugaucaagguggaguacaagggagaagauguucccuguaaaauuccuuucuccacugaggacggccaagguaaggcucauaacgggcgucuuaucaccgcgaauccagugguaacaaaaaaggaggaacccgucaacauagaggcagaaccgccuuucggcgagucaaauauugugaucggaaucggcgauaacgccuugaaaauuaauugguauaagaaggggagcaguaucggaaaaauguuugaagcuacugcccgcggugcaagaaggauggccauucugggcgacaccgcuugggauuucgggucuguuggaggcgugcucaacucccuggguaagaugguccaccagauauuugggagcgccuacacggcacuuuucucgggcgugucuuggguaaugaaaaucggaauuggcgugcuguugacauggaucgggcucaauuccaagaacaccucaaugaguuuuagcugcaucgcgauuggaauaaucacucuguauuuaggcgcuguuguccaggccgacauggguugugugauuaauuggaaagggaaggagcugaagugcggauccggcaucuucgugacaaacgagguccauaccuggacugaacaguacaaauuucaagcagauucucccaagcggcuagccaccgcuauugccggugcaugggagaauggcguuugugggauccgaagcacaacgcgcauggaaaaccuccuguggaaacagauagcuaaugagcuuaacuauaucuugugggaaaauaacauuaagcugaccguggugguaggagacaucauuggcguccucgagcaggggaaaagaacucugacaccacagccuauggaguuaaaguacucauggaaaaccuggggaaaggccaagaucguggcggccgaaacacaaaacaguuccuucauaauugauggccccaauacuccagagugccccagcgcuucuagggcauggaacguuugggaaguggaggacuaugguuuuggggucuucaccacgaauaucuggcugaaacuucgggaaguguacacacaguugugugaccaccgccucaugucagccgcuguuaaggaugagagagccgugcacgcagacaugggauacuggauugagagucagaaaaacggcagcuggaagcuggaaaaagcgucccuaaucgagguaaagaccugcacuuggccuaagucucauacccuguggucgaaugguguccucgaaagcgauaugauaaucccaaaaucccuggccggcccgauuucacagcacaacuauaggcccggguaccauacacaaacugcuggaccuuggcaccuuggcaaguuggagcuggacuuuaauuauugcgaggggaccacaguggugaucacggaaaacuguggaacccguggcccaaguuuacggacuacaaccgucucugguaaacucauucacgaguggugcugucgaagcugcacucugcccccucuuagauacaugggggaagauggauguugguauggcauggagaucaggccaauauccgaaaaggaggagaauaugguuaaaucacuggugagcgccgguucuggcgaaguagacaacuucacaauggggguguugugccucgcaauucuguuugaggaagucaugcgcggaaagcuaggcaagaaacauaugaucgcugggguguucuucaccuuuguucugcuccuguccggacagaucacguggcgggauauggcccacacucuuauuaugaucggcaguaaugcaagcgacagaauggguaugggggugaccuacuuggcccugauugcuacauucaagauacagcccuuuuuagcgcucggauucuuucugaggaaacuuaccucucgcgagaaccugcuacucggcgucggccuggccauggcaacuacauugcaacugccggaagauaucgagcagauggcuaaugggauugccuuaggacucauggcccugaagcuuaucacccaguucgagacauaucagcuguggacugcuuugauuucccucaccuguucaaacacgaucuuuacacugaccguggcauggcgaacugccacccuaauacuggcggguguuagucuucucccugugugccaaagcucguccaugcggaaaacagacuggcugccaaugacugucgcugccaugggcguacccccuuugccccuguucaucuuuucuuuaaaggauacccucaagcguagaagcuggccacugaaugaaggggugauggcaguuggacuugugucaauucuggccaguuccuugcucaggaacgacgucccuauggcuggcccccugguggcaggugggcuacugaucgccuguuacguaauuacgggaacaucugcggaucuuaccguggagaaagcugccgacgucacuugggaagaggaagcagagcagacaggcguuagccauaaccucaugaucaccguggacgaugacggcacuaugcgcauaaaggaugacgagacagaaaauauucugaccguguuguuaaaaacggcccugcucaucgucuccgggaucuucccauacucaauuccggcuacucugcuuguguggcacaccuggcagaagcagacacaacggagcggaguucugugggauguaccuagucccccagagacccagaaagccgaauuggaggaggguguguauagaauaaagcagcagggcaucuuugggaaaacacaagucggagugggcguucagaaggaagguguguuccauacuauguggcacgucaccaggggggcagugcuaacguacaacggaaagcgacuggagcccaauugggcuucuguaaaaaaggaccucauuuccuauggcggcggguggcgccugaacgcccaguggcaaaaaggagaagagguccaggugaucgcgguugaaccugguaagaauccaaaaaacuuucagacaaugcccggcacuuuccagaccacaaccggggagauuggagccaucgcacuugauuucaagccuggcacuagcgguucgccgauaaucaaucgggaggggaagguggucggauuauacggcaacggcgugguuaccaaaaaugggggauaugugucagguauugcucaaacaaacgccgaaccagacggccccacgccugagcuggaagaggaaauguuuaagaaaagaaaucucacuaucauggauuugcacccagggucuggaaagaccaggaaauaccugcccgcuauuguccgugaggcaaucaagcgccggcucagaacacugauacuugccccuaccagggugguagccgcugagauggaagaggcgcugaagggcuugccgauucgauaucagacuacagcaaccaaaagugaacauacgggucgggagaucguggaccuaaugugccacgccacuuucacaaugcgccugcucucccccguuagagucccaaacuacaauuuaaucauuauggaugaagcucauuuuaccgacccugccagcaucgcagccaggggguacauaucuacccgggugggaaugggcgaggcugcggccauuuucaugacugcaacacccccaggcaccgcugaugccuuuccucagagcaacgcacccauccaggacgaggaacgagacauuccagagagauccuggaauucagggaacgaauggaucacagauuucgccggaaagacugugugguuugucccgaguauaaaagcugguaacgacauugccaauugucugcgcaagaacggcaaaaagguaauccaacuuagcaggaagacguucgauaccgaguaucagaaaacaaagcugaaugacugggauuuugugguuacuaccgacaucucugagaugggggcgaacuucaaagcagaucgugugauugacccucggagaugccucaagcccgucaucuugacagauggaccagaaagggugauucuggccggccccauaccuguuaccgcugccuccgcugcacagcgccgagguagaguggggcggaauccacagaaagagaacgaccaauacaucuuuacuggccagccccucaauaacgaugaagaccacgcccauuggacggaggcuaagaugcugcuugacaauauuaacaccccugaaggaaucaucccggcccuauucgagccagagagggaaaagucagcagcgauugauggcgaguaucgccugaaaggggaaagucguaagacauucgucgaguugaugagacggggagacuuacccguguggcuggcccacaaaguagcuagcgaagguauaaaguacacugauaggaaauggugcuuugacggccagcgcaauaaccagauccucgaggagaauauggauguggaaauuuggaccaaggagggggaaaaaaagaagcugcgaccuagauggcuugacgcccggacauauuccgauccccuggcacucaaagaguucaaggacuuugcugccggaaggaaaucuaucgcauuggaucugguuaccgaaauuggccgcgucccaucgcaccuagcccauagaacuaggaacgcucuggacaaucucgugaugcuucacacaagcgagcauggugggaaggcguaccggcacgccguggaggaacugccugagacgauggaaaccuuauugcugcucggccugaugauccuucugacuggaggcgcaaugcucuucuugauaucagggaaaggaaucgguaagacauccauuggccugaucugugucauugcuaguucugggauguuauggauggccgagaucccccuacaauggauagccagcgcaauuguucuggaguuuuucaugauggugcuccuuaucccagaaccugagaagcagcguaccccgcaggauaaccaacuggcuuauguagugauuggaaucuugacccuggccgcgauaaucgcugccaaugaaaugggccuccuggagacaacuaaacgcgaccuugguauguccaaggaacccggggucgugucaccaacgucuuaccucgauguugaccugcacccugcaagcgccuggaccuuguacgcuguggcaacaacugucauuacccccaugcugcgacauacaaucgagaacaguaccgccaacguauccuuagcggcuauugccaaucaggcagugguucuaaugggccuggacaaaggauggccaaucagcaagauggaucucggcgugccucuucuggccuuggggugcuauucucaggucaacccccugacucucacggcugccgugcugcuuuuaauaacacacuacgcaauuaucggaccgggccugcaggcuaaagccaccagagaggcgcaaaagaggacugccgcagguaucaugaagaauccaaccgucgacgggauuaugacaaucgaucucgacccugugauauaugauucaaaauuugaaaagcaguugggacagguuaugcugcuagugcugugugcuguacagcuccuucugaugcggacuuccugggccuugugcgaggcacugacccucgcuacaggccccauuacgacccugugggaagguaguccaggcaaauucuggaacacuacaaucgccgugagcauggccaauauuuuucgcgggucguacaucgcgggagcuggcuuagcauucucuauaaugaaguccgucgggaccggaaaaagaggcacugguagccaaggggagacacuuggagaaaaguggaagaaaaagcugaaccagcucucaaggaaagaguuugaccuauauaagaaaaguggcaucaccgagguugaucggacggaagccaaggagggucugaaacgaggcgaaauuacccaucacgcugugucuagaggguccgccaaguugcagugguucgucgagcgcaauauggugacacccgaaggaaggguaaucgaccugggcugugggcggggaggcuggagcuacuauugcgcaggucucaagaaagugacugagguucguggguacaccaagggaggcccuggccaugaggaaccggugcccaugucaacauacggguggaacauugucaaacuuaugaguggaaaggauguguuuuaucugccaccugagaaaugugacacuuugcugugcgauaucggugaaagcucccccucuccuaccgucgaggagagcagaacaauuagggugcucaagaugguugaaccaugguuaaagaauaaccaguucuguaucaaaguacugaaucccuacaugccuaccgugauagagcaccuugaacgccugcaacggaagcacggcgggaugcuaguccgauccccacucucaagaaacucuacucaugagauguauuggauuaguaauggaacgggcaacaucguggccucgguuaauauggugagcaggcuguugcugaaccgcuucacaaugacccaccggagacccacuaucgaaaaagacgucgaucucggugcugggacccgucaugugaacgcggagccggagacaccuaauauggacguaauuggagaaaggauaaagcggaucaaagaggaacacaacuccacguggcacuacgacgaugagaauccauauaagaccugggccuaccauggcucuuaugaagugaaggcaacuggcucagcuagcuccaugauuaacgggguugucaaacuucugacaaagcccugggacguggugccuauggucacccagauggccaugacugauacaaccccauuuggacagcaacgcguuuucaaagagaagguggacacacgaacucccagaaguaugccggguaccaggcggguaaugggcaucacggcagagugguuauggcgcacccuggggagaaauaaaaagccuagguugugcacacgagaagaguuuacuaagaaagugcggaccaacgccgcuaugggagccgucuucacagaagagaaucagugggauucugcgaaggcagccguggaagacgaggauuuuuggaaacucguugaccgugagagagaacugcaccgccuaggcaagugugguagcugcguguacaacaugauggggaaaagggagaagaaacuuggagaauucggcaaggcuaagggcucacgggccauuugguacauguggcugggggcaagauaucucgaguuugaggcucugggauucuugaaugaagaucauugguuuucccgcgagaacaguuacagcggugucgaaggcgaggggcugcacaaacucggauauauccuuagggacauaucuaagauccccggcggugccauguacgcugaugacacugccgggugggacacccgaauuacggaagaugaccugcauaaugaggagaaaaucacacagcagauggauccagaacaccggcaauuagcaaacgcgauuuucaagcugaccuaucagaauaaagugguaaagguucagagaccuacucccacaggaaccgugauggacaucauauccaggaaggaucagcgcggcucaggccaagucgggacuuacggauugaacaccuuuacaaauauggaggcccagcucauucgucagauggaaggugagggcgugcugagcaaagcugaccuagaaaacccacaccuucccgagaagaaaaucacgcaguggcuggagaccaaggggguggaacggcucaaaagaauggccaucucgggagaugacugcgucguuaagccuauugaugacagguucgcaaacgcucuguuggccuuaaaugauaugggcaaggugcgcaaagacauaccacaauggcagccgucuaaggguuggcaugauuggcagcagguacccuuuuguagucaccauuuccacgagcugaucaugaaagacgggcgaaagcucguggucccuugccggccacaagacgaacuuauuggaagagcaaggaucucccagggcgccggcuggagccugcgcgagacugcgugucuagggaaagcuuaugcccagauguggucacugauguacuuccacagacgggaucucagguuggcauccaacgccauuugcucugcugugcccguucauugggugccuacaagccguaccacuuggaguauccacgcccaucaccaauggaugacaaccgaagacaugcugacggucuggaaucgaguguggauagaggauaacccauggauggaggacaagacacccguaaccacuugggaaaauguuccuuaccuuggaaagcgcgaggaucaguggugugguucccugaucggccucaccagcagagcaacaugggcucagaacauuccgacugccauccagcaagugcggucuuuaauugggaaugaagaguuucuggacuauaugccaucaaugaaaagguuccgcaaggaggaagagagugaaggagcgaucugguga

SEQ ID NO: 15511 - RNA, 9873 nt, Artificial Sequence
  derived and/or modified CDS sequence (opt3) from DENV-3__FJ639778__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggacggauuaccaacaucacgaccgauagccgcugcccuacacagggcgaagcugucuugccagaggaacaggaccagaauuauguuuguaagcacacuuacguggaucgagguugggggaacggaugcggccucuucggcaaagggagucugguaaccugcgccaaguuucaauguuuagagcccauagagggaaaggugguccaguaugaaaaucugaaauacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgagaacugguuuggacuucaaugagaugauccuacugaccaugaagaacaaagcguggauggugcauaggcagugguuuuucgaucucccccugccuuggacaagcggggccaccacugaaacaccaacguggaaucggaaggagcuucugguaaccuuuaaaaacgcacacgcuaagaaacaagaaguuguggucuugggcucccaggagggagccaugcacacugcucucacaggcgccaccgaaauucagaauucagggggaacaaguauauucgcaggucaucugaagugucguuuaaagauggacaaacuggagcuaaagggcaugagcuacgccaugugcacuaacaccuuugugcucaaaaaggaggucucugaaacgcagcacgggaccauccugauuaaaguggaguacaagggagaagauguucccuguaagaucccuuucuccacagaggacggccaagguaaagcucauaacgggcgccuuauaacugcgaauccagugguaaccaagaaagaggaacccgucaacauugaggcagaaccgccuuucggcgagucaaauauggugaucggaaucggcgauaacgccuugaagauuaauugguauaaaaaggggagcaguaucggaaagauguuugaagcuacagccagaggugcaaggcggauggccauucugggcgacacugcuugggauuucgggucuguuggaggcgugcucaacucccuggguaaaaugguccaccagauauuugggagcgccuacaccgcacuuuucucgggcgugucuuggguaaugaagaucggaauuggcgugcuguugacguggaucgggcucaauuccaaaaacacaucaaugaguuuuagcugcaucgcgauuggaauaaucacccuguauuuaggcgcuguuguccaggccgacauggguugugugauuaauuggaaggggaaagagcugaagugcggauccggcaucuucgugacuaacgagguccauacauggaccgaacaguacaaguuucaagcagauucucccaaacgacuagccacugcuauugccggugcaugggagaauggcguuugugggauccgcagcaccacaagaauggaaaaccuccuguggaagcagauagcuaaugagcuuaacuauaucuugugggaaaauaacauuaaacugacgguggugguaggagacaucauuggcguccucgagcaggggaagaggacccugacuccacagccuauggaguuaaaauacucauggaagacauggggaaaagccaagaucgugaccgcggaaacacaaaacaguuccuucauaauugauggccccaauacuccagagugccccagcgccucucgggcuuggaacguuugggaaguggaggacuaugguuuuggggucuucaccacgaauaucuggcugaagcuucgcgaaguguacacacaguugugugaccacagacucaugucagcagccguuaaagaugagagggcugugcacgccgacaugggauacuggauugagagucagaagaacggcagcuggaaacuggaaaaggcaucccuaaucgagguaaaaaccugcacuuggccuaagucucauacccuguggucgaaugguguccucgaaagcgauaugauaaucccaaagucccuggcgggcccgauuucacagcacaacuaucgucccggguaccauacacaaacugccggaccuuggcaccuuggcaaauuggagcuggacuuuaauuauugcgaggggaccacaguggugaucacggaaaacuguggaacccggggcccaaguuuacgaacuacaaccgucucugguaagcucauucacgaguggugcuguagaagcugcacucugcccccucuuagguacaugggggaagauggauguugguauggcauggagauccgcccaauauccgaaaaagaggagaauaugguuaagucacuggugagcgcugguucuggcgaaguagacaacuucacaauggggguguugugccucgccauucuguuugaggaagucaugcggggaaaauucggcaagaagcauaugaucgcagggguguucuuuaccuucguucuacugcucuccggacagaucacguggagagauauggcucacacucugauuaugaucggcaguaaugccagcgacaggauggguaugggggugaccuaccuugcauugauugccacauuuaaaauacagcccuuccuggcuuuaggauuuuuccuccgcaagcugaccucucgagagaaccuucugcuaggcgucggccucgcgauggccacuacacugcaauugccggaagauaucgagcagauggcaaaugggauugcucugggauuaauggcccucaaacugaucacccaguuugagacauaucagcuuuggacugcccugauuuccuugaccuguucaaacacgaucuucacacucaccguggcuuggcggacugcaacccugauacuagccgguguuagucugcuuccugugugccaaagcucguccaugcguaagacagacuggcucccaaugacugucgcggcuaugggcguacccccucugcccuuguuuaucuucucucugaaagauaccuuaaagagaaggagcuggccacucaaugaaggggugauggccguuggacuggugucaauucuugcaaguucccuguugaagaacgacgucccuauggccggcccccucguggcuggugggcugcuaaucgcauguuacguaauuacgggaacaucugccgaucugaccguggagaaagcggcugacgucacuugggaagaggaagccgagcagacaggcguuagccauaaccuuaugaucaccguggacgaugacggcacuaugcgcauaaaggaugacgagacagaaaauauucucaccgugcuguugaaaacggcauuacugaucgucuccgggaucuuuccauacucaauuccggccacucuccugguguggcacaccuggcagaagcagacacaacggagcggaguucuuugggauguaccuagucccccagagacccagaaagcugaacuggaggaggguguguauagaauaaagcagcagggcaucuucgggaaaacacaagucggagugggcguucagaaggaagguguguuucauacuauguggcacgucaccaggggggccguguugacguacaacggaaagcgacuagagcccaauugggcaucuguaaaaaaggaccugauuuccuauggcggcggguggcgccucagcgcucaguggcaaaaaggagaagagguccaggugaucgccguugaaccugguaagaacccaaaaaauuuccagacaaugcccggcacuuuccagaccacaaccggggagauuggagcgaucgcccuggauuuuaagccuggcacuucggguucaccgauaaucaaccgggaggggaagguggucggacuuuacggcaauggcgugguuaccaaaaacgggggauaugugucugguauugcacaaacaaaugcugaaccagacggccccacgccugaguuagaagaggaaauguucaagaaaagaaaccugacuaucauggaucuccacccagggaguggaaagaccaggaaauacuugcccgccauuguccgugaggcuaucaagcgccggcugagaacacucauacuggcaccuaccagggugguagccgccgagauggaagaggcucuuaagggccugccgauucgauaucagacuacagcgaccaaauccgaacauacgggucgggagaucguggacuugaugugccacgcaacuuuuacaaugcgccuacugagccccguuagagucccaaauuacaaccucaucauuauggaugaagcccauuucaccgacccugcuucuaucgccgcaaggggguacauaagcacccgggugggaaugggcgaggccgcugcgauuuuuaugacugccacacccccaggcaccgcagaugcuuucccucaguccaaugcccccauccaggacgaggaacgagacauuccagagagaucauggaacagugggaaugaauggaucacagauuuugcaggaaagacugugugguucgucccgagcauaaaagccgguaacgacauugcuaacuguuuacgcaagaauggcaaaaagguaauccaacugucuaggaagacguuugauaccgaguaucagaaaacaaagcuuaacgacugggauuucgugguuacuaccgacaucuccgagaugggggccaauuuuaaagcggaucgugugauugacccucggagaugccugaagcccgucauccucacagauggaccagaaagggugauuuuggcaggccccaugccuguuaccgccgcuucagccgcucagcgccgagguagaguggggcggaacccacagaaagagaaugaccaauacauauucacuggccagccccugaacaaugaugaagaccacgcacauuggacggaggccaagaugcuccuggacaacaucaauaccccugaaggaauuaucccggcucuuuucgagccagagagggaaaagagugccgcaaucgauggcgaguaucgccuaaaaggggaaagccguaagacauuugucgagcugaugagacggggagacuugcccgugugguuagcgcacaaaguagccuccgaagguauuaaguacacugauaggaaauggugcuucgacggccagcgcaacaaucagauacuggaggagaacauggauguggaaaucuggaccaaggagggggaaaaaaagaagcuccgaccuagauggcuggacgcucggacauauucugauccccuugcccugaaagaguuuaaggacuucgcagcuggaaggaaaucgauugcccucgauuugguuaccgaaaucggccgcgucccaacucaccuggcacauagaacaaggaaugcccuagacaaccuggugaugcuccacacgagcgagcauggugggaaggcuuaccggcacgcgguggaggaacuuccugagaccauggaaacucuguuauugcugggccucaugauucugcuuacaggaggcgccaugcuguuucucaucucagggaaaggaauagguaagaccuccaucggcuugauuugugucaucgcaaguucugggaugcuguggauggcugagauucccuuacaauggaucgccagcgccauaguucuagaguucuuuaugauggugcugcucauuccagaaccugagaagcagcguaccccgcaggauaaucaacuugcauauguagugaucggaauucugacauuggcugccaucauagcggcuaacgaaaugggccugcucgagacuacgaaacgcgaccuggguauguccaaggaacccggggucgugucaccaaccucuuaccuugauguugaccuccacccugccagcgcauggacacuguacgccguggcuacuaccgucaucacacccauguugcgacauaccauugagaauaguacugcaaacguaucccuggccgcgaucgcuaaccaggccgugguuuuaaugggccuagacaaaggauggccaauuagcaagauggaucugggcgugccucuccuugcacuggggugcuauucucaggucaaucccuugacgcugacagccgcugugcuccugcuuaucacccacuacgccauaauuggaccgggcuuacaggcaaaagcuacuagagaggcccaaaagaggaccgcggccgguaucaugaagaacccaacagucgacgggaucaugacuauugaucuggacccugugaucuaugauucaaaauucgaaaagcagcucggacagguuauguugcuggugcuaugugcaguacagcugcuccuuaugcggaccuccugggcucugugcgaggccuugacacuggcaacgggccccauaaccacucucugggaagguaguccaggcaaauuuuggaauacaaccauugcugugagcauggccaacaucuuccgcgggucguaccuggccggagcgggcuuagcuuuuucuauuaugaaguccgucgggacuggaaaaagaggcacagguagccaaggggagacccuuggagaaaaguggaagaaaaagcugaaucagcucucaaggaaagaguucgaccuauauaagaaaaguggcaucacggagguugaucggaccgaagcaaaggagggucugcgaagaggcgaaauaacacaucacgccgugucucgcggguccgcuaaauugcagugguuugucgagaggaacauggugauccccgaaggacggguaauugaccugggcugugggcguggaggcuggagcuacuauugcgccggucucaagaaggugacugagguuagaggguacaccaaaggaggcccuggccaugaggaaccggugcccaugucaacauacggguggaauaucgucaagcuuaugaguggaaaagauguguucuaucugccaccugagaagugugacacuuugcugugcgauauuggugaaagcucccccucuccuaccgucgaggagagcaggacaauccgcgugcucaaaaugguugaaccaugguuaaagaacaaucaguucuguauuaagguacugaaccccuacaugccuaccgugaucgagcaccuugaacggcugcaacgaaaacacggcgggaugcuagucagaaauccacucuccaggaacucaacucaugagauguauuggauaucuaauggaacgggcaacauuguggcaaguguuaauauggugucgcgccuguugcugaaccgguuuacaaugacccacagacgucccacuaucgaaaaggacgucgaucucggugccgggaccaggcaugugaacgcugagccggagacaccuaauauggacguaaucggagaacggauuaaacgcauaaaggaggaacacaacagcacguggcacuacgacgaugagaauccauauaaaaccugggcguaccauggcuccuaugaagugaaggccacuggcucugcaucaagcaugaucaacgggguugucaagcuucugacaaaacccugggacguggugccuauggucacccagauggcuaugacugauacaaccccauucggacagcaacgaguuuuuaaggagaaaguggacacaagaacucccagguccaugccggguacccggcgcguaaugggcauuacggccgagugguuauggagaacccuggggaggaauaagaaaccucgauugugcacacgggaagaguucacuaagaaggugcguaccaacgcagccaugggagcugucuuuacagaagagaaucagugggauagugccaaagcggcaguggaagacgaggauuucuggaagcucguugacagagagcgcgaacugcacaaacuaggcaagugugguucuugcguguacaacaugauggggaaaagggagaagaaacuuggagaauuuggcaaggccaagggcagccgggcuaucugguacauguggcugggggccagauaucucgaguucgaggcacugggauuuuugaaugaagaucauugguucucacgcgagaacuccuacaguggugucgaaggcgaggggcugcacaaacucggauauauucuuagggacaucagcaagauacccggcggugcuauguacgccgaugacacugcugggugggacacccgaaucacggaagaugaccugcauaaugaggagaaaauuacacagcagauggauccagaacaccggcaauuagccaacgcaaucuuuaagcugaccuaucagaauaaagugguaaagguucagagaccuacucccacaggaaccgugauggacauuaucucuaggaaggaucagcgcggcuccggccaagucgggacuuacggauugaacaccuucacaaauauggaggcgcagcucauacgucagauggaaggugagggcgugcugucaaaagccgaccuagaaaacccacaccuucccgagaagaaaauuacgcaguggcuggagaccaaggggguggaacggcucaaaagaauggcuaucagcggagaugacugcgucguuaagccuaucgaugacagguuugccaacgcacuguuggcuuuaaaugauaugggcaaggugcgcaaagacauuccacaauggcagccgucgaaggguuggcaugauuggcagcagguacccuucuguucucaccauuuccacgagcugauaaugaaagacgggcgaaagcucguggucccuugccggccacaagacgaacuuaucggaagagccaggauuagucagggcgcaggcuggucccugcgcgagacugccugucuagggaaagcguaugcucagauguggagccugauguacuuucacagacgggaucucagguuggccucaaacgcaaucugcuccgccgugcccguucauugggugccuacaucucguaccacuuggagcauucacgcucaucaccaauggaugacaaccgaagacaugcugacggucuggaaucgaguguggaucgaggauaacccauggauggaggacaagacacccguaaccacuugggaaaauguuccuuaccuuggaaagcgcgaggaucaguggugugguagucugauaggccucaccuccagagccacaugggcacagaacaucccgacugcuauucagcaagugcggagcuuaaucgggaaugaagaguuccuggacuauaugccaucuaugaaaagguuucgcaaggaggaagagucagaaggagccauuugguga

SEQ ID NO: 15512 - RNA, 9873 nt, Artificial Sequence
  derived and/or modified CDS sequence (opt3) from DENV-3__FJ639779__SS-prME
accagccugugccucaugaugauccuuccagccgcucuggcauuccacuugacauccagggacggcgaaccuaggaugauuguggggaagaacgaacggggaaaaucuuuacuguuuaagacugccucagguauaaauauguguacgcuaaucgcgauggaucucggcgaaaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaacguaaggcucauaacggucgccuuauaacugcgaauccagugguaaccaaaaaggaggaacccgucaacauugaggcagaaccgccuuucggggagucaaauaucgugaucggcauuggagauaacgccuugaaaaucaauugguauaagaagggcagcaguauugggaaaauguuugaagcuacagccagaggagcaaggcggauggccauacugggugacacugcuugggauuucggcucuguugggggagugcucaacucccugggcaagaugguccaccagaucuuugguagcgccuacaccgcacuuuucucgggggugucuuggguaaugaaaauuggcaucggagugcuguugacguggaucggccucaauuccaagaacacaucaaugaguuuuagcugcauugcgauagggaucauuacccuguauuuaggagcuguuguccaggccgacaugggcugugugaucaauuggaaagguaaggagcugaagugcggguccggaauuuucgugacuaacgagguccauacauggaccgaacaguacaaauuucaagcagauucucccaagcgacuagccacugcuaucgccggcgcaugggagaaugguguuuguggcauacgcagcaccacaagaauggaaaaccuccuguggaaacagaucgcuaaugagcuuaacuauauuuugugggaaaauaacaucaagcugacgguggugguaggggacauuaucggaguccucgagcagggcaaaaggacccugacuccacagccuauggaguuaaaguacucauggaaaacaugggggaaggccaagauagugaccgcggaaacacaaaacaguuccuucauuaucgauggacccaauacuccagagugccccagcgccucucgggcuuggaacguuugggaaguggaggacuauggcuuuggugucuucaccacgaauauuuggcugaaacuucgcgaaguguacacacaguugugugaccacagacucaugucagcagccguuaaggaugagagggcugugcacgccgacaugggguacuggaucgagagucagaaaaacggaagcuggaagcuggaaaaagcaucccuaauagagguaaagaccugcacuuggccuaagucucauacccuguggucgaauggcguccucgaaagcgauaugaucauuccaaaaucccuggcggguccgaucucacagcacaacuaucgucccggcuaccauacacaaacugccgggccuuggcaccuuggaaaguuggagcuggacuuuaauuauugcgagggcaccacaguggugauuacggaaaacugugggacccggggaccaaguuuacgaacuacaaccgucucuggcaaacucauccacgaguggugcuguagaagcugcacucugcccccucuuagguacaugggugaagauggguguugguauggaauggagauacgcccaauuuccgaaaaggaggagaauaugguuaaaucacuggugagcgcuggcucuggugaaguagacaacuucacaaugggcguguugugccucgccauccuguuugaggaagucaugcgggggaaguucggaaagaaacauaugaucgcaggcguguucuuuaccuucguucuacugcucuccgggcagauuacguggagagauauggcucacacucugaucaugauuggaaguaaugccagcgacaggaugggcaugggugugaccuaccuugcauugauagccacauuuaagauccagcccuuccuggcuuuaggguuuuuccuccgcaaacugaccucucgagagaaccuucugcuaggagucggccucgcgauggccacuacacugcaauugccggaagauuuugagcagauggcaaauggcauugcucugggguuaauggcccucaagcugaucacccaguucgagacauaucagcuuuggacugcccugauuuccuugaccuguucaaacacgaucuuuacacucaccguggcuuggcggacugcaacccugauacuagccggaguuagucugcuuccugugugccaaagcucguccaugcguaaaacagacuggcucccaaugacugucgcggcuauggguguacccccucugcccuuguucaucuuuucucugaaggauaccuuaaagagaaggagcuggccacucaaugaaggcgugauggccguugggcuggugucaauucuugcaaguucccuguugcgcaacgacgucccuauggccggaccccucguggcuggcggucugcuaaucgcauguuacguaauuacggggacaucugccgaucugaccguggagaaagcggcugacgucacuugggaagaggaagccgagcagacaggaguuagccauaaccuuaugaucaccguggacgaugacggcacuaugcggauaaaggaugacgagacagaaaauauucucaccgugcuguugaaaacggcauuacugaucgucuccggcaucuucccauacucaauuccggccacucuccugguguggcacaccuggcagaagcagacacaaagaagcgggguucuuugggauguaccuagucccccagagacccagaaagcugaacuggaggagggaguguauaggauaaagcagcaggguaucuuuggcaaaacacaagucggggugggaguucagaaggaaggcguguuccauacuauguggcacgucacccgaggugccguguugacguacaacgggaagcgccuagagcccaauugggcaucugucaagaaggaccugauuuccuauggaggcggcuggcggcucagcgcucaguggcaaaaaggggaagagguccaggugaucgccguugaaccuggaaagaaccccaagaauuuccagacaaugcccgguacuuuucagaccacaaccggcgagauuggggcgaucgcccuggauuucaagccuggaacuucgggcucaccgauaaucaacagagaggguaagguggucgggcuuuacggaaauggcgugguuaccaaaaacggcggguaugugucuggaauugcacaaacaaaugcugaaccagacggucccgccccugaguuagaagaggaaauguuuaagaaaaggaaccugacgaucauggaucuccacccaggcagugggaagacucguaaauacuugcccgcuauuguccgcgaggcaaucaagcggagacugaggacccucauacuggccccuacacgagugguagccgcugagauggaagaggcgcuuaagggacugccgauucgguaucagaccacugcaacaaaauccgaacauaccggccgcgagaucguggacuugaugugccacgccacguucacuaugagacuacugagccccguuagggucccaaauuacaaccucaucauuauggaugaagcucauuuuacagacccugccucuaucgcagcccgggguuacauaagcacccgaguggggaugggagaggcugcggccauuuucaugaccgcaacucccccaggcacagcugaugccuuuccucaguccaaugcacccauccaggacgaggaaagagacauuccagagcgcucauggaacaguggcaaugaauggaucaccgauuucgccgggaagacagugugguuugucccgagcauaaaagcuggaaacgacauugccaacuguuuaaggaagaaugguaaaaagguaauccaacugucucguaagacuuucgauacggaguaucagaaaaccaaacuuaacgacugggauuuugugguuacaacugacaucuccgagaugggcgcgaauuucaaagcagaucgggugauugacccuagaaggugccugaagcccgucauccucaccgaugggccagaacgcgugauuuuggccggacccaugccuguuacagcugccucagcugcacagcgaagaggccggguggguaggaacccacagaaagagaaugaccaauacauauucaccgggcagccccugaacaaugaugaagaccacgcccauuggacugaggcuaagaugcuccuggacaacaucaauacgccugaaggcauuaucccggcccuuuuugagccagagcgcgaaaagagugcagcgaucgauggagaguaucgucuaaaaggcgaaagcagaaagaccuucgucgagcugaugcggagaggggacuugcccgugugguuagcccacaaaguagcuuccgaaggaauuaaguacacagaucgcaaauggugcuuugacggucagcgaaacaaucagauacuggaggagaacauggauguggaaaucuggacuaaggagggcgagaagaagaagcucagaccucgguggcuggacgccaggaccuauucugauccccuugcacugaaagaguucaaggacuuugcugccgggcgcaaaucgauugcacucgauuugguuacagaaaucggaagagucccaacccaccuggcccauaggacucggaaugcucuagacaaccuggugaugcuccacacaagcgagcauggcgguaaggcguaccgucacgccguggaggaacuuccugagacgauggaaacccuguuauugcuggggcucaugauucugcuuacuggcggagcaaugcuguuccucaucucaggcaaagggauaggaaagacauccaucgguuugauuugugucaucgcuaguucuggcaugcuguggauggccgagauucccuuacaauggaucgccagcgcaauaguucuagaguuuuucaugauggugcugcucauuccagaaccugagaagcagcgcaccccgcaggauaaucaacuugcuuauguagugaucgggauucugaccuuggccgcgaucauagcugccaacgaaaugggacugcucgagacaacuaaacgagaccugggcauguccaaggaacccggugucgugucaccaacgucuuaccuugauguugaccuccacccugcaagcgccuggacccuguacgcuguggcaacaacugucaucacccccauguugagacauacaauugagaauaguaccgccaacguaucccuggcggcuaucgccaaccaggcagugguuuuaauggggcuagacaaaggcuggccaauuagcaagauggaucugggagugccucuccuugcccugggcugcuauucucaggucaaucccuugacucugacggcugccgugcuccugcuuaucacacacuacgcaauaauugggccgggauuacaggcuaaagccaccagggaggcgcaaaagcggacugccgcaggcaucaugaagaacccaaccgucgacgguaucaugacaauugaucuggacccugugaucuaugauucaaaauuugaaaagcagcucgggcagguuauguugcuggugcuaugugcuguacagcugcuccuuaugcgcacuuccugggcccugugcgaggcauugacccuggcuacaggacccauaacgacccucugggaaggcaguccagguaaauucuggaauacuacaauugccgugagcauggccaacaucuuuagaggcucguaccuggcgggggcuggauuagcauucucuauuaugaaguccgucggcaccgggaaaaggggaacuggcagccaaggugagacacuuggggaaaaguggaagaaaaagcugaaucagcucucacggaaagaguuugaccuauauaagaaaaguggaaucaccgagguugaucgaacggaagccaaggagggccugaaaagaggugaaauaacccaucacgcugugucucgcggcuccgccaaguugcagugguucgucgagaggaacauggugauccccgaagggcggguaauugaccugggauguggccgugggggauggagcuacuauugcgcaggccucaagaaagugacagagguuagagguuacacuaaagggggaccuggccaugaggaaccggugcccaugucaaccuacggcuggaauaucgucaaacuuaugagugggaaggauguguucuaucugccaccugagaaaugugacacauugcugugcgauauuggagaaagcucccccucuccuacugucgaggagagcaggaccauccgcgugcucaagaugguugaaccaugguuaaagaacaaucaguuuuguauuaaaguacugaaccccuacaugccuacagugaucgagcaccuugaacggcugcaacgaaagcacgguggcaugcuagucagaaauccacucuccaggaacucaacccaugagauguauuggauaucuaaugggacuggaaacauuguggccaguguuaauauggugucgcgccuguugcugaaccgguucacgaugacacacagacgucccaccaucgaaaaagacgucgaucucggcgcugguacuaggcaugugaacgcggagccggagaccccuaauauggacguaaucggggaacggauuaagcgcauaaaagaggaacacaacagcacauggcacuacgacgaugagaauccauauaagacgugggccuaccauggauccuaugaagugaaggcaaccggcucugcuucaagcaugaucaacggcguugucaaacuucugacuaagcccugggacguggugccuauggucacacagauggccaugaccgauacuacaccauuugggcagcaacgaguuuucaaagagaagguggacaccagaacacccagguccaugccgggaacucggcgcguaauggguauuaccgcagagugguuauggagaacgcugggcaggaauaaaaagccucgauugugcacccgggaagaguuuacaaagaaagugcguacuaacgccgcuaugggggccgucuucaccgaagagaaucagugggauagugcgaaggcagccguggaagacgaggauuuuuggaaacucguugacagagagcgcgaacugcacaagcuaggaaaauguggcucuugcguguacaacaugauggguaagagggagaagaaacuuggggaguucggaaaagcuaaaggcagccgggccaucugguacauguggcugggcgcaagauaucucgaguuugaggcucugggguucuugaaugaagaucauugguuuucacgcgagaacuccuacaguggagucgaaggugagggccugcacaagcucggguauauucuuagggacaucagcaaaauacccggaggcgccauguacgcugaugacacagccgguugggacacucgaaucaccgaagaugaccugcauaaugaggagaagauuacgcagcagauggauccagaacaccggcaauuagcaaacgcgaucuucaaacugacauaucagaauaaggugguaaagguucagagaccuacccccacugggacagugauggacauuaucucuaggaaagaucagcgcggauccggccaagucggcaccuacggguugaacacuuuuaccaauauggaggcccagcucauacgucagauggaaggagagggugugcugucaaaggcugaccuagaaaacccacaccuucccgagaaaaagauuacacaguggcuggagacgaaaggcguggaacggcucaagagaauggccaucagcggggaugacugcgucguuaagccuaucgaugacagguucgcaaacgcucuguuggccuuaaaugauaugggaaaagugcgcaaggacauuccacaauggcagccgucgaaaggcuggcaugauuggcagcagguacccuucuguucucaccauuuucacgagcugauaaugaaggacggucgaaaacucguggucccuugccggccacaagacgaacuuaucgggagagcaaggauuagucagggagccggcuggucccugcgcgagaccgcgugucuaggcaaggcuuaugcccagauguggagccugauguacuuccacagacgggaucucagguuggcaucaaacgccaucugcuccgcugugcccguucauugggugccuacuucucguacaaccuggagcauucacgcccaucaccaauggaugacuacagaagacaugcugaccgucuggaaucgaguguggaucgaggauaacccauggauggaggacaagacgcccguaacaaccugggaaaauguuccuuaccuugggaaacgcgaggaucagugguguggaagucugauaggucucacuuccagagcaaccugggcucagaacaucccgacagccauucagcaagugcggagcuuaaucggcaaugaagaguuucuggacuauaugccagcgaugaagagguuccgcaaagaggaagagucugaaggggcuauuugguga

SEQ ID NO: 15513 - RNA, 9873 nt, Artificial Sequence
  derived and/or modified CDS sequence (opt3) from DENV-3__FJ639780__SS-prME
accagccugugccucaugaugauccuucccgcagcucuggcauuccacuugaccuccagggacggcgagccuaggaugauuguggggaagaacgagcggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaaggacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcgggaccacuacagaaacgccaaccuggaauaggaaagagcuucugguaacuuuuaagaacgcccacgccaagaagcaagaaguuguggucuugggcucccaggagggagcuaugcacacagcccucaccggcgcuacagaaauucaaaauucagggggaacaaguauauucgccggucaucugaagugucgguuaaaaauggacaagcuggagcuaaaaggcaugagcuacgcaaugugcaccaacacguuugugcucaagaaagaggucucugaaacccagcacgggacaauccugauuaagguggaguacaagggagaagauguucccuguaaaaucccuuucuccacugaggacggccaagguaaggcccauaacgggcgucuuauaaccgcuaauccagugguaacuaagaaggaggaacccgucaacauugaggcggaaccgccuuucggcgagucaaauaucgugaucggaauuggcgauaacgcauugaaaaucaauugguauaagaaggggagcaguauuggaaaaauguuugaagccacugcucgcggugccagaaggauggcaauacugggcgacaccgccugggauuucgggucuguuggaggcgugcucaacucccuggguaagaugguccaccagaucuuugggagcgcuuacacggcccuuuucucgggcgugucuuggguaaugaaaauuggaaucggcgugcuguugacauggaucgggcucaauuccaagaacaccucaaugaguuuuagcugcauugcaauaggaaucauuacucuguauuuaggcgcgguuguccaggcugacauggguugugugaucaauuggaaagggaaggagcugaagugcggauccggcauuuucgugacaaacgagguccauaccuggacugaacaguacaaauuucaagccgauucucccaagcggcuagcaaccgccaucgcuggugccugggagaauggcguuugugggauacgaagcacaacgcgcauggaaaaccuccuguggaaacagaucgcaaaugagcuuaacuauauuuugugggaaaauaacaucaagcugaccguggugguaggagacauuaucggcguccucgagcaggggaaaagaacucugacaccacagccuauggaguuaaaguacucauggaaaaccuggggaaaggcuaagauagugacagccgaaacucaaaacaguuccuucauuaucgauggccccaauaccccagagugccccaacgcgagcagggccuggaauguuugggaaguggaggacuaugguuuuggggucuucacgacaaacauuuggcugaaacuucgggaaguguacacccaguugugugaccaccgccucaugucugcugcaguuaaggaugagagagccgugcacgcugacaugggauacuggaucgagucacagaaaaauggcaguuggaagcuggaaaaagccagccuaauagagguaaagacuugcaccuggccuaagucccauacacuguggucuaacgguguccucgaaucggauaugaucauuccaaaaagccuggcaggcccgaucucccagcacaauuauaggcccggguaccauacucaaaccgcgggaccuuggcaccuuggcaaguuggagcuggacuuuaacuauugcgaggggacaacgguggugauuaccgaaaauuguggaacucguggcccaucauuacggacaaccacugucagugguaaacucauccacgaguggugcugucgaucuugcacacugcccccucuuagauacaugggggaagauggauguugguauggcauggagauaaggccaauuagcgaaaaggaggagaacaugguuaaaucccuggugucagccgguagcggcgaaguagacaauuucaccauggggguguugugccucgcuauccuguuugaggaagucaugcgcggaaaguucggcaagaaacauaugaucgccgggguguucuuuacguucguucuacugcucucuggacagauuacuuggcgggauauggcacacacccugaucaugauuggcuccaacgcuagugacagaauggguaugggggugacauaccuugccuugauagcaaccuuuaagauccagcccuuccuggccuuaggauuuuuccucaggaaacugacuagccgcgagaaucuucugcuaggcgucggccucgcuauggcgacaacccugcaauugccggaagauauugagcagauggccaacgggaucgcacugggauuaauggcucucaagcugauuacacaguuugagacuuaucagcuuuggaccgcccugaucucuuugacguguuccaauacaauauucacccucacuguggccuggcgaaccgcuacacugauccuagccgguguuucacugcuuccugugugccaaaguagcucgaugcggaaaacugacuggcucccaaugaccgucgccgcgaugggcauucccccucugcccuuguuuaucuucucccugaaggauacguuaaagcguagaucuuggccacucaacgaagggguaauggcugugggacugguuagcauucuugccucaagucuguugaggaacgacgugccuauggcaggcccccucgucgccggugggcugcuaaucgcuuguuacgugauaacaggaaccuccgcagaucugacuguagagaaagccgcggacgugacaugggaagaggaagcugagcagaccggcgucucucauaaucuuaugauuacuguugacgaugacggcacaaugcgcaucaaggaugacgagaccgaaaacauccucacggugcuguugaaaacugccuuacugauugugagcgggauauuuccauacuccaucccggcaacccuccuggucuggcacacauggcagaagcagacccaacggucaggagugcuuugggauguuccuagcccaccagagacacagaaagccgaacuggaggaggguguauauagaauuaagcagcagggcaucuucgggaaaacucaagugggagucggcgugcagaaggaagguguuuuucauaccauguggcacgugacgagaggggcugucuugacauacaauggaaagcgacuagagcccaacugggccagugugaaaaaggaccugauuucuuauggcggcggguggcgccucuccgcacaguggcaaaaaggagaagagguacaggucaucgcuguggaaccugguaagaaucccaagaauuuccagacuaugcccggcaccuuccagacaaccacuggggagauaggagccaucgcgcuggauuuuaagccuggcaccagcgguucgccgauuaucaaucgggaggggaagguugugggacuuuacggcaacggcgucgugaccaaaaaugggggauauguuucagguauugcccaaacgaacgcagaaccagacggccccacuccugaguuagaagaggaaauguucaagaaaagaaaucugaccaucauggaucuccacccagggucuggaaagacaaggaaauacuugcccgcuauagugcgugaggccauuaagcgccggcugagaacccucauccuggcuccuacuagggucguggcagccgagauggaagaggcccuuaagggccugccgauccgauaucagacaaccgcuacgaaaagugaacauacuggucgggagauuguagacuugaugugccacgcgacauuuaccaugcgccuacugucccccgugagaguuccaaacuacaaucucaucauaauggaugaagcacauuucaccgacccugccagcauugcugccaggggguacaucucuacucgggucggaaugggcgaggcagccgcuauuuuuaugacagcgacacccccaggcacagccgaugcauucccucagagcaacgcucccauccaggacgaggaacgagacauaccagagagauccuggaacucagggaacgaauggauuacugauuuugccggaaagacggugugguucgugccgaguaucaaagcagguaacgacaucgccaauuguuuacgcaagaacggcaaaaaggucauucaacugagcaggaagaccuuugauacagaguaucagaaaacuaaacuuaaugacugggauuucguagugaccacagacaucucugagaugggggcuaacuuuaaagccgaucguguuauugacccucggagaugccugaagcccgugauacucaccgauggaccagaaagggucaucuuggcgggccccaugccugugacugcagccuccgcugcccagcgccgagguagaguugggcggaauccacagaaagagaacgaccaauacauuuucacgggccagccccugaauaacgaugaagaccacgcucauuggaccgaggcaaagaugcuccuggacaauaucaacacaccugaaggaaucauuccggcccuuuucgagccagagagggaaaagucagcugccauagauggcgaguaucgccuaaaaggggaaagucguaagacuuuuguggagcugaugagacggggagacuugcccgucugguuagcacacaaaguggcgagcgaagguaucaaguacaccgauaggaaauggugcuucgacggccagcgcaauaaccagauucuggaggagaauauggauguagaaaucuggacaaaggagggggaacggaaaaagcucagaccuagauggcuggacgccaggaccuauuccgauccccuugcucugaaggaguuuaaagacuucgccgcaggacgcaagucuauugcucucgauuuggugacugaaaucggcagaguuccaacacaccuggcccauaggacgcggaacgcacuagacaaucuggucaugcuccacaccucggagcauggugggaaagccuaccgucacgcuguggaggaacuuccugagacuauggaaacacuguuauugcugggccucaugauacugcuuaccggaggcgcgaugcuguuucucaucagcgggaagggaauugguaaaaccucaaucggcuugauuugugugaucgccuccagugggaugcuguggauggcagagauacccuuacaauggauugcuucugccaucguccuagaguucuuuaugaugguucugcucauuccagaaccugagaagcagcgcacaccgcaggauaaccaacuugccuaugugguaaucggaauacugacuuuggcagcuaucauugccgcgaaugaaaugggccugcucgagacgaccaagcgagaccuggguaugagcaaagaacccgggguggucuccccaacaucauaccuugauguggaccuccacccugcuucugccuggacucuguacgcaguugccaccacagugaucacccccauguugagacauacuauugagaacagcacggcuaacgucagucuggcagccaucgcgaaucaggcuguaguguuaaugggccuagacaagggauggccaauauccaaaauggaucugggcguuccucuccuugcccuggggugcuauagccaggugaaccccuugacacugaccgcagccguccuccugcuuauuacucacuacgcuaucaucggaccgggcuuacaggccaaggcaaccagggaggcucaaaaacggacagccgcggguauuaugaagaauccaacuguggacgggaucaugaccauagaucuggacccugucauuuaugauucuaaguucgaaaaacagcucggacaggugauguugcugguucuaugugccgugcagcugcuccuuaugcgcacaucaugggcacugugcgaggcuuugacgcuggccaccggccccaucacuacacucugggaagguuccccaggcaaguuuuggaacaccacuauugcaguaaguauggcuaauaucuucagagggagcuaccuggccggagccggcuuagcguuuucgauaaugaaaucuguggggacaggaaagaggggcaccgguucccaaggggagacgcuuggagaaaaauggaagaagaaacugaaccagcucagccggaaggaguucgaccuauauaaaaagucaggcaucaccgaggucgaucgaacagaagcuaaagagggucugaagagaggcgaaauuacucaucacgcaguuagucgcgggucugccaaauugcagugguuuguggagaggaauauggucauccccgaaggacgggugauugaccugggcugugggcguggaggcugguccuacuauugcgcuggucucaagaagguaaccgaggugagaggguacacaaaaggaggcccuggccaugaggaaccgguucccaugagcacuuacggguggaacaucgugaaacuuaugucaggaaaagaugucuucuaucugccaccugagaagugugacaccuugcugugcgauauuggugaaaguagccccuccccuacaguggaggagucuaggaccauccgcguccucaaaaugguggaaccaugguuaaagaauaaccaguucuguauaaagguucugaaucccuacaugccugccguaauugagcaccuugaacggcugcaacgaaaacacggcgggaugcuagugagaaacccacucagcagaaauuccacucaugagauguauuggaucucaaacggaacgggcaauaucgucgcaucugugaacaugguuagucgccuguugcugaaccgguuuacaaugacccacagacgucccacuauugaaaaggacguggaucucggugccgggaccaggcaugucaaugcugagccggagacaccuaacauggacgugauaggagaacggaucaaacgcauuaaggaggaacacaauucgacguggcacuacgacgaugagaacccauauaaaaccugggcguaccauggcagcuaugaaguaaaggccacuggcuccgcaucuucaaugaucaauggggugguuaaacuucugacaaaacccugggacgucgugccuauggugacccagauggcuaugacugauacaaccccauucggacagcaacgagucuuuaaggagaaaguugacacaagaacucccaggagcaugccggguacccggcgcgugaugggcauuacggccgagugguuauggagaacccuggggaggaacaagaaaccucgauugugcacacgggaagaguucacuaagaagguacguaccaaugcagccaugggagcuguguuuacagaagagaaccagugggauuccgccaaagcggcagucgaagacgaggauuucuggaagcucguggacagagagcgcgaacugcacaaacuaggcaagugugguaguugcguuuacaauaugauggggaaaagggagaagaaacuuggagaauuuggcaaggccaagggcucucgggcuaucugguacauguggcugggggccagauaucucgaguucgaggcacugggauuuuugaacgaagaucauugguucagccgcgaaaauucauacuccgguguggaaggcgaggggcugcacaaacucggauauauacuuagggacaucaguaagauucccggcggugcuauguacgccgaugacacugcugggugggacacccgaaucacggaagaugaccugcauaacgaggagaaaauuacacagcagauggauccagaacaccggcaauuagccaaugcaaucuuuaagcugaccuaucagaacaaagucgugaagguacagagaccuacucccacaggaaccguuauggacauaauuagcaggaaggaucagcgcggcucuggccaaguggggacuuacggauugaauaccuucacaaacauggaggcgcagcucauccgucagauggaaggugagggcguccuguccaaagccgaccuagaaaacccacaccuucccgagaagaaaaucacgcaguggcuggagaccaaggggguggaacggcucaaaagaauggcuauuucaggagaugacugcguggucaagccuauagaugacagguuugccaaugcacuguuggcuuuaaacgauaugggcaagguucgcaaagacaucccacaauggcagccgagcaaggguuggcaugauuggcaacaggugcccuucuguucgcaccauuuccacgagcugauuaugaaagacgggcgaaagcucguagugccuugccggccacaagacgaacuuaucggacgagcaaggauuucucagggcgcaggcuggagucugcgcgagacugccugucuagggaaagcguaugcucagauguggucccugauguacuuucacagacgggaucucagguuggccagcaaugcaaucugcucagccguccccgugcauuggguuccuacaucccguaccacuuggucuauacacgcucaucaccaauggaugacaaccgaagacaugcugacgguguggaaccgagucuggaucgaggauaauccauggauggaggacaagacacccgugaccacuugggaaaacguaccuuaccuuggaaagcgcgaggaucaguggugugguagccugauuggccucaccaguagagccacaugggcacagaauaucccgacugcuauucagcaaguucgguccuuaaucgggaacgaagaguuccuggacuauaugccaagcaugaaaagguuucgcaaggaggaagagucugaaggagccauuugguga

SEQ ID NO: 15514 - RNA, 9873 nt, Artificial Sequence
  derived and/or modified CDS sequence (opt3) from DENV-3__FJ639781__SS-prME
accagccugugccucaugaugauccuucccgcagcucuggcauuccacuugacauccagagacggcgagccuaggaugauuguggggaagaacgaacggggaaaaucuuuacuguuuaagacugccucagguauaaauauguguacgcuaaucgcgauggaucucggcgaaaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucaguacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcauggcgggugcgugacgacuauggcgaagaauaaacccacacuagacauugagcuccaaaagaccgaagcaacucagcuggccacacuuaggaaacuguguaucgagggaaagauuaccaacaucacgaccgauagccggugcccuacacagggcgaagcugucuugccagaggaacaggaccaaaauuauguuuguaaacacacuuacguggaucgcgguugggggaacggaugcggccucuucggcaaggggagucugguaaccugcgccaaguuucaguguuuagagcccauagagggaaaagugguccaguaugaaaaucugaaguacacagugauuaucacuguucacaccggugaccagcaucaagugggcaacgagacacagggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcacagacaaugguuuuucgaucucccccugccuuggacaagcggggccaccacugaaacaccaacguggaauaggaaagagcuucugguaaccuuuaagaacgcacaugcuaaaaagcaggaaguuguggucuugggcucccaggagggagccaugcacacugcucucacaggcgccaccgaaauucaaaauucagggggaacaaguauauucgcaggucaccugaagugucgguuaaaaauggacaagcuggagcuaaaaggcaugagcuacgccaugugcacuaacaccuuugugcucaagaaagaggucucugaaacgcaacaugggaccauccugauuaagguggaguacaagggagaagauguucccuguaaaaucccuuucuccacagaggacggccaggguaaggcucacaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaucagaucuuugggagcgccuacaccgcacuuuucucgggcgugucuuggguaaugaaaauuggaaucggcgugcuguugacguggaucgggcucaauuccaagaacauuucaaugaguuuuagcugcauagcgaucggaauuaucacacuguauuuaggcgcuguuguccaggccgacauggguugugugauuaauuggaaagggaaggagcugaagugcggauccggcaucuucgugaccaacgagguccacacuuggacagaacaauacaaauuucaggcagauucucccaagcggcuagccaccgcuauagccggugcaugggagaauggcguuugugggauccgaagcacuacccgcauggaaaaccuccuguggaaacagauugcuaaugagcuuaacuauaucuugugggaaaauaacauuaagcugacaguggugguaggagacacgaucggcguccucgagcaggggaaaagaacccugacuccacaaccuauggaguuaaaguacucauggaaaacauggggaaaggccaagauagugaccgcggaaacacagaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaucgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucacacccuguggucgaaugguguccucgaaagcgauaugaucauuccaaaaucccuggcgggcccgaucucacaacauaacuauaggcccggguaccacacacagacugccggaccuuggcaucuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacacaugaucgcagggguguucuuuaccuucgcucuacugcucuccggacagauuacguggcgggauauggcccauacucugaucaugauuggcaguaaugcaagcgacagaauggguauggggguuaccuaccuugccuugauagcuacauuuaagauccaacccuuccuggcguuaggauuuuuccucaggaaacugaccucucgcgagaaccuucugcuaggcgugggccucgccauggcaacuacacugcaguugccggaagauauugagcagauggcuaaugggaucgcccugggauuaauggcccucaagcugauuacccaguuugagacauaucaacuuuggacugcucugaucuccuugaccuguucaaacacgauauucacacucaccgucgcauggcgaacugccacccugauccuagcgggugugagucugcuuccuguuugccagagcucguccaugcggaaaacagacuggcucccaaugacuguggcugccaugggcgucccaccucugcccuuguuuauuuucucucugaaggauaccuuaaagcguagaagcuggccacucaaugaagggguaauggcagugggacugguuucaauccuugccaguucccuguugaggaacgacgugccuauggcuggcccccucgucgccggugggcugcuaauugccuguuacgugaucacgggaacaucugcggaucugaccguagagaaagcugccgacgugacuugggaagaggaagcagagcagacaggcgucagccacaaccuuaugauaaccguugacgaugacggcacuaugcgcauuaaggaugacgagacagaaaauauccucaccgugcuguugaaaacggccuuacugaucguguccgggauuuuuccauacucaauaccggcuacucuccuggucuggcauaccuggcagaagcaaacacagcggagcggagugcuuugggauguuccuagucccccagagacccagaaagccgaacuggaggaggguguauauagaaucaagcagcaaggcauuuucgggaaaacacaggugggagucggcgugcagaaggaagguguuuuucacacuauguggcaugugaccagaggggcagucuugacguacaacggaaagcgacuagagcccaauugggcuucugugaaaaaggaccugaucuccuauggcggcggguggcgccucagcgcccaauggcagaaaggagaagagguacaggucauugcgguggaaccugguaagaaccccaagaauuuccagacaaugcccggcacuuuccaaaccacaaccggggagaucggagccauagcacuggauuuuaagccuggcacuucggguucaccgaucauuaaccgggaggggaagguugugggacuuuacggcaauggcgucgugaccaaaaacgggggauauguuucugguaucgcucagacaaaugccgaaccagacggccccacgccugaguuagaagaggaaauguucaagaaaagaaaccugacuauuauggaucuccacccagggaguggaaagaccaggaaauacuugcccgcuaucgugcgugaggcaauaaagcgccggcugagaacacucauucuggccccuaccagggucguggccgcugagauggaagaggcgcuuaagggccugccgauccgauaucagacuacagcaaccaaauccgaacacacgggucgggagaucguagacuugaugugccaugccacuuuuacaaugcgccuacugagccccgugagaguuccaaauuacaaccucauuaucauggaugaagcucacuucaccgacccugccucuauagcagccaggggguacauuagcacccgggucggaaugggcgaggcugcggccaucuuuaugacugcaacacccccaggcaccgcugaugccuucccucaguccaaugcacccauucaagacgaggaacgagacaucccagagagaucauggaacagugggaaugaauggauaacagauuuugccggaaagacugugugguucgugccgagcauuaaagcugguaacgacaucgccaacuguuuacgcaagaauggcaaaaaggucauccagcugucuaggaagacguuugauaccgaguaucagaaaacaaaacuuaacgacugggauuucguagugacuaccgacauuuccgagaugggggcgaauuuuaaagcagaucguguuaucgacccucggagaugccugaagcccgugauucucacagauggaccagaaagggucauauuggccggccccaugccugugaccgcugccucagcugcacagcgccgagguagaguugggcggaacccacaaaaagagaaugaccaguacaucuucacuggccagccccugaacaaugaugaagaccaugcccacuggacggaggcuaagaugcuccuggacaacauuaauaccccugaaggaaucaucccggcccuuuucgagccagagagggaaaagagugcagcgauugauggcgaguaucgccuaaaaggggaaagccguaagacauuuguggagcugaugagacggggagacuugcccgucugguuagcccauaaaguggcuuccgaagguauaaaguacacugauaggaaauggugcuucgacggccagcgcaacaaucaaauccuggaggagaacauggauguagaaauuuggaccaaggagggggagaagaagaagcuccgaccuagauggcuggacgcccggacauauucugauccccuugcacugaaagaguuuaaggacuucgcugccggaaggaaaucgaucgcacucgauuuggugaccgaaauuggccgcguuccaacucaccuggcccacagaacaaggaaugcucuagacaaccuggucaugcuccauacgagcgagcacggugggaaggcguaccggcaugccguggaggaacuuccugagaccauggaaacucuguuauugcugggccucaugauccugcuuacaggaggcgcaaugcuguuucucauaucagggaaaggaaucgguaagaccuccauuggcuugaucugugugauugcuaguucugggaugcuguggauggccgagauccccuuacaguggauagccagcgcaauuguccuagaguucuuuaugaugguucugcucaucccagaaccugagaagcagcguaccccgcaagauaaucagcuugcuuaugugguaauuggaauccugacauuggccgcgacuauagcugccaacgaaaugggccugcucgagacgaccaaacgcgaccuggguauguccaaggaacccgggguggucucaccaacaucuuaccuugauguggaccuccacccugcaagcgccuggacucuguacgcuguugcaaccacagugaucacccccauguugcgacacacuauugagaauaguacggccaacgucucccuggcggcuaucgccaaccaggcaguaguguuaaugggccuagacaaaggauggccaauuagcaagauggaucugggcguuccucuccuugcccuggggugcuauucucaggugaaucccuugacacugaccgcugccguccuccugcuuaucacucauuacgcaauaauuggaccgggcuuacaagcuaaagccaccagagaggcgcagaagaggacagccgcagguaucaugaagaacccaacuguggacgggaucaugaccauugaucuggacccugucaucuaugauucaaaauucgaaaagcagcucggacaggugauguugcugguucuaugugcugugcaacugcuccuuaugcggacauccugggcccugugcgaggcauugacgcuggcuaccggccccauaacuacacucugggaagguaguccaggcaaauuuuggaauaccacuauugccguaagcauggccaacaucuuccgcgggucguaccuggcgggagcuggcuuagcauuuucuauuaugaaguccguggggacaggaaaaagaggcaccgguagccagggggagacgcuuggagaaaaguggaagaaaaagcugaaucagcucucaaggaaagaguucgaccuauauaagaaaaguggcaucaccgaggucgaucggacagaagccaaggagggucugaaacgaggcgaaauaacucaccaugcuguuucuagaggguccgccaaguugcagugguuuguggagcgcaacauggucauccccgaaggaagggugauugaccugggcugugggcggggaggcuggagcuacuauugcgcaggucucaagaaaguaaccgaggugcguggguacacaaagggaggcccuggccacgaggaaccgguucccaugucaacuuacggguggaauaucgugaaacuuaugaguggaaaggaugucuucuaucugccaccugagaaaugugacaccuugcugugcgauauuggugaaagcucccccucuccuacaguggaggagagcagaaccaucaggguccucaagaugguggaaccaugguuaaagaacaaucaauucuguauuaaaguucugaaccccuacaugccuacuguaaucgagcaucuugaacgccugcagcggaagcacggcgggaugcuagugcgaaauccacucuccagaaacucaacgcacgagauguauuggauaucuaauggaacaggcaacauugucgccagugugaauaugguuucgaggcuguugcugaaccgcuuuaccaugacucaucggagacccaccaucgaaaaagacguggaucucggugcugggacacgucacgucaacgcggagccggagacgccuaauauggacgugaucggagaaaggauuaagcggauaaaagaggaacauaacagcaccuggcacuacgacgaugagaauccauauaagacuugggccuaccacggcuccuaugaaguaaaggcaacaggcucugcuucaagcaugaucaacggggugguuaaacuucugaccaagcccugggacgucgugccuauggugacucagauggccaugacagauaccacaccauucggacaacagcgcgucuuuaaagagaagguugacacucgaacccccagauccaugccggguacgaggcgggugaugggcauuaccgcagagugguuauggcgcacacuggggagaaauaaaaagccuagguugugcacucgagaagaguucaccaagaaaguacggacaaacgccgcuaugggagccguguuuacugaagagaaucagugggauagugcgaaggcagccgucgaagacgaggauuucuggaaacucguggaccgugagagagaacugcauaagcuaggcaaaugugguucuugcguuuacaacaugauggggaagcgcgagaagaaacuuggagaauuuggcaaagcuaaaggcagcagggccaucugguacauguggcugggggcacgguaucucgaguucgaggcucugggauuuuugaaugaagaucacugguucucaagagagaacuccuacagugguguggaaggcgaggggcugcauaagcucggauauauucuucgcgacaucagcaaaauacccggcggugccauguacgcugaugacaccgccgggugggacacgaggaucacagaagaugaccugcacaaugaggagaagauuacccagcaaauggauccagaacaucgacaguuagcaaacgcgaucuuuaaacugacuuaucagaauaaggucgugaagguacagcggccuacacccaccggaacuguuauggacauuaucucuagaaaagaucaaaggggcuccggccagguggggaccuacggauugaacacauucacgaauauggaggcccagcucauacgccagauggaaggugagggcguccugucaaaggcugaccuagaaaacccacaccuucccgagaaaaagauuacccaauggcuggagacuaaagggguggaacgucucaagcggauggccaucagcggagaugacugcguggucaagccuaucgaugacagauuugcaaacgcucuguuggccuuaaaugauaugggcaaaguuaggaaggacauuccacaguggcagccgucgaaagguuggcacgauuggcagcaagugcccuucuguucucaucacuuccaugagcugauaaugaaggacgggcgcaaacucguagugccuugccgaccacaggacgaacuuaucggacgggcaagaauuagucagggcgccggcuggucccugagggagacagcgugucuagggaaggcuuaugcccaaauguggagccugauguacuuucaccgcagagaucuccgguuggcaucaaacgccaucugcuccgcuguccccgugcacuggguuccuaccucuaggacuacauggagcauucaugcccaccaucaguggaugaccacggaagacaugcugacaguguggaaucgugucuggaucgaggauaacccauggauggaggacaagacccccgugacuaccugggaaaauguaccuuaccuuggaaaacgagaggaucaguggugugguagucugauaggccucacaucccgcgcaacuugggcucagaacaucccgaccgccauucaacagguuaggagcuuaaucgggaaugaagaguuccuggacuauaugccaucuaugaagcgguuuaggaaagaggaagagucagaaggagcgauuugguga

SEQ ID NO: 15515 - RNA, 9873 nt, Artificial Sequence
  derived and/or modified CDS sequence (opt3) from DENV-3__FJ639782__SS-prME
accagccugugccucaugaugauccuuccagccgcucuggcauuccacuugacauccagagacggcgagccuaggaugauuguggggaagaacgaacggggaaaaucuuuacuguuuaagacugccucagguauaaauauguguacgcuaaucgcgauggaucucggcgaaaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucucucugaaggauaccuuaaagcguagaagcuggccacucaaugaaggggugauggccguuggacuggugucaauccuugcaaguucccuguugaggaacgacgucccuauggccggcccccucguggcuggugggcugcuaauugcauguuacguaaucacgggaacaucugccgaucugaccguggagaaagcggcugacgucacuugggaagaggaagccgagcagacaggcguuagccauaaccuuaugauaaccguggacgaugacggcacuaugcgcauuaaggaugacgagacagaaaauauccucaccgugcuguugaaaacggcauuacugaucgucuccgggauuuuuccauacucaauaccggccacucuccugguguggcacaccuggcagaagcagacacaacggagcggaguucuuugggauguaccuagucccccagagacccagaaagcugaacuggaggaggguguguauagaaucaagcagcagggcauuuucgggaaaacacaagucggagugggcguucagaaggaagguguguuucauacuauguggcacgucaccagaggggccguguugacguacaacggaaagcgacuagagcccaauugggcaucugucaagaaggaccugaucuccuauggcggcggguggcgccucagcgcucaguggcaaaaaggagaagagguccaggugauugccguugaaccugguaagaaccccaagaauuuccagacaaugcccggcacuuuccagaccacaaccggggagaucggagcgauagcccuggauuuuaagccuggcacuucggguucaccgaucauuaaccgggaggggaagaucgugggacuuuacggcaauggcgucgugaccaaaaacgggggauauguuucugguauugcacaaacaaaugcugaaccagacggccccacgccugaguuagaagaggaaauguucaagaaaagaaaccugacuaucauggaucuccacccagggaguggaaagaccaggaaauacuugcccgccauagugcgugaggcuauuaagcgccggcugagaacacucauccuggcaccuaccagggucguggccgccgagauggaagaggcucuuaagggccugccgauccgauaucagacuacagcgaccaaauccgaacauacgggucgggagauuguagacuugaugugccacgcaacuuuuacaaugcgccuacugagccccgugagaguuccaaauuacaaccucaucauaauggaugaagcccauuucaccgacccugcuucuauugccgcaaggggguacaucagcacccgggucggaaugggcgaggccgcugcgauuuuuaugacugccacacccccaggcaccgcagaugcuuucccucaguccaaugcccccauccaggacgaggaacgagacauaccagagagaucauggaacagugggaaugaauggauuacagauuuugcaggaaagacugugugguucgugccgagcaucaaagccgguaacgacaucgcuaacuguuuacgcaagaauggcaaaaaggucauucaacugucuaggaagacguuugauaccgaguaucagaaaacaaaacuuaacgacugggauuucguagugacuaccgacaucuccgagaugggggccaauuuuaaagcggaucguguuauugacccucggagaugccugaagcccgugauacucacagauggaccagaaagggucaucuuggcaggccccaugccugugaccgccgcuucagccgcucagcgccgagguagaguugggcggaacccacagaaagagaaugaccaauacauuuucacuggccagccccugaacaaugaugaagaccacgcacauuggacggaggccaagaugcuccuggacaacaucaauaccccugaaggaaucauuccggcucuuuucgagccagagagggaaaagagugccgcaauagauggcgaguaucgccuaaaaggggaaagccguaagacauuuguggagcugaugagacggggagacuugcccgucugguuagcgcacaaaguggccuccgaagguaucaaguacacugauaggaaauggugcuucgacggccagcgcaacaaucagauucuggaggagaacauggauguagaaaucuggaccaaggagggggagaaaaagaagcuccgaccuagauggcuggacgcucggacauauucugauccccuugcccugaaagaguuuaaggacuucgcagcuggaaggaaaucgauugcccucgauuuggugaccgaaaucggccgcguuccaacucaccuggcacauagaacaaggaaugcccuagacaaccuggucaugcuccacacgagcgagcauggugggaaggcuuaccggcacgcgguggaggaacuuccugagaccauggaaacucuguuauugcugggccucaugauacugcuuacaggaggcgccaugcuguuucucaucucagggaaaggaauugguaagaccuccaucggcuugauuugugugaucgcaaguucugggaugcuguggauggcugagauacccuuacaauggauugccagcgccaucguccuagaguucuuuaugaugguucugcucauuccagaaccugagaagcagcguaccccgcaggauaaucaacuugcauaugugguaaucggaauacugacauuggcugccacuaucgcggcuaacgaaaugggccugcucgagacgaccaaacgcgaccuggguauguccaaggaacccgggguggucucaccaacaucuuaccuugauguggaccuccacccugccagcgcauggacucuguacgccguugcuaccacagugauuacccccauguugcgacauacuaucgagaauaguacggcaaacgucucccuggccgcgauugcuaaccaggccguaguguuaaugggccuagacaaaggauggccaaucagcaagauggaucugggcguuccucuccuugcacuggggugcuauucucaggugaaucccuugacacugaccgccgcuguccuccugcuuauaacucacuacgccauuaucggaccgggcuuacaggcaaaagcuaccagagaggcccaaaagaggacagcggccgguaucaugaagaacccaacuguggacgggauuaugaccaucgaucuggacccugucauauaugauucaaaauucgaaaagcagcucggacaggugauguugcugguucuaugugcagugcagcugcuccuuaugcggacauccugggcucugugcgaggccuugacgcuggcaaccggccccauuacuacacucugggaagguaguccaggcaaauuuuggaauaccacuaucgcuguaagcauggccaacauuuuccgcgggucguaccuggccggagcgggcuuagcuuuuucuaucaugaaguccguggggacaggaaaaagaggcaccgguagccaaggggagacgcuuggagaaaaguggaagaaaaagcugaaucagcucucaaggaaagaguucgaccuauauaagaaaaguggcauaaccgaggucgaucggacagaagcaaaggagggucugaaacgaggcgaaaucacucaucacgccguuucuagaggguccgcuaaguugcagugguuuguggagcgcaacauggucauucccgaaggaagggugaucgaccugggcugugggcggggaggcuggagcuacuauugcgccggucucaagaaaguaaccgaggugcguggguacacaaagggaggcccuggccaugaggaaccgguucccaugucaacuuacggguggaauauugugaaacuuaugaguggaaaggaugucuucuaucugccaccugagaaaugugacaccuugcugugcgauaucggugaaagcucccccucuccuacaguggaggagagcagaaccauuaggguccucaagaugguggaaccaugguuaaagaacaaucaguucuguaucaaaguucugaaccccuacaugccuacuguaauagagcaccuugaacgccugcaacggaagcacggcgggaugcuagugcgaaauccacucuccagaaacucaacgcaugagauguauuggauuucuaauggaacaggcaacaucgucgcaagugugaauaugguuucgaggcuguugcugaaccgcuuuaccaugacuuaccggagacccaccaucgaaaaagacguggaucucggugccgggacacgucacgucaacgcugagccggagacgccuaauauggacgugauuggagaaaggauaaagcggaucaaagaggaacauaacagcaccuggcacuaugacgaugagaauccauacaagacuugggcguaucacggcuccuacgaaguaaaggccacaggcucugcaucaagcaugauuaacggggugguuaaacuucugaccaagcccugggacgucgugccuauggugacucagauggcuaugacagauaccacaccauucggacagcaacgcgucuuuaaagagaagguugacacucgaacccccagauccaugccggguacgaggcgggugaugggcaucaccgccgagugguuauggcgcacacuggggagaaauaaaaagccuagguugugcacucgagaagaguucaccaagaaaguacggacaaacgcagccaugggagcuguguuuacugaagagaaucagugggauagugccaaggcggcagucgaagacgaggauuucuggaaacucguggaccgugagagagaacugcauaagcuaggcaaaugugguucuugcguuuacaacaugauggggaagcgcgagaagaaacuuggagaauuuggcaaagccaaaggcagcagggcuauuugguauauguggcugggggcccgguaccucgaguucgaggcacugggauuuuugaaugaagaucacugguucucaagagagaacuccuauagugguguggaaggcgaggggcugcauaagcucggauacauccuucgcgacauaagcaaaauccccggcggugcuauguaugccgaugacaccgcugggugggacacgaggauuacagaagaugaccugcacaaugaggagaagaucacccagcagauggauccagaacaucgacaauuagccaacgcaauuuuuaaacugacuuaccagaauaaggucgugaagguacagcggccuacacccaccggaacuguuauggacaucauaucuagaaaagaucagaggggcuccggccaaguggggaccuauggauugaacacauucacgaauauggaggcgcagcucauucgccagauggaaggugagggcguccugucaaaggccgaccuagaaaacccacaccuucccgagaaaaagaucacccaguggcuggagacuaaagggguggaacgucucaagcggauggcuaucagcggagaugacugcguggucaagccuauugaugacagauuugccaacgcacuguuggcuuuaaaugauaugggcaaaguuaggaaggacauaccacaauggcagccgucgaaagguuggcacgauuggcaacaggugcccuucuguucucaucacuuccaugagcugaucaugaaggacgggcgcaaacucguagugccuugccgaccacaagacgaacuuauuggacgggccagaaucagucagggcgcaggcuggucccugagggagacagccugucuagggaaggcguacgcucagauguggagccugauguacuuucaccgcagagaucuccgguuggccucaaacgcaauuugcuccgccguccccgugcacuggguuccuaccucuaggacuacauggagcauccaugcucaccaucaauggaugaccacggaagacaugcugacaguguggaaucgugucuggauagaggauaacccauggauggaggacaagacccccgugacuaccugggaaaauguaccuuaucuuggaaaacgagaggaucaguggugugguagucugaucggccucacaucccgcgccacuugggcacagaacauuccgaccgcuauccagcaaguuaggagcuuaauugggaaugaagaguuccuggacuacaugccaucuaugaagcgguuuaggaaagaggaagagucagaaggagccaucugguga

SEQ ID NO: 15516 - RNA, 9873 nt, Artificial Sequence
  derived and/or modified CDS sequence (opt3) from DENV-3__FJ639785__SS-prME
accagccugugccucaugaugauccuucccgccgcucuggcauuccacuugaccuccagagacggagagccuaggaugauuguggggaagaacgaacggggaaaaucuuuacuguuuaagacugccucagguauaaauauguguacgcuaaucgcgauggaucucggcgaaaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacaccauuggcguccucgagcaggggaaaagaacucugacaccacagccuauggaguuaaaguacucauggaaaaccuggggaaaggccaagaucgugacagcggaaacucaaaacaguuccuucauaauugauggccccaauaccccagagugccccagcgccucuagggcuuggaacguuugggaaguggaggacuaugguuuuggggucuucacgacaaauaucuggcugaaacuucgggaaguguacacccaguugugugaccaccgccucaugucagcagccguuaaggaugagagagcugugcacgccgacaugggauacuggauugagagucagaaaaacggcagcuggaagcuggaaaaagcaucccuaaucgagguaaagacuugcaccuggccuaagucucauacacuguggucgaaugguguccucgaaagcgauaugauaaucccaaaaucccuggcgggcccgauuucacagcacaacuauaggcccggguaccauacucaaaccgccggaccuuggcaccuuggcaaguuggagcuggacuuuaauuauugcgaggggacaacgguggugaucaccgaaaacuguggaacucguggcccaaguuuacggacaaccacugucucugguaaacucauucacgaguggugcugucgaagcugcacacugcccccucuuagauacaugggggaagauggauguugguauggcauggagaucaggccaauauccgaaaaggaggagaauaugguuaaaucacuggugagcgcugguucuggcgaaguagacaacuucaccauggggguguugugccucgccauucuguuugaggaagucaugcgcggaaaguucggcaagaaacauaugaucgcagggguguucuuuacguucguucuacugcucuccggacagaucacuuggcgggauauggcucacacccugauuaugaucggcaguaaugccagcgacagaauggguaugggggugacauaccuugcauugauugccaccuuuaagauacagcccuuccuggcuuuaggauuuuuccucaggaaacugacuucucgcgagaaccuucugcuaggcgucggccucgcgauggccacaacccugcaauugccggaagauaucgagcagauggcaaaugggauugcucugggauuaauggcccucaagcugaucacacaguuugagacuuaucagcuuuggaccgcccugauuuccuugacguguucaaacacaaucuucacccucacuguggcuuggcgaaccgcaacacugauacuagccgguguuagucugcuuccugugugccaaagcucguccaugcggaaaacugacuggcucccaaugaccgucgcggcuaugggcguacccccucugcccuuguuuaucuucucucugaaggauacguuaaagcguagaagcuggccacucaaugaaggggugauggccguuggacuggugucaauucuugcaaguucccuguugaggaacgacgucccuauggccggcccccucguggcuggugggcugcuaaucgcauguuacguaauuacaggaaccucugccgaucugacuguggagaaagcggcugacgucacaugggaagaggaagccgagcagaccggcguuagccauaaccuuaugaucacuguggacgaugacggcacaaugcgcauaaaggaugacgagaccgaaaauauucucacggugcuguugaaaacugcauuacugaucgucuccgggaucuuuccauacucaauuccggccacccuccugguguggcacacauggcagaagcagacccaacggagcggaguucuuugggauguaccuagucccccagagacacagaaagcugaacuggaggaggguguguauagaauaaagcagcagggcaucuucgggaaaacucaagucggagugggcguucagaaggaagguguguuucauaccauguggcacgucacgagaggggccguguugacauacaacggaaagcgacuagagcccaauugggcaucugucaagaaggaccugauuuccuauggcggcggguggcgccucagcgcucaguggcaaaaaggagaagagguccaggugaucgccguugaaccugguaagaaccccaagaauuuccagacuaugcccggcaccuuccagacaaccacuggggagauuggagcgaucgcccuggauuuuaagccuggcaccucggguucaccgauaaucaaccgggaggggaagguggucggacuuuacggcaauggcgugguuaccaaaaacgggggauaugugucugguauugcacaaacgaaugcugaaccagacggccccacuccugaguuagaagaggaaauguucaagaaaagaaaccugaccaucauggaucuccacccagggaguggaaagacaaggaaauacuugcccgccauuguccgugaggcuaucaagcgccggcugagaacccucauacuggcaccuacuagggugguagccgccgagauggaagaggcucuuaagggccugccgauucgauaucagacaaccgcgacgaaauccgaacauacuggucgggagaucguggacuugaugugccacgcaacauuuaccaugcgccuacugagccccguuagagucccaaauuacaaccucaucauuauggaugaagcccauuucaccgacccugcuucuaucgccgcaaggggguacauaagcacucgggugggaaugggcgaggccgcugcgauuuuuaugacagccacaccaccaggcacagcagaugcuuucccucaguccaaugcccccauccaggacgaggaacgagacauuccagagagaucauggaacagugggaaugaauggaucacugauuuugcaggaaagacggugugguucgucccgagcauaaaagccgguaacgacauugcuaacuguuuacgcaagaauggcaaaaagguaauccaacugucuaggaagaccuuugauacagaguaucagaaaacuaaacuuaacgacugggauuucgugguuaccacagacaucuccgagaugggggccaauuuuaaagcggaucgugugauugacccucggagaugccugaagcccgucauccucaccgauggaccagaaagggugauuuuggcaggccccaugccuguuacugccgcuucagccgcucagcgccgagguagaguggggcggaacccacagaaagagaaugaccaauacauauucacgggccagccccugaacaaugaugaagaccacgcacauuggaccgaggccaagaugcuccuggacaacaucaauacaccugaaggaauuaucccggcucuuuucgagccagagagggaaaagagugccgcaaucgauggcgaguaucgccuaaaaggggaaagccguaagacuuuugucgagcugaugagacggggagacuugcccgugugguuagcgcacaaaguagccuccgaagguauuaaguacaccgauaggaaauggugcuucgacggccagcgcaacaaucagauacuggaggagaacauggauguggaaaucuggacaaaggagggggagaaaaagaagcuccgaccuagauggcuggacgcucggaccuauucugauccccuugcccugaaagaguuuaaggacuucgcagcuggaaggaaaucgauugcccucgauuugguuacugaaaucggccgcgucccaacacaccuggcacauagaacgaggaaugcccuagacaaccuggugaugcuccacaccagcgagcauggugggaaggcuuaccggcacgcgguggaggaacuuccugagacuauggaaacacuguuauugcugggccucaugauucugcuuaccggaggcgccaugcuguuucucaucucagggaaaggaauagguaagaccuccaucggcuugauuugugucaucgcaaguucugggaugcuguggauggcugagauucccuuacaauggaucgccagcgccauaguucuagaguucuuuaugauggugcugcucauuccagaaccugagaagcagcguacaccgcaggauaaucaacuugcauauguagugaucggcauucugacuuuggcugccacgaucgcggcuaacgaaaugggccugcucgagaccacaaaacgcgaccuggguauguccaaggaacccggggucgugucaccaacuucuuaccuugauguugaccuccacccugccagcgcauggacccuguacgccguggcuacaaccgucauaacucccauguugcgacauacgaucgagaauaguacagcaaacguaucccuggccgcgauugcuaaccaggccgugguuuuaaugggccuagacaaaggauggccaaucagcaagauggaucugggcgugccucuccuugcacuggggugcuauucucaggucaaucccuugacccugacugccgcugugcuccugcuuauuacccacuacgccaucauaggaccgggcuuacaggcaaaagcuacaagagaggcccaaaagaggacugcggccgguauuaugaagaacccaaccgucgacgggaucaugacaaucgaucuggacccugugauuuaugauucaaaauucgaaaagcagcucggacagguuauguugcuggugcuaugugcaguacagcugcuccuuaugcggacguccugggcucugugcgaggccuugacccuggcaacuggccccaucacaacccucugggaagguaguccaggcaaauuuuggaauacuacaauagcugugagcauggccaacauuuuccgcgggucguaccuggccggagcgggcuuagcuuuuucuaucaugaaguccgucgggaccggaaaaagaggcacggguagccaaggggagacccuuggagaaaaguggaagaaaaagcugaaucagcucucaaggaaagaguucgaccuauauaagaaaaguggcauuacagagguugaucggacugaagcaaaggagggucugaaacgaggcgaaaucacccaucacgccgugucuagaggguccgcuaaguugcagugguuugucgagcgcaacauggugauacccgaaggaaggguaaucgaccugggcugugggcggggaggcuggagcuacuauugcgccggucucaagaaagugacagagguucguggguacacuaagggaggcccuggccaugaggaaccggugcccaugucaaccuacggguggaauauugucaaacuuaugaguggaaaggauguguucuaucugccaccugagaaaugugacacauugcugugcgauaucggugaaagcucccccucuccuaccgucgaggagagcagaacuauuagggugcucaagaugguugaaccaugguuaaagaacaaucaguucuguaucaaaguacugaaccccuacaugccuacggugauugagcaccuugaacgccugcaacggaagcacggcgggaugcuaguccgaaauccacucuccagaaacucaacacaugagauguauuggaucucuaauggaaccggcaacauaguggcaaguguuaauauggugucgaggcuguugcugaaccgcuuuacuaugacccaccggagacccacaauugaaaaagacgucgaucucggugccgggacgcgucaugugaacgcugagccggagaccccuaauauggacguaaucggagaaaggaucaagcggauuaaagaggaacacaacagcacuuggcacuacgacgaugagaauccauauaagacaugggcguaccauggcuccuaugaagugaaggccaccggcucugcaucaagcaugauaaacgggguugucaaacuucugacuaagcccugggacguggugccuauggucacacagauggcuaugaccgauacaacuccauucggacagcaacgcguuuuuaaagagaagguggacacccgaacgcccagauccaugccggguaccaggcggguaaugggcaucacagccgagugguuauggcgcacucuggggagaaauaaaaagccuagguugugcacccgagaagaguucacaaagaaagugcggacuaacgcagccaugggagcugucuuuaccgaagagaaucagugggauagugccaaggcggcaguggaagacgaggauuucuggaaacucguugaccgugagagagaacugcacaagcuaggcaaaugugguucuugcguguacaacaugauggggaagcgcgagaagaaacuuggagaauuuggcaaagccaaaggcagcagggcuauuugguacauguggcugggggcccgguaucucgaguucgaggcacugggauuuuugaaugaagaucauugguucucaagagagaacuccuacaguggugucgaaggcgaggggcugcacaagcucggauauauccuucgcgacauuagcaaaauccccggcggugcuauguacgccgaugacacggcugggugggacacaaggauaaccgaagaugaccugcauaaugaggagaagaucacucagcagauggauccagaacaccgacaauuagccaacgcaauuuuuaaacugacauaucagaauaaggugguaaagguucagcggccuacccccacuggaaccgugauggacaucauuucuagaaaagaucagaggggcuccggccaagucgggacauacggauugaacacguucaccaauauggaggcgcagcucauccgccagauggaaggugagggcgugcugucaaaggccgaccuagaaaacccacaccuucccgagaaaaagauaacucaguggcuggagacaaaagggguggaacgucucaagcggauggcuauuagcggagaugacugcgucguuaagccuaucgaugacagauuugccaacgcacuguuggcuuuaaaugauaugggcaaagugaggaaggacaucccacaauggcagccgucgaaagguuggcaugauuggcagcagguacccuucuguucucaccauuuccacgagcugauuaugaaggacgggcgcaaacucguggucccuugccgaccacaagacgaacuuauaggacgggccagaaucagucagggcgcaggcuggucccugagggagaccgccugucuagggaaggcguaugcucagauguggagccugauguacuuucaccgcagagaucuccgguuggccucaaacgcaauuugcuccgccgugcccguucauugggugccuacuucuaggacaaccuggagcauccacgcucaucaccaauggaugacgacagaagacaugcugaccgucuggaaucguguguggauugaggauaacccauggauggaggacaagacucccguaaccacaugggaaaauguuccuuaccuuggaaaacgagaggaucaguggugugguagucugaucggccucacuucccgcgccaccugggcacagaacauaccgacagcuauccagcaagugaggagcuuaauugggaaugaagaguuccuggacuauaugccaucuaugaagcgguuuaggaaagaggaagagucagaaggagccaucugguga

SEQ ID NO: 15517 - RNA, 9873 nt, Artificial Sequence
  derived and/or modified CDS sequence (opt3) from DENV-3__FJ639786__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuugggccagcggggcaacaaccgaaacuccaacauggaauaggaaagagcuucugguaacguuuaagaacgcucacgccaaaaagcaagaaguuguggucuugggcucccaggagggagcuaugcacaccgcccucacuggcgcaacagaaauucagaauucagggggaaccaguauauucgccggucaucugaagugucgguuaaaaauggacaagcuggagcuaaaaggcaugagcuacgcuaugugcacaaacacuuuugugcucaagaaagaggucucugaaacccagcacgggacgauccugauuaagguggaguacaagggagaagauguucccuguaaaaucccuuucuccaccgaggacggccaagguaaggcgcauaacgggcgucuuauaacagcaaauccagugguaacuaaaaaggaggaacccgucaacauugaggccgaaccgccuuucggcgagucaaauaucgugaucggaauuggcgauaacgcuuugaaaaucaauugguauaagaaggggagcaguauuggaaaaauguuugaagccaccgcacgcggugccagaaggauggcuauacugggcgacacagccugggauuucgggucuguuggaggcgugcucaacucccuggguaagaugguccaccagaucuuugggagcgcauacacugcgcuuuucucgggcgugucuuggguaaugaaaauuggaaucggcgugcuguugaccuggaucgggcucaauuccaagaacacgucaaugaguuuuagcugcauugcuauaggaaucauuacacuguauuuaggcgccguuguccaggcagacauggguugugugaucaauuggaaagggaaggagcugaagugcggauccggcauuuucgugaccaacgagguccauacuuggacagaacaguacaaauuucaagccgauucucccaagcggcuagcuaccgccaucgcaggugcuugggagaauggcguuugugggauacgaagcacuacccgcauggaaaaccuccuguggaaacagaucgccaaugagcuuaacuauauuuugugggaaaauaacaucaagcugacaguggugguaggagacauuaucggcguccucgagcaggggaaaagaacgcugaccccacagccuauggaguuaaaguacucauggaaaacuuggggaaaggcgaagauagugacagccgaaacccaaaacaguuccuucauuaucgauggccccaauacaccagagugccccagcgcuucuagggcauggaacguuugggaaguggaggacuaugguuuuggggucuucacuaccaauauuuggcugaaacuucgggaaguguacacgcaguugugugaccaccgccucaugucagccgcuguuaaggaugagagagccgugcacgcagacaugggauacuggaucgagagucagaaaaacggcagcuggaagcuggaaaaagcgucccuaauagagguaaagacaugcaccuggccuaagucucauacucuguggucgaaugguguccucgaaagcgauaugaucauuccaaaaucccuggccggcccgaucucacagcacaacuauaggcccggguaccauacccaaacagcuggaccuuggcaccuuggcaaguuggagcuggacuuuaauuauugcgaggggacuaccguggugauuacagaaaacuguggaacgcguggcccaaguuuacggaccacuacagucucugguaaacucauccacgaguggugcugucgaagcugcacccugcccccucuuagauacaugggggaagauggauguugguauggcauggagauaaggccaauuuccgaaaaggaggagaauaugguuaaaucacuggugagcgccgguucuggcgaaguagacaacuucacuauggggguguugugccucgcaauccuguuugaggaagucaugcgcggaaaguucggcaagaaacauaugaucgcugggguguucuuuacauucguucuacugcucuccggacagauuaccuggcgggauauggcccacacgcugaucaugauuggcaguaaugcaagcgacagaauggguaugggggugacuuaccuugccuugauagcuaccuuuaagauccagcccuuccuggcguuaggauuuuuccucaggaaacugacaucucgcgagaaccuucugcuaggcgucggccucgccauggcaaccacucugcaauugccggaagauauugagcagauggcuaaugggaucgcccugggauuaauggcccucaagcugauuacacaguuugagaccuaucagcuuuggacagcucugaucuccuugacuuguucaaacaccauauucacgcucacaguggcauggcgaaccgccacucugauccuagcggguguuagucugcuuccugugugccaaagcucguccaugcggaaaaccgacuggcucccaaugacagucgcugccaugggcguacccccucugcccuuguuuauuuucucucugaaggauacuuuaaagcguagaagcuggccacucaaugaaggggugauggcaguuggacuggugucaauccuugccaguucccuguugaggaacgacgucccuauggcuggcccccucguggcaggugggcugcuaauugccuguuacguaaucaccggaacgucugcggaucugacaguggagaaagcugccgacgucaccugggaagaggaagcagagcagacuggcguuagccauaaccuuaugauaacaguggacgaugacggcaccaugcgcauuaaggaugacgagacugaaaauauccucacagugcuguugaaaaccgccuuacugaucgucuccgggauuuuuccauacucaauaccggcuacgcuccugguguggcacacuuggcagaagcagacccaacggagcggaguucuuugggauguaccuagucccccagagacacagaaagccgaacuggaggaggguguguauagaaucaagcagcagggcauuuucgggaaaacccaagucggagugggcguucagaaggaagguguguuucauacaauguggcacgucacuaggggggcaguguugaccuacaacggaaagcgacuagagcccaauugggcuucuguaaaaaaggaccugaucuccuauggcggcggguggcgccucagcgcccaguggcaaaaaggagaagagguccaggugauugcgguugaaccugguaagaacccaaaaaauuuccagacgaugcccggcacauuccagacuaccacaggggagaucggagccauagcacuggauuuuaagccuggcaccucggguucaccgaucauuaaccgggaggggaagguggucggacuuuacggcaauggcgugguuacuaaaaacgggggauaugugucugguaucgcucaaaccaaugccgaaccagacggccccacaccugaguuagaagaggaaauguucaagaaaagaaaccugacgauuauggaucuccacccagggaguggaaagacuaggaaauacuugcccgcuaucguccgugaggcaauaaagcgccggcugagaacccucauucuggccccuacaagggugguagccgcugagauggaagaggcgcuuaagggccugccgauccgauaucagaccacugcaacaaaauccgaacauaccggucgggagaucguggacuugaugugccacgccacguuuacuaugcgccuacugagccccguuagagucccaaauuacaaccucauuaucauggaugaagcucauuucacagacccugccucuauagcagccaggggguacauuagcacccgggugggaaugggcgaggcugcggccaucuuuaugaccgcaacucccccaggcacagcugaugccuucccucaguccaaugcacccauucaggacgaggaacgagacaucccagagagaucauggaacagugggaaugaauggauaaccgauuuugccggaaagacagugugguucgucccgagcauuaaagcugguaacgacaucgccaacuguuuacgcaagaauggcaaaaagguaauccaacugucuaggaagacuuuugauacggaguaucagaaaaccaagcuuaacgacugggauuucgugguuacaacugacauuuccgagaugggggcgaauuuuaaaaccgaucgugugaucgacccucggagaugccugaagcccgucauucucacagauggaccagaaagggugauauuggcaggccccaugccuguuaccgccgcuucagccgcucagcgccgagguagaguggggcggaacccacagaaagagaaugaccaauacaucuucacuggccagccccugaacaaugaugaagaccacgcacauuggacggaggccaagaugcuccuggacaacauuaauaccccugaaggaaucaucccggcucuuuucgagccagagagggaaaagagugccgcaauugauggcgaguaucgccuaaaaggggaaagccguaagacauuugucgagcugaugagacggggagacuugcccgugugguuagcgcacaaaguagccuccgaagguauaaaguacacugauaggaaauggugcuucgacggccagcgcaacaaucagauccuggaggagaacauggauguggaaauuuggaccaaggagggggaaaaaaagaagcuccgaccuagauggcuggacgcucggacauauucugauccccuugcccugaaagaguuuaaggacuucgcagcuggaaggaaaucgaucgcccucgauuugguuaccgaaauuggccgcgucccaacucaccuggcacauagaacaaggaaugcccuagacaaccuggugaugcuccacacgagcgagcauggugggaaggcuuaccggcacgcgguggaggaacuuccugagaccauggaaacucuguuauugcugggccucaugauccugcuuacaggaggcgccaugcuguuucucauaucagggaaaggaaucgguaagaccuccauuggcuugaucugugucauugcaaguucugggaugcuguggauggcugagauccccuuacaauggauagccagcgccauuguucuagaguucuuuaugauggugcugcucaucccagaaccugagaagcagcguaccccgcaggauaaucaacuugcauauguagugauuggaauccugacauuggcugccauaaucgcggcuaacgaaaugggccugcucgagacuacgaaacgcgaccuggguauguccaaggaacccggggucgugucaccaaccucuuaccuugauguugaccuccacccugccagcgcauggacacuguacgccguggcuacuaccgucauuacacccauguugcgacauaccaucgagaauaguacugcaaacguaucccuggccgcgauugcuaaccaggccgugguuuuaaugggccuagacaaaggauggccaaucagcaagauggaucugggcgugccucuccuugcacuggggugcuauucucaggucaaucccuugacgcugacagccgcugugcuccugcuuauaacccacuacgccauuaucggaccgggcuuacaggcaaaagcuacuagagaggcccaaaagaggaccgcggccgguaucaugaagaacccaacagucgacgggauuaugacuaucgaucuggacccugugauauaugauucaaaauucgaaaagcagcucggacagguuauguugcuggugcuaugugcaguacagcugcuccuuaugcggaccuccugggcucugugcgaggccuugacacuggcaacgggccccauuaccacucucugggaagguaguccaggcaaauuuuggaauacaaccaucgcugugagcauggccaacauuuuccgcgggucguaccuggccggagcgggcuuagcuuuuucuaucaugaaguccgucgggacuggaaaaagaggcacagguagccaaggggagacccuuggagaaaaguggaagaaaaagcugaaucagcucucaaggcgggaguucgaccuauauaaaaagaguggcauaacggagguugaucgaaccgaagcaaaagagggucugaagagaggcgaaaucacacaucacgccgugucucgcggguccgcuaaauugcagugguuugucgagaggaacauggugauucccgaaggacggguaaucgaccugggcugugggcguggaggcuggagcuacuauugcgccggucucaagaaggugacugagguuagaggguacaccaaaggaggcccuggccaugaggaaccggugcccaugucaacauacggguggaauauugucaagcuuaugaguggaaaagauguguucuaucugccaccugagaagugugacacuuugcugugcgauaucggugaaagcucccccucuccuaccgucgaggagagcaggacaauucgcgugcucaaaaugguugaaccaugguuaaagaacaaucaguucuguaucaagguacugaaccccuacaugccuaccgugauagagcaccuugaacggcugcaacgaaaacacggcgggaugcuagucagaaauccacucuccaggaacucaacucaugagauguauuggauuucuaauggaacgggcaacaucguggcaaguguuaauauggugucgcgccuguugcugaaccgguuuacaaugacccacagacgucccacuaucgaaaaggacgucgaucucggugccgggaccaggcaugugaacgcugagccggagacaccuaauauggacguaauuggagaacggauaaaacgcaucaaggaggaacacaacagcacguggcacuacgacgaugagaauccauauaaaaccugggcguaccauggcuccuaugaagugaaggccacuggcucugcaucaagcaugauuaacgggguugucaagcuucugacaaaacccugggacguggugccuauggucacccagauggcuaugacugauacaaccccauucggacagcaacgaguuuuuaaggagaaaguggacacaagaacucccaggccgaugccugguacccggcgcguaaugggcaucacggccgagugguuauggagaacccuggggaggaauaagaaaccccgauugugcacacgggaagaguucacuaagaaggugcguaccaacgcagccaugggagcugucuuuacagaagagaaucagugggauuccgccaaagcggcaguggaagacgaggauuucuggaagcucguugacagagagcgcgaacugcacaaacuaggcaagugugguaguugcguguacaacaugauggggaaaagggagaagaaacuuggagaauuuggcaaggccaagggcucucgggcuauuugguacauguggcugggggccagauaucucgaguucgaggcacugggauuuuugaaugaagaucauugguucagccgcgagaacucauacuccggugucgaaggcgaggggcugcacaaacucggauauauccuuagggacauaaguaagaucccaggcggugcuauguacgccgaugacacugcugggugggacacccgaauuacggaagaugaccugcauaaugaggagaaaaucacacagcagauggauccugaacaccggcaauuagccaacgcaauuuuuaagcugaccuaucagaauaaagugguaaagguucagagacccacuccaacaggaaccgugauggacaucauaagcaggaaggaucagcgcggcucuggccaagucgggacuuacggauugaacaccuucacaaauauggaggcgcagcucauucgucagauggaaggugagggcgugcuguccaaagccgaccuagaaaacccccaccuuccugagaagaaaaucacgcaguggcuggagaccaaggggguggaacggcucaaaagaauggcuaucucaggagaugacugcgucguuaagccaauugaugacagguuugccaacgcacuguuggcuuuaaaugauaugggcaaggugcgcaaagacauaccgcaauggcagcccagcaaggguuggcaugauuggcagcagguaccuuucuguucgcaccauuuccacgagcugaucaugaaagacgggcgaaagcucguggucccaugccggccccaagacgaacuuauuggaagagccaggaucucucagggcgcaggcuggagucugcgcgagacugccugucuagggaaagcguaugcucagauguggucccugauguacuuucacagacgggaucucagguuggccagcaacgcaauuugcucagccgugccuguucauugggugccaacaucccguaccacuuggucuauccacgcucaucaccaauggaugacaaccgaagacaugcugacggucuggaaucgaguguggauagaggauaaccccuggauggaggacaagacaccuguaaccacuugggaaaauguuccguaccuuggaaagcgcgaggaucaguggugugguagccugaucggccucaccaguagagccacaugggcacagaacauuuccacugcuauccagcaagugcggagcuuaauugggaaugaagaguuccuggacuauaugccaucuaugaaaagguuucgcaaggaggaagagucagaaggagccaucugguga

SEQ ID NO: 15518 - RNA, 9873 nt, Artificial Sequence
  derived and/or modified CDS sequence (opt3) from DENV-3__FJ639787__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacgugguuguccgccgagggggcuuggaggcaggucgaaaaaguggagacuugggcacuccggcacccuggauucaccauucuggcccuguuucucgcucauuacaucggcacaucuuuaacucagaagguugugauauucauccugcuuauguuggucaccccaucgaugacaaugcgcugugugggcguagggaacagagacuuuguugaaggacugucaggugccaccuggguggaugucgugcuagagcacggcgggugcgugacgacuauggcgaagaauaaacccacacucgacauugagcugcagaagaccgaagcaacucaacuugccacacugaggaaauuguguaucgagggaaagauuaccaacaucacgaccgauagccggugcccuacacagggcgaagcuguccucccagaggaacaggaccagaauuauguuuguaaacacacuuacguggaucgcgguugggggaacggaugcggccuguucggcaaggggaguuuaguaaccugcgccaaguuucaaugucuggagcccauagagggaaaagugguccaguaugaaaaucucaaguacacagugauuaucacuguucauaccggugaccagcaccaggugggcaacgagacacaaggggucaccgcagaaauuacuccucaggcuuccacgacagaggccauccuuccagaauauggaacccugggcuuggagugcucuccgcgaacuggucuagacuucaaugagaugauccugcucaccaugaaaaacaaggcguggauggugcauagacagugguuuuucgaucugccccuuccuuggacaagcggggccaccacugaaacaccaacguggaauaggaaagagcuguugguaaccuuuaagaacgcacacgcuaaaaagcaagaaguugugguccucggcucccaggagggagccaugcacacugcucugacaggcgccaccgaaauucagaauucagggggaacaaguauauucgcaggucauuuaaagugucggcugaaaauggacaagcuagagcucaaaggcaugagcuacgccaugugcacuaacaccuuugugcugaagaaagaggucucugaaacgcagcacgggaccauccuuauuaagguggaguacaagggagaagauguucccuguaaaaucccuuucuccacagaggacggccaagguaaggcucauaacgggcguuugauaacugcgaauccagugguaaccaaaaaggaggaacccgucaacauugaggcagaaccgccuuucggcgagucaaauaucgugaucggaauuggcgauaacgcccugaaaaucaauugguauaagaaggggagcaguauuggaaaaauguuugaagcuacagcccgcggugcaagaaggauggccauacucggcgacacugcuugggauuucgggucuguuggaggcgugcugaacucccuugguaagaugguccaccagaucuuugggagcgccuacaccgcacuguucucgggcgugucuuggguaaugaaaauuggaaucggcguguugcucacguggaucgggcugaauuccaagaacacaucaaugaguuuuagcugcauugcgauaggaaucauuaccuuauaucugggcgcuguuguccaggccgacauggguugugugaucaauuggaaagggaaggagcuaaagugcggauccggcauuuucgugacuaacgagguccauacauggaccgaacaguacaaauuucaagcagauucucccaagcggcucgccacugcuaucgccggugcaugggagaauggcguuugugggauacgaagcaccacacgcauggaaaaccugcuuuggaaacagaucgcuaaugaguugaacuauauucugugggaaaauaacaucaagcucacgguggugguaggagacaccauuggcguccuggagcaggggaaaagaacuuuaacaccacagccuauggagcugaaguacucauggaaaaccuggggaaaggccaagaucgugacagcggaaacucaaaacaguuccuucauaauugauggccccaauaccccagagugccccagcgccucuagggcuuggaacguuugggaaguggaggacuaugguuuuggggucuucacgacaaauaucuggcuuaaauugcgggaaguguacacccagcucugugaccaccgccugaugucagcagccguuaaggaugagagagcugugcacgccgacaugggauacuggauugagagucagaaaaacggcagcuggaagcuagaaaaagcaucccugaucgagguaaagacuugcaccuggccuaagucucauacacucuggucgaaugguguccuggaaagcgauaugauaaucccaaaaucccuugcgggcccgauuucacagcacaacuauaggcccggguaccauacucaaaccgccggaccuuggcacuugggcaagcuggaguuagacuuuaauuauugcgaggggacaacgguggugaucaccgaaaacuguggaacucguggcccaagucuccggacaaccacugucucugguaaacugauucacgaguggugcugucgaagcugcacacuucccccucugagauacaugggggaagauggauguugguauggcauggagaucaggccaauauccgaaaaggaggagaauaugguuaaaucauuggugagcgcugguucuggcgaaguagacaacuucaccaugggggugcucugccuggccauucuauuugaggaagucaugcgcggaaaguucggcaagaaacauaugaucgcagggguguucuuuacguucguucugcuccuguccggacagaucacuuggcgggauauggcucacacccuuauuaugaucggcaguaaugccagcgacagaauggguaugggggugacauacuuggcacugauugccaccuuuaagauacagcccuucuuagcucucggauuuuuccugaggaaacuuacuucucgcgagaaccugcuacucggcgucggccuggcgauggccacaaccuugcaacugccggaagauaucgagcagauggcaaaugggauugcuuuaggacucauggcccugaagcuuaucacacaguuugagacuuaucagcuguggaccgccuugauuucccucacguguucaaacacaaucuucacccugacuguggcuuggcgaaccgcaacacuaauacuggccgguguuagucuucucccugugugccaaagcucguccaugcggaaaacugacuggcugccaaugaccgucgcggcuaugggcguacccccuuugccccuguuuaucuucucuuuaaaggauacgcucaagcguagaagcuggccacugaaugaaggggugauggccguuggacuugugucaauucuggcaaguuccuugcucaggaacgacgucccuauggccggcccccugguggcuggugggcuacugaucgcauguuacguaauuacaggaaccucugccgaucuuacuguggagaaagcggcugacgucacaugggaagaggaagccgagcagaccggcguuagccauaaccucaugaucacuguggacgaugacggcacaaugcgcauaaaggaugacgagaccgaaaauauucugacgguguuguuaaaaacugcacugcucaucgucuccgggaucuuuccauacucaauuccggccacccugcuuguguggcacacauggcagaagcagacccaacggagcggaguucugugggauguaccuagucccccagagacacagaaagcugaauuggaggaggguguguauagaauaaagcagcagggcaucuucgggaaaacucaagucggagugggcguucagaaggaagguguguuucauaccauguggcacgucacgaggggggccgugcuaacauacaacggaaagcgacuggagcccaauugggcaucuguaaaaaaggaccucauuuccuauggcggcggguggcgccugagcgcucaguggcaaaaaggagaagagguccaggugaucgccguugaaccugguaagaacccaaaaaauuuccagacuaugcccggcaccuuccagacaaccacuggggagauuggagcgaucgcccuugauuuuaagccuggcaccucggguucaccgauaaucaaccgggaggggaagguggucggauuauacggcaauggcgugguuacaaaaaacgggggauaugugucugguauugcacaaacgaaugcugaaccagacggccccacuccugagcuggaagaggaaauguucaagaaaagaaaccucaccaucauggauuugcacccagggaguggaaagacaaggaaauaccugcccgccauuguccgugaggcuaucaagcgccggcucagaacccugauacuugcaccuacuagggugguagccgccgagauggaagaggcucugaagggcuugccgauucgauaucagacaaccgcgacgaaauccgaacauacuggucgggagaucguggaccuaaugugccacgcaacauuuaccaugcgccugcucagccccguuagagucccaaauuacaacuuaaucauuauggaugaagcccauuucaccgacccugcuucuaucgccgcaaggggguacauaagcacucgggugggaaugggcgaggccgcugcgauuuuuaugacagccacccccccaggcacagcagaugcuuucccucaguccaaugcccccauccaggacgaggaacgagacauuccagagagaucauggaacagugggaaugaauggaucacugauuuugcaggaaagacggugugguucgucccgagcauaaaagccgguaacgacauugcuaacugucugcgcaagaauggcaaaaagguaauccaacuuucuaggaagaccuuugauacagaguaucagaaaacuaagcugaacgacugggauuucgugguuaccacagacaucuccgagaugggggccaauuuuaaagcggaucgugugauugacccucggagaugccucaagcccgucaucuugaccgauggaccagaaagggugauucuggcaggccccaugccuguuacugccgcuucagccgcucagcgccgagguagaguggggcggaacccacagaaagagaaugaccaauacauauucacgggccagccccucaacaaugaugaagaccacgcacauuggaccgaggccaagaugcugcuugacaacaucaauacaccugaaggaauuaucccggcucuauucgagccagagagggaaaagagugccgcaaucgauggcgaguaucgccugaaaggggaaagccguaagacuuuugucgaguugaugagacggggagacuuacccguguggcuggcgcacaaaguagccuccgaagguauuaaguacaccgauaggaaauggugcuucgacggccagcgcaacaaucagauacucgaggagaacauggauguggaaaucuggacaaaggagggggaaaaaaagaagcugcgaccuagauggcuugacgcucggaccuauucugauccccuggcccucaaagaguuuaaggacuucgcagcuggaaggaaaucgauugccuuggaucugguuacugaaaucggccgcgucccaacacaccuagcacauagaacgaggaaugcccuggacaaccucgugaugcuucacaccagcgagcauggugggaaggcuuaccggcacgcgguggaggaacugccugagacuauggaaacauuauugcugcucggccugaugauucuucugaccggaggcgccaugcucuuuuugaucucagggaaaggaauagguaagaccuccaucggccugauuugugucaucgcaaguucugggauguuauggauggcugagauuccccuacaauggaucgccagcgccauaguucuggaguucuuuaugauggugcuccuuauuccagaaccugagaagcagcguacaccgcaggauaaucaacuggcauauguagugaucggaauuuugacucuggcugccacgaucgcggcuaacgaaaugggccuccuggagaccacaaaacgcgaccuugguauguccaaggaacccggggucgugucaccaacuucuuaccucgauguugaccugcacccugccagcgcauggaccuuguacgccguggcuacaaccgucauaacucccaugcugcgacauacgaucgagaauaguacagcaaacguauccuuagccgcgauugcuaaccaggccgugguucuaaugggccuggacaaaggauggccaaucagcaagauggaucucggcgugccucuucuggcauuggggugcuauucucaggucaauccccugacccucacugccgcugugcugcuuuuaauuacccacuacgccaucauaggaccgggccugcaggcaaaagcuacaagagaggcccaaaagaggacugcggccgguauuaugaagaacccaaccgucgacgggaucaugacaaucgaucucgacccugugauuuaugauucaaaauucgaaaagcaguugggacagguuaugcugcuagugcugugugcaguacagcuccuucugaugcggacguccugggcuuugugcgaggcccugacccucgcaacuggccccaucacaacccugugggaagguaguccaggcaaauuuuggaauacuacaauagcugugagcauggccaacauuuuccgcgggucguacuuagccggagcgggccuugcuuuuucuaucaugaaguccgucgggaccggaaaaagaggcacggguagccaaggggagacccugggagaaaaguggaagaaaaagcucaaucagcuaucaaggaaagaguucgaccuguauaagaaaaguggcauuacagagguugaucggacugaagcaaaggaggguuugaaacgaggcgaaaucacccaucacgccgugucuagaggguccgcuaagcugcagugguuugucgagcgcaacauggugauacccgaaggaaggguaaucgaccucggcugugggcggggaggcuggagcuacuauugcgccggucuuaagaaagugacagagguucguggguacacuaagggaggcccuggccaugaggaaccggugcccaugucaaccuacggguggaauauugucaaacugaugaguggaaaggauguguucuauuugccaccugagaaaugugacacacugcucugcgauaucggugaaagcucccccucuccuaccgucgaggagagcagaacuauuaggguguuaaagaugguugaaccauggcugaagaacaaucaguucuguaucaaaguacuuaaccccuacaugccuacggugauugagcaccuggaacgccuacaacggaagcacggcgggaugcucguccgaaauccacuguccagaaacucaacacaugagauguauuggaucucuaauggaaccggcaacauaguggcaaguguuaauauggugucgagguugcugcucaaccgcuuuacuaugacccaccggagacccacaauugaaaaagacgucgaucuuggugccgggacgcgucaugugaacgcugagccggagaccccuaauauggacguaaucggagaaaggaucaagcggauuaaagaggaacacaacagcacuuggcacuacgacgaugagaauccauauaagacaugggcguaccauggcuccuaugaagugaaggccaccggcucugcaucaagcaugauaaacgggguugucaaacuguuaacuaagcccugggacguggugccuauggucacacagauggcuaugaccgauacaacuccauucggacagcaacgcguuuuuaaagagaagguggacacccgaacgcccagauccaugccggguaccaggcggguaaugggcaucacagccgaguggcuguggcgcacuuuggggagaaauaaaaagccuaggcucugcacccgagaagaguucacaaagaaagugcggacuaacgcagccaugggagcugucuuuaccgaagagaaucagugggauagugccaaggcggcaguggaagacgaggauuucuggaaacugguugaccgugagagagaacuacacaagcuuggcaaaugugguucuugcguguacaacaugauggggaagcgcgagaaaaagcugggagaauuuggcaaggccaaaggcagcagggcuauuugguacauguggcucggggcccgguaucuggaguucgaggcauugggauuucugaaugaagaucauugguucucaagagagaacuccuacaguggugucgaaggcgaggggcuccacaagcuuggauauauccugcgcgacauuagcaaaauccccggcggugcuauguacgccgaugacacggcugggugggacacaaggauaaccgaagaugacuuacauaaugaggagaagaucacucagcagauggauccagaacaccgacaacuggccaacgcaauuuuuaaauugacauaucagaauaaggugguaaagguucagcggccuacccccacuggaaccgugauggacaucauuucuagaaaagaucagaggggcuccggccaagucgggacauacggacucaacacguucaccaauauggaggcgcagcugauccgccagauggaaggugagggcgugcuaucaaaggccgaccuugaaaacccacaccugcccgagaaaaagauaacucaguggcucgagacaaaagggguggaacgucugaagcggauggcuauuagcggagaugacugcgucguuaagccuaucgaugacagauuugccaacgcauuguuagcucugaaugauaugggcaaagugaggaaggacaucccacaauggcagccgucgaaagguuggcaugauuggcagcagguacccuucuguucucaccauuuccacgagcucauuaugaaggacgggcgcaaacuuguggucccuugccgaccacaagacgaacugauaggacgggccagaaucagucagggcgcaggcuggucccuaagggagaccgccugucuggggaaggcguaugcucagauguggagccucauguacuuucaccgcagagauuugcggcuggccucaaacgcaauuugcuccgccgugcccguucauugggugccuacuucuaggacaaccuggagcauccacgcucaucaccaauggaugacgacagaagacaugcuuaccgucuggaaucguguguggauugaggauaacccauggauggaggacaagacucccguaaccacaugggaaaauguuccuuaccugggaaaacgagaggaucaguggugugguagucucaucggcuuaacuucccgcgccaccugggcacagaacauaccgacagcuauccagcaagugagaagccugauugggaaugaagaguucuuggacuauaugccaucuaugaagcgguuuaggaaagaggaagagucagaaggagccaucugguga

SEQ ID NO: 15519 - RNA, 9873 nt, Artificial Sequence
  derived and/or modified CDS sequence (opt3) from DENV-3__FJ639790__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguuccuaaccuuuguucugcuccuguccggacagauuacguggcgggauauggcucacacucuuaucaugauuggcaguaaugccagcgacagaauggguaugggggugaccuacuuggcacugauagccacauucaagauccagcccuuuuuagcucucggauucuuucugaggaaacuuaccucucgcgagaaccugcuacucggcgucggccuggcgauggccacuacauugcaacugccggaagauauugagcagauggcaaaugggaucgcuuuaggacucauggcccugaagcuuauuacccaguucgagacauaucagcuguggacugccuugaucucccucaccuguucaaacacgauauuuacacugaccguggcuuggcgaacugcaacccuaauccuggccgguguuagucuucucccugugugccaaagcucguccaugcggaaaacagacuggcugccaaugacugucgcggcuaugggcguacccccuuugccccuguucauuuuuaauuuaaaggauacccucaagcguagaucuuggccacugaacgaaggggugauggccguuggacuugugagcauccuggcaucaaguuugcucaggaacgacgucccuauggccggcccccugguggcuggugggcuacugauugcauguuacguaaucacgggaacauccgccgaucuuaccguggagaaagcggcugacgucacuugggaagaggaagccgagcagacaggcguuucucauaaucucaugauaaccguggacgaugacggcacuaugcgcauuaaggaugacgagacagaaaacauccugaccguguuguuaaaaacggcacugcucaucgucagcgggauuuucccauacuccauaccggccacucugcuuguguggcacaccuggcagaagcagacacaacggucaggaguucugugggauguaccuagccccccagagacccagaaagcugaauuggaggaggguguguauagaaucaagcagcagggcauuuuugggaaaacacaagucggagugggcguucagaaggaagguguguuccauacuauguggcacgucaccaggggggccgugcuaacguacaauggaaagcgacuggagcccaacugggcaaguguaaaaaaggaccucaucucuuauggcggcggguggcgccuguccgcucaguggcaaaaaggagaagagguccaggugauugccguugaaccugguaagaauccaaaaaacuuucagacaaugcccggcacuuuccagaccacaaccggggagaucggagcgauagcccuugauuucaagccuggcacuagcgguucgccgaucauuaaucgggaggggaagguggucggauuauacggcaacggcgugguuaccaaaaaugggggauaugugucagguaucgcacaaacaaacgcugaaccagacggccccacgccugagcuggaagaggaaauguuuaagaaaagaaaucucacuauuauggauuugcacccagggucuggaaagaccaggaaauaccugcccgccaucguccgugaggcuauaaagcgccggcucagaacacugauucuugcaccuaccagggugguagccgccgagauggaagaggcucugaagggcuugccgauccgauaucagacuacagcgaccaaaagugaacauacgggucgggagaucguggaccuaaugugccacgcaacuuucacaaugcgccugcucucccccguuagagucccaaacuacaauuuaauuaucauggaugaagcccauuuuaccgacccugcuagcauagccgcaaggggguacauuucuacccgggugggaaugggcgaggccgcugcgaucuucaugacugccacacccccaggcaccgcagaugcuuuuccucagagcaacgcccccauucaggacgaggaacgagacaucccagagagauccuggaauucagggaacgaauggauaacagauuucgcaggaaagacugugugguuugucccgaguauuaaagccgguaacgacaucgcuaauugucugcgcaagaacggcaaaaagguaauccaacuuagcaggaagacguucgauaccgaguaucagaaaacaaagcugaaugacugggauuuugugguuacuaccgacauuucugagaugggggccaacuucaaagcggaucgugugaucgacccucggagaugccucaagcccgucauuuugacagauggaccagaaagggugauacuggcaggccccaugccuguuaccgccgcuuccgccgcucagcgccgagguagaguggggcggaauccacagaaagagaacgaccaauacaucuuuacuggccagccccucaauaacgaugaagaccacgcacauuggacggaggccaagaugcugcuugacaauauuaacaccccugaaggaaucaucccggcucuauucgagccagagagggaaaagucagccgcaauugauggcgaguaucgccugaaaggggaaagucguaagacauucgucgaguugaugagacggggagacuuacccguguggcuggcgcacaaaguagccagcgaagguauaaaguacacugauaggaaauggugcuuugacggccagcgcaauaaccagauccucgaggagaauauggauguggaaauuuggaccaaggagggggaaaaaaagaagcugcgaccuagauggcuugacgcucggacauauuccgauccccuggcccucaaagaguucaaggacuuugcagcuggaaggaaaucuaucgccuuggaucugguuaccgaaauuggccgcgucccaacucaccuagcacauagaacaaggaacgcccuggacaaucucgugaugcuucacacgucggagcauggugggaaggcuuaccggcacgcgguggaggaacugccugagaccauggaaacuuuauugcugcucggccugaugauccuucugacaggaggcgccaugcucuucuugauaagcgggaaaggaaucgguaagaccucaauuggccugaucugugucauugcauccagugggauguuauggauggcugagaucccccuacaauggauagccucugccauuguucuggaguuuuucaugauggugcuccuuaucccagaaccugagaagcagcguaccccgcaggauaaccaacuggcauauguagugauuggaaucuugacacuggcugccauaaucgcggcuaaugaaaugggccuccuggagacuacgaaacgcgaccuugguaugagcaaggaacccggggucguguccccaaccucauaccucgauguugaccugcacccugccucugcauggacauuguacgccguggcuacuaccgucauuacacccaugcugcgacauaccaucgagaacagcacugcaaacguaaguuuagccgcgauugcuaaucaggccgugguucuaaugggccuggacaaaggauggccaaucuccaagauggaucucggcgugccucuucuggcauuggggugcuauagccaggucaacccccugacgcucacagccgcugugcugcuuuuaauaacccacuacgccauuaucggaccgggccugcaggcaaaagcuacuagagaggcccaaaagaggaccgcggccgguaucaugaagaauccaacagucgacgggauuaugacuaucgaucucgacccugugauauaugauucuaaauuugaaaagcaguugggacagguuaugcugcuagugcugugugcaguacagcuccuucugaugcggaccucaugggcuuugugcgaggcccugacacucgcaacgggccccauuaccacucugugggaagguuccccaggcaaauucuggaacacaaccaucgcugugaguauggccaauauuuuucgcgggagcuacuuagccggagcgggccuugcuuucucgaucaugaagucugucgggacuggaaaaagaggcacagguucccaaggggagacccugggagaaaaguggaagaaaaagcucaaccagcuaagcaggaaagaguuugaccuguauaagaaaucaggcauaacggagguugaucggaccgaagcaaaggaggguuugaaacgaggcgaaaucacacaucacgccgugaguagagggucugcuaagcugcagugguucgucgagcgcaauauggugauucccgaaggaaggguaaucgaccucggcugugggcggggaggcugguccuacuauugcgccggucuuaagaaagugacugagguucguggguacaccaagggaggcccuggccaugaggaaccggugcccaugagcacauacggguggaacauugucaaacugaugucaggaaaggauguguuuuauuugccaccugagaaaugugacacucugcucugcgauaucggugaaaguagccccuccccuaccgucgaggagucuagaacaauuaggguguuaaagaugguugaaccauggcugaagaauaaccaguucuguaucaaaguacuuaaucccuacaugccuaccgugauagagcaccuggaacgccuacaacggaagcacggcgggaugcucguccgaaacccacugagcagaaauuccacucaugagauguauuggauuucaaacggaacgggcaauaucguggcaucuguuaacauggugaguagguugcugcucaaccgcuucacaaugacccaccggagacccacuaucgaaaaagacgucgaucuuggugccgggacccgucaugugaaugcugagccggagacaccuaacauggacguaauuggagaaaggauaaagcggaucaaagaggaacacaauucgacguggcacuacgacgaugagaacccauauaagaccugggcguaccauggcagcuaugaagugaaggccacuggcuccgcaucuucaaugauuaaugggguugucaaacuguuaacaaagcccugggacguggugccuauggucacccagauggcuaugacugauacaaccccauuuggacagcaacgcguuuucaaagagaagguggacacacgaacucccagaagcaugccggguaccaggcggguaaugggcaucacggccgaguggcuguggcgcaccuuggggagaaacaaaaagccuaggcucugcacacgagaagaguuuacuaagaaagugcggaccaaugcagccaugggagcugucuucacagaagagaaccagugggauuccgccaaggcggcaguggaagacgaggauuuuuggaaacugguugaccgugagagagaacuacacaagcuuggcaaaugugguaguugcguguacaauaugauggggaagcgcgagaaaaagcugggagaauucggcaaggccaaaggcucuagggcuauuugguacauguggcucggggcccgguaucuggaguuugaggcauugggauuccugaacgaagaucauugguuuagcagagagaauucauacuccggugucgaaggcgaggggcuccacaagcuuggauauauccugcgcgacauaaguaaaauccccggcggugcuauguacgccgaugacacugcugggugggacaccaggauuacggaagaugacuuacauaacgaggagaagaucacacagcagauggauccagaacaccgacaacuggccaaugcaauuuucaaauugaccuaucagaacaaggugguaaagguucagcggccuacucccgcgggaacagugauggacaucauaagcagaaaagaucagaggggcucuggccaagucgggaccuacggacucaauacuuuuaccaacauggaggcccagcugauucgccagauggaaggugagggcgugcuauccaaggcugaccuugaaaacccacaccugcccgagaaaaagaucacacaguggcucgagacgaaagggguggaacgucugaagcggauggccaucucaggagaugacugcgucguuaagccuauugaugacagauucgcaaaugcuuuguuagcccugaacgauaugggcaaagugaggaaggacauaccacaauggcagccgagcaaagguuggcaugauuggcagcagguacccuuuuguucgcaccauuuccacgagcucaucaugaaggacgggcgcaaacuuguggucccuugccgaccacaagacgaacugauuggacgggcaagaaucucucagggcgccggcuggagucuaagggagaccgcgugucuggggaaggcuuaugcccagauguggucccucauguacuuccaccgcagagauuugcggcuggcaagcaaugccauuugcucagcugugcccguucauugggugccuacuuccaggacaaccuggucuauccacgcccaucaccaauggaugacuacagaagacaugcuuaccgucuggaaccguguguggauagaggauaauccauggauggaggacaagacgcccguaacaaccugggaaaacguuccuuaccugggaaaacgagaggaucaguggugugguagccucaucggcuuaacuagucgcgcaaccugggcucagaauauuccgacagccauccagcaagugagaucccugauugggaacgaagaguuuuuggacuauaugccaagcaugaagcgguucaggaaagaggaagagucugaaggagcgaucugguga

SEQ ID NO: 15520 - RNA, 9873 nt, Artificial Sequence
  derived and/or modified CDS sequence (opt3) from DENV-3__FJ639791__SS-prME
accagccugugccucaugaugauccuucccgccgcucuggcauuccacuugacauccagagacggcgaaccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccguggagggaaaagucgugcaguaugaaaaucugaaguacacaguuauaauuacugugcauaccggugaccagcaccaggucggcaacgagacacaaggggugaccgcagaaaucacuccucaggcuuccacgacagaggccauucucccagaauauggaacccuuggccuggagugcucuccgcgaacugguuuggacuucaaugagaugauccuacugaccaugaaaaacaaggcguggaugguacauagacagugguuuuucgaucucccccugccuuggacaagcggggccaccacugaaacaccaacguggaauaggaaagagcuucugguuaccuuuaagaacgcacacgcuaaaaagcaagaaguggucguguugggcucccaggagggagccaugcacacugcucucacaggcgccaccgaaauccaaaauucagggggaacaaguauuuucgcaggucaucugaagugucgguuaaaaauggacaagcuggagcuaaaaggcaugagcuacgccaugugcacuaacaccuuuguccucaagaaagaggugucugaaacgcagcacgggaccauacugaucaagguugaguacaagggagaagaugugcccuguaaaauuccuuucuccacagaggacggccaagguaaggcucauaacgggcgucuuaucacugcgaauccaguagucaccaaaaaggaggaacccgugaacauagaggcagaaccgccuuucggcgagucaaauauuguuaucggaaucggcgauaacgccuugaaaauuaauugguauaagaaggggagcaguaucggaaaaauguuugaagcuacagcccgcggugcaagaaggauggccauucugggcgacacugcuugggauuucgggucugugggaggcguccucaacucccuggguaagauggugcaccagauauuugggagcgccuacaccgcacuuuucucgggcguaucuugggugaugaaaaucggaauuggcguucuguugacguggaucgggcucaauuccaagaacacaucaaugaguuuuagcugcaucgcgauuggaauaaucacccuguauuuaggcgcugucgugcaggccgacauggguugugugauuaauuggaaagggaaggagcugaagugcggauccggcaucuucgucacuaacgagguucauacauggaccgaacaguacaaauuucaagcagauucucccaagcggcuagccacugcuauugccggugcaugggagaauggcgugugugggauccgaagcaccacacgcauggaaaaccuccuguggaaacagauagcuaaugagcuuaacuauaucuugugggaaaauaacauuaagcugacggugguagucggagacaucauuggcgugcucgagcaggggaaaagaacccugacuccacagccuauggaguuaaaguacucauggaaaacauggggaaaggccaagaucguuaccgcggaaacacaaaacaguuccuucauaauugauggccccaauacuccagagugccccagcgccucuagggcuuggaacgugugggaagucgaggacuaugguuuugggguguucaccacgaauaucuggcugaaacuucgggaaguuuacacacaguugugugaccaccgccucaugucagcagccgugaaggaugagagagcuguacacgccgacaugggauacuggauugagagucagaaaaacggcagcuggaagcuggaaaaagcaucccuaaucgaggucaagaccugcacuuggccuaagucucauacccuguggucgaauggugugcucgaaagcgauaugauaaucccaaaaucccuggcgggcccgauuucacagcacaacuauaggcccggguaccauacacaaacugccggaccuuggcaccuuggcaaguuggagcuggacuuuaauuauugcgaggggaccacaguggucaucacggaaaacuguggaacccguggcccaaguuuacggacuacaaccguuucugguaaacucauucacgaguggugcugucgaagcugcacucugcccccucuuagauacaugggggaagauggauguugguauggcauggagaucaggccaauauccgaaaaggaggagaauauggugaaaucacugguaagcgcugguucuggcgaaguggacaacuucacaaugggggucuugugccucgccauucuguuugaggaagugaugcgcggaaaguucggcaagaaacauaugaucgcagggguuuucuuuaccuucgugcuacugcucuccggacagaucacguggcgggauauggcucacacucugauuaugaucggcaguaaugccagcgacagaauggguaugggggucaccuaccuugcauugauugccacauuuaagauacagcccuuccuggcuuuaggauuuuuccucaggaaacugaccucucgcgagaaccuucugcuaggcgugggccucgcgauggccacuacacugcaauugccggaagauaucgagcagauggcaaaugggauugcucugggauuaauggcccucaagcugaucacccaguuugagauuuaucagcuuuggacagcccugaucuccuugacuuguucaaacaccauauucacgcucacaguugcuuggcgaaccgcaacucugauccuagccggugugagucugcuuccugucugccaaagcucguccaugcggaaaaccgacuggcucccaaugacaguagcggcuaugggcgugcccccucugcccuuguuuauuuucaaucugaaggauacuuuaaagcguagaucuuggccacucaacgaagggguuauggccgugggacuggucagcauccuugcaucaagucuguugaggaacgacgugccuauggccggcccccucguagcuggugggcugcuaauugcauguuacgugaucaccggaacguccgccgaucugacagucgagaaagcggcugacguuaccugggaagaggaagccgagcagacuggcgugucucauaaucuuaugauaacaguggacgaugacggcaccaugcgcauuaaggaugacgagacugaaaacauccucacaguccuguugaaaaccgcauuacugaucgugagcgggauuuuuccauacuccauaccggccacgcuccugguuuggcacacuuggcagaagcagacccaacggucaggaguacuuugggaugugccuagcccaccagagacacagaaagcugaacuggaggagggugucuauagaaucaagcagcagggcauuuucgggaaaacccaagugggaguuggcgugcagaaggaaggugucuuucauacaauguggcacgugacuagaggggccguauugaccuacaauggaaagcgacuagagcccaacugggcaagugucaaaaaggaccugaucucuuauggcggcggguggcgccucuccgcucaguggcaaaaaggagaagaggugcagguuauugccguggaaccugguaagaaucccaagaauuuccagacgaugcccggcacauuccagacuaccacaggggagaucggagcgauagcccuggauuuuaagccuggcaccagcgguucgccgaucauuaaucgggaggggaaggucgugggacuuuacggcaacggcguugugacuaaaaaugggggauaugucucagguaucgcacaaaccaacgcugaaccagacggccccacaccugaguuagaagaggaaauguucaagaaaagaaaucugacgauuauggaucuccacccagggucuggaaagacuaggaaauacuugcccgccaucgugcgugaggcuauaaagcgccggcugagaacccucauucuggcaccuacaaggguaguggccgccgagauggaagaggcucuuaagggccugccgauccgauaucagaccacugcgacaaaaagugaacauaccggucgggagaucguugacuugaugugccacgcaacguuuacuaugcgccuacugucccccgucagagugccaaacuacaaucucauuaucauggaugaagcccauuucacagacccugcuagcauagccgcaaggggguacauuucuacccgggugggaaugggcgaggccgcugcgaucuuuaugaccgccacucccccaggcacagcagaugcuuucccucagagcaacgcccccauucaggacgaggaacgagacaucccagagagauccuggaacucagggaacgaauggauaaccgauuuugcaggaaagacagucugguucguaccgaguauuaaagccgguaacgacaucgcuaauuguuuacgcaagaacggcaaaaaggugauccaacugagcaggaagacuuuugauacggaguaucagaaaaccaaacuuaaugacugggauuucguugugacaacugacauuucugagaugggggccaacuuuaaagcggaucgugucaucgacccucggagaugccugaagcccgugauucucaccgauggaccagaaaggguuauauuggcaggccccaugccugugacagccgcuuccgccgcucagcgccgagguagagucgggcggaauccacagaaagagaacgaccaauacaucuucaccggccagccccugaauaacgaugaagaccacgcacauuggacugaggccaagaugcuccuggacaauauuaacacgccugaaggaaucaucccggcucuuuucgagccagagagggaaaagucagccgcaauugauggcgaguaucgccuaaaaggggaaagucguaagaccuuuguggagcugaugagacggggagacuugcccguaugguuagcgcacaaaguggccagcgaagguauaaaguacacagauaggaaauggugcuucgacggccagcgcaauaaccagauccuggaggagaauauggauguugaaauuuggacuaaggagggggagaagaagaagcuccgaccuagauggcuggacgcucggaccuauuccgauccccuugcccugaaagaguuuaaggacuucgcagcuggaaggaaaucuaucgcccucgauuuggucacagaaauuggccgcgugccaacccaccuggcacauagaacuaggaacgcccuagacaaucuggugaugcuccacacaucggagcauggugggaaggcuuaccggcacgcggucgaggaacuuccugagacgauggaaacccuguuauugcugggccucaugauccugcuuacuggaggcgccaugcuguuucucauaagcgggaaaggaaucgguaagacaucaauuggcuugaucuguguuauugcauccagugggaugcuguggauggcugagauccccuuacaauggauagccucugccauugugcuagaguucuuuaugaugguacugcucaucccagaaccugagaagcagcguaccccgcaggauaaccaacuugcauauguggucauuggaauccugaccuuggcugccauaaucgcggcuaaugaaaugggccugcucgagacaacuaaacgcgaccuggguaugagcaaggaacccggggugguuuccccaacgucauaccuugauguggaccuccacccugccucugcauggacccuguacgccgucgcuacaacuguaauuacccccauguugcgacauacaaucgagaacagcaccgcaaacgugagucuggccgcgauugcuaaucaggccguuguguuaaugggccuagacaaaggauggccaaucuccaagauggaucugggcgucccucuccuugcacuggggugcuauagccaggugaaccccuugacucugacggccgcuguccuccugcuuauaacacacuacgccauuaucggaccgggcuuacaggcaaaagcuaccagagaggcccaaaagaggacugcggccgguaucaugaagaauccaaccguggacgggauuaugacaaucgaucuggacccuguuauauaugauucuaaauucgaaaagcagcucggacaggugauguugcugguacuaugugcagugcagcugcuccuuaugcggacuucaugggcucugugcgaggccuugacccuggcaacaggccccauuacgacccucugggaagguuccccaggcaaauuuuggaacacuacaaucgcugucaguauggccaauauuuuccgcgggagcuaccuggccggagcgggcuuagcuuuuucgaucaugaagucuguugggaccggaaaaagaggcacugguucccaaggggagacacuuggagaaaaguggaagaaaaagcugaaccagcucagcaggaaagaguucgaccuauauaagaaaucaggcauaaccgagguggaucggacggaagcaaaggagggucugaaacgaggcgaaaucacccaucacgccgucaguagagggucugcuaaguugcagugguuuguggagcgcaauaugguaauucccgaaggaagggugaucgaccugggcugugggcggggaggcugguccuacuauugcgccggucucaagaaaguuacagaggugcguggguacacuaagggaggcccuggccaugaggaaccgguccccaugagcaccuacggguggaacauugugaaacuuaucucaggaaaggaugucuucuaucugccaccugagaaaugugacacauugcugugcgauauuggugaaaguagccccuccccuacuguggaggagucuagaaccaucaggguucucaagaugguagaaccaugguuaaagaauaaccaguucuguauaaaagugcugaaucccuacaugccuacagucauugagcaccuugaacgccugcaacggaagcacggcgggaugcuagugcgaaacccacucagcagaaauuccacccaugagauguauuggaucucaaacggaucuggcaauaucguugcaagugugaacauggucucgaggcuguugcugaaccgcuuuacuaugacgcaccggagacccacaauugaaaaagacguggaucucggugccgggacccgucauguaaaugcugagccggagacuccuaacauggacgugauaggagaaaggaucaagcggauuaaagaggaacacaauagcaccuggcacuacgacgaugagaacccauauaagacaugggcguaccauggcuccuaugaaguuaaggccacgggcucugcaucaagcaugaucaauggggucgugaaacuucugaccaagcccugggacguggucccuaugguuacucagauggcuaugacagauaccacuccauucggacagcaacgcguguuuaaagagaagguagacacacgaacccccagauccaugccggguacaaggcgggugaugggcauuacugccgagugguuauggcgcacccuggggagaaacaaaaagccuagguugugcacgcgagaagaguucaccaagaaaguccggacaaaugcagccaugggagcuguguuuacugaagagaaccagugggauagugccaaggcggcaguugaagacgaggauuucuggaaacucguggaccgugagagagaacugcacaagcuaggcaaaugugguucuugcgucuacaauaugauggggaagcgcgagaagaaacuuggagaauuuggcaaagccaaaggcagcagggcuaucugguacauguggcugggggcccgguaucucgaguucgaggcacugggauuuuugaacgaagaucauugguucucaagagaaaauuccuacagugguguggagggcgaggggcugcacaagcucggauauauacuucgcgacaucagcaaaauucccggcggugcuauguacgccgaugacaccgcugggugggacacaaggaucacugaagaugaccugcauaacgaggagaagauuacccagcagauggauccagaacaccgacaauuagccaaugcaaucuuuaaacugacguaucagaacaagguaguuaaggugcagcggccuacacccaccggaacugucauggacauaauuucuagaaaagaucagaggggcuccggccaaguggggacauacggauugaauaccuucacuaacauggaggcgcagcucauccgccagauggaaggugagggcgugcugucaaaggccgaccuagaaaacccacaccuucccgagaaaaagaucacccaguggcuggagacaaaaggggucgaacgucucaagcggauggcuauuagcggagaugacugcguugugaagccuauagaugacagauuugccaaugcacuguuggcuuuaaacgauaugggcaaaguaaggaaggacaucccacaauggcagccgucgaaagguuggcaugauuggcaacaggugcccuucuguucucaccauuuccacgagcugauuaugaaggacgggcgcaaacucgucgugccuugccgaccacaagacgaacuuaucggacgggccagaauuagucagggcgcaggcuggucccugagggagacggccugucuagggaaggcguaugcucagauguggagccugauguacuuucaccgcagagaucuccgguuggccucaaaugcaaucugcuccgccguucccgugcauugggucccuaccucuaggacuacauggagcauacacgcucaucaccaauggaugaccacugaagacaugcugacaguguggaaccguguauggaucgaggauaauccauggauggaggacaagacccccguuacgacaugggaaaacgugccuuaccuuggaaaacgagaggaucaguggugugguagucugauuggccucaccucccgcgccacuugggcacagaauaucccgaccgcuauucagcaagucaggagcuuaaucgggaacgaagaguuccuggacuauaugccaucuaugaagcgguuuaggaaagaggaagagucagaaggagccauuugguga

SEQ ID NO: 15521 - RNA, 9873 nt, Artificial Sequence
  derived and/or modified CDS sequence (opt3) from DENV-3__FJ639792__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucucucugaaggauaccuuaaagcguagaagcuggccacucaaugaaggggugauggccguuggacuggugucaauccuugcaaguucccuguugaggaacgacgucccuauggccggcccccucguggcuggugggcugcuaauugcauguuacguaaucacgggaacaucugccgaucugaccguggagaaagcggcugacgucacuugggaagaggaagccgagcagacaggcguuagccauaaccuuaugauaaccguggacgaugacggcacuaugcgcauuaaggaugacgagacagaaaauauccucaccgugcuguugaaaacggcauuacugaucgucuccgggauuuuuccauacucaauaccggccacucuccugguguggcacaccuggcagaagcagacacaacggagcggaguucuuugggauguaccuagucccccagagacccagaaagcugaacuggaggaggguguguauagaaucaagcagcagggcauuuucgggaaaacacaagucggagugggcguucagaaggaagguguguuucauacuauguggcacgucaccaggggggccguguugacgcacaacggaaagcgacuagagcccaauugggcaucuguaaaacgcgaccugaucuccuacggcggcggguggcggcucagcgcucaguggcaaaagggagaagagguccaggugauugccguugaaccugguaaaaacccaaagaauuuccagacaaugcccggcacuuuccagaccacaaccggggagaucggagcgauagcccuggauuuuaaaccuggcacuucggguucaccgaucauuaacagagaggggaagguggucggacuuuauggcaauggcgugguuaccaagaacgggggauacgugucugguaucgcacaaacaaaugcugaaccagacggccccacgccugaguuagaagaggaaauguucaaaaagaggaaccugacuauuauggaucuccauccagggaguggaaaaacccguaaguauuugcccgccaucguccgcgaggcuauaaaacggagacugaggacacucauucuggcaccuacccgagugguagccgccgagauggaagaggcucuuaagggccugccgauccgguaccagacuacagcgaccaaguccgaacacacgggucgcgagaucguggacuugaugugccaugcaacuuuuacaaugagacuacugagccccguuagggucccaaauuauaaccucauuaucauggaugaagcccacuucaccgacccugcuucuauagccgcacggggguacauuagcacccgagugggaaugggcgaggccgcugcgaucuuuaugacugccacacccccaggcaccgcagaugcuuucccucaguccaaugcccccauucaggacgaggaaagagacaucccagagcgcucauggaacagugggaaugaauggauaacagauuuugcaggaaaaacugugugguucgucccgagcauuaaggccgguaacgacaucgcuaacuguuuaaggaaaaauggcaagaaaguaauccaacugucucguaagacguuugauaccgaguaccagaagacaaaacuuaacgacugggauuucgugguuacuaccgacauuuccgagaugggggccaauuuuaaggcggaucgggugaucgacccuagaaggugccugaaacccgucauucucacagauggaccagaacgcgugauauuggcaggccccaugccuguuaccgccgcuucagccgcucagcgaagaggucggguggggaggaacccacagaaggagaaugaccaauauaucuucacuggccagccccugaacaaugaugaagaccaugcacacuggacggaggccaaaaugcuccuggacaacauuaauaccccugaaggaaucaucccggcucuuuucgagccagagcgcgaaaagagugccgcaauugauggcgaguaccgucuaaagggggaaagcagaaaaacauuugucgagcugaugcggaggggagacuugcccgugugguuagcguauaagguagccuccgaagguauaaaauacacugaucgcaaguggugcuucgacggccagcgaaacaaucagauccuggaggagaacauggauguggaaauuuggaccaaagagggggaaaagaaaaagcucagaccucgguggcuggacgcuaggacauauucugauccccuugcccugaaggaguuuaaagacuucgcagcuggacgcaagucgaucgcccucgauuugguuaccgaaauuggcagagucccaacucaccuggcacauaggacacggaaugcccuagacaaccuggugaugcuccacacgagcgagcauggugggaaagcuuaccgucacgcgguggaggaacuuccugagaccauggaaacucuguuauugcugggccucaugauccugcuuacaggaggcgccaugcuguuucucauaucagggaagggaaucgguaaaaccuccauuggcuugaucugugucauugcaaguucugggaugcuguggauggcugagauccccuuacaauggauagccagcgccauuguucuagaguucuuuaugauggugcugcucaucccagaaccugagaagcagcgcaccccgcaggauaaucaacuugcauauguagugauuggaauccugacauuggcugccauaaucgcggcuaacgaaaugggccugcucgagacuacgaagcgagaccuggguauguccaaagaacccggggucgugucaccaaccucuuaccuugauguugaccuccacccugccagcgcauggacacuguacgccguggcuacuaccgucauuacacccauguugagacauaccaucgagaauaguacugcaaacguaucccuggccgcgauugcuaaccaggccgugguuuuaaugggccuagacaagggauggccaaucagcaaaauggaucugggcgugccucuccuugcacuggggugcuauucucaggucaaucccuugacgcugacagccgcugugcuccugcuuauaacccacuacgccauuaucggaccgggcuuacaggcaaaggcuacuagggaggcccaaaaacggaccgcggccgguaucaugaagaacccaacagucgacgggauuaugacuaucgaucuggacccugugauauaugauucaaaguucgaaaaacagcucggacagguuauguugcuggugcuaugugcaguacagcugcuccuuaugcgcaccuccugggcucugugcgaggccuugacacuggcaacgggccccauuaccacucucugggaagguaguccaggcaaguuuuggaauacaaccaucgcugugagcauggccaacauuuucagagggucguaccuggccggagcgggcuuagcuuuuucuaucaugaaauccgucgggacuggaaagaggggcacagguagccaaggggagacccuuggagaaaaauggaagaagaaacugaaucagcucucacggaaggaguucgaccuauauaaaaagaguggcauaacggagguugaucgaaccgaagcaaaagagggucugaagagaggcgaaaucacacaucacgccgugucucgcggguccgcuaaauugcagugguuugucgagaggaacauggugauucccgaaggacggguaaucgaccugggcugugggcguggaggcuggagcuacuauugcgccggucucaagaaggugacugagguuagaggguacaccaaaggaggcccuggccaugaggaaccggugcccaugucaacauacggguggaauauugucaagcuuaugaguggaaaagauguguucuaucugccaccugagaagugugacacuuugcugugcgauaucggugaaagcucccccucuccuaccgucgaggagagcaggacaauucgcgugcucaaaaugguugaaccaugguuaaagaacaaucaguucuguaucaagguacugaaccccuacaugccuaccgugauagagcaccuugaacggcugcaacgaaaacacggcgggaugcuagucagaaauccacucuccaggaacucaacucaugagauguauuggauuucuaauggaacgggcaacaucguggcaaguguuaauauggugucgcgccuguugcugaaccgguuuacaaugacccacagacgucccacuaucgaaaaggacgucgaucucggugccgggaccaggcaugugaacgcugagccggagacaccuaauauggacguaauuggagaacggauaaaacgcaucaaggaggaacacaacagcacguggcacuacgacgaugagaauccauauaaaaccugggcguaccauggcuccuaugaagugaaggccacuggcucugcaucaagcaugauuaacgggguugucaagcuucugacaaaacccugggacguggugccuauggucacccagauggcuaugacugauacaaccccauucggacagcaacgaguuuuuaaggagaaaguggacacaagaacucccagguccaugccggguacccggcgcguaaugggcaucacggccgagugguuauggagaacccuggggaggaauaagaaaccucgauugugcacacgggaagaguucacuaagaaggugcguaccaacgcagccaugggagcugucuuuacagaagagaaucagugggauagugccaaagcggcaguggaagacgaggauuucuggaagcucguugacagagagcgcgaacugcacaaacuaggcaagugugguucuugcguguacaacaugauggggaaaagggagaagaaacuuggagaauuuggcaaggccaagggcagccgggcuauuugguacauguggcugggggccagauaucucgaguucgaggcacugggauuuuugaaugaagaucauugguucucacgcgagaacuccuacaguggugucgaaggcgaggggcugcacaaacucggauauauccuuagggacauaagcaagauccccggcggugcuauguacgccgaugacacugcugggugggacacccgaauuacggaagaugaccugcauaaugaggagaaaaucacacagcagauggauccagaacaccggcaauuagccaacgcaauuuuuaagcugaccuaucagaauaaagugguaaagguucagagaccuacucccacaggaaccgugauggacaucauaucuaggaaggaucagcgcggcuccggccaagucgggacuuacggauugaacaccuucacaaauauggaggcgcagcucauucgucagauggaaggugagggcgugcugucaaaagccgaccuagaaaacccacaccuucccgagaagaaaaucacgcaguggcuggagaccaaggggguggaacggcucaaaagaauggcuaucagcggagaugacugcgucguuaagccuauugaugacagguuugccaacgcacuguuggcuuuaaaugauaugggcaaggugcgcaaagacauaccacaauggcagccgucgaaggguuggcaugauuggcagcagguacccuucuguucucaccauuuccacgagcugaucaugaaagacgggcgaaagcucguggucccuugccggccacaagacgaacuuauuggaagagccaggaucagucagggcgcaggcuggucccugcgcgagacugccugucuagggaaagcguaugcucagauguggagccugauguacuuucacagacgggaucucagguuggccucaaacgcaauuugcuccgccgugcccguucauugggugccuacaucucguaccacuuggagcauccacgcucaucaccaauggaugacaaccgaagacaugcugacggucuggaaucgaguguggauagaggauaacccauggauggaggacaagacacccguaaccacuugggaaaauguuccuuaccuuggaaagcgcgaggaucaguggugugguagucugaucggccucaccuccagagccacaugggcacagaacauuccgacugcuauccagcaagugcggagcuuaauugggaaugaagaguuccuggacuauaugccaucuaugaaaagguuucgcaaggaggaagagucagaaggagccaucugguga

SEQ ID NO: 15522 - RNA, 9873 nt, Artificial Sequence
  derived and/or modified CDS sequence (opt3) from DENV-3__FJ639793__SS-prME
accagccugugccucaugaugauccuucccgcaacacuggcuuuccacuugacuuccagagacggcgagccuaggaugauuguggggaagaacgaacggggaaaaucuuuacuguuuaagacggcaucagguauaaauauguguacccuaaucgccauggaucucggcgaaaugugcgacgauacaguaacuuacaaauguccacauauuaccgaaguugagccggaagacaucgauugcugguguaaccugacaaguaccugggugacuuaugggacaugcaaucaggcgggagagcaccgccgagacaagcguagcguagcucuugcaccacaugugggcaugggucuggauaccagaacgcagacuuggauguccgcagagggggccuggaggcaggucgaaaaaguggagaccugggcuuugcggcacccuggauucacaauucucgcacuguuucuggcccauuacaucggcacuucucucacccagaagguugugauauucaucuuacugaugcuugucacaccaucgaugaccaugcgcugugugggcguagggaacagagacuuuguugaaggauugucaggugcuacguggguggaugucgugcuggagcacggcgggugcgugacuacaauggccaagaauaaacccacccuagacauugagcuccagaagacugaagcgacacaacuggcaacccuuaggaaacuguguaucgagggaaagauuacgaacaucaccacagauagccggugcccuacucagggcgaagccgucuugccagaggaacaggaccagaauuauguuuguaaacacaccuacguggaucgcgguugggggaacggaugcggccucuucggcaaggggagucugguaacaugcgcuaaguuucaauguuuagagcccauagagggaaaagugguccaguaugaaaaucugaaguacacugugauuaucaccguucauacaggugaccagcaccaggugggcaacgagacccaaggggucacugccgaaauuacgccucaggcauccacaaccgaggcuauccucccagaauauggaacucuuggccuggagugcucuccgcgaaccgguuuggacuucaaugagaugauccuacugacaaugaaaaacaaggccuggauggugcauagacagugguuuuucgaucucccccugccuuggaccagcggggcgacuacagaaacgccaaccuggaauaggaaagagcuucugguaacuuuuaagaacgcccacgccaagaagcaagaaguuguggucuugggcucccaggagggagcuaugcacacagcccucaccggcgcuacagaaauucaaaauucagggggaacaaguauauucgccggucaucugaagugucgguuaaaaauggacaagcuggagcuaaaaggcaugagcuacgcaaugugcaccaacacguuugugcucaagaaagaggucucugaaacccagcacgggacaauccugauuaagguggaguacaagggagaagauguucccuguaaaaucccuuucuccacugaggacggccaagguaaggcccauaacgggcgucuuauaaccgcuaauccagugguaacuaagaaggaggaacccgucaacauugaggcggaaccgccuuucggcgagucaaauaucgugaucggaauuggcgauaacgcauugaaaaucaauugguauaagaaggggagcaguauuggaaaaauguuugaagccacugcucgcggugccagaaggauggcaauacugggcgacaccgccugggauuucgggucuguuggaggcgugcucaacucccuggguaagaugguccaccagaucuuugggagcgcuuacacggcccuuuucucgggcgugucuuggguaaugaaaauuggaaucggcgugcuguugacauggaucgggcucaauuccaagaacaccucaaugaguuuuagcugcauugcaauaggaaucauuacucuguauuuaggcgcgguuguccaggcugacauggguugugugaucaauuggaaagggaaggagcugaagugcggauccggcauuuucgugacaaacgagguccauaccuggacugaacaguacaaauuucaagccgauucucccaagcggcuagcaaccgccaucgcuggugccugggagaauggcguuugugggauacgaagcacaacgcgcauggaaaaccuccuguggaaacagaucgcaaaugagcuuaacuauauuuugugggaaaauaacaucaagcugaccguggugguaggagacauuaucggcguccucgagcaggggaaaagaacucugacaccacagccuauggaguuaaaguacucauggaaaaccuggggaaaggcuaagauagugacagccgaaacucaaaacaguuccuucauuaucgauggccccaauaccccagagugccccagcgcgucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaacuauaggcccggguaccauacucaaaccgcgggaccuuggcaccuuggcaaguuggagcuggacuuuaauuauugcgaggggacaacgguggugauuaccgaaaacuguggaacucguggcccaaguuuacggacaaccacugucucugguaaacucauccacgaguggugcugucgaagcugcacacugcccccucuuagauacaugggggaagauggauguugguauggcauggagauaaggccaaccuccgaaaaggaggagaauaugguuaaaucacuggugagcgccgguucuggcgaaguagacaacuucacgauggggguguugugccucgcuauucuguuugaggaagucaugcgcggaaaguucggcaagaaacauaugaucgccgggguguucuuuacuuucguucuacugcucuccggacagaucaccuggcgggauauggcacacacacugauuaugaucggcaguaaugcuagcgacagaauggguaugggggugaccuaccuugccuugauugcaacuuuuaagauacagcccuuccuggccuuaggauuuuuccucaggaaacugacaucucgcgagaaccuucugcuaggcgucggccucgcuauggcgaccacacugcaauugccggaagauaucgagcagauggccaaugggauugcacugggauuaauggcucucaagcugaucacucaguuugagaccuaucagcuuuggacggcccugauuuccuugacauguucaaacaccaucuucacucucaccguggccuggcgaacagcuacucugauacuagccgguguuagucugcuuccugugugccaaagcucguccaugcggaaaaccgacuggcucccaaugacggucgccgcgaugggcguacccccucugcccuuguuuaucuucucucugaaggauacauuaaagcguagaagcuggccacucaaugaaggggugauggcuguuggacuggugucaauucuugccaguucccuguugaggaacgacgucccuauggcaggcccccucguggccggugggcugcuaaucgcuuguuacguaauuaccggaacuucugcagaucugacaguggagaaagccgcggacgucaccugggaagaggaagcugagcagacuggcguuagccauaaccuuaugaucacaguggacgaugacggcaccaugcgcauaaaggaugacgagacggaaaauauucucacugugcuguugaaaaccgccuuacugaucgucuccgggaucuuuccauacucaauuccggcaacacuccugguguggcacaccuggcagaagcagacacaacggagcggaguucuuugggauguaccuagucccccagagacucagaaagccgaacuggaggaggguguguauagaauaaagcagcagggcaucuucgggaaaacccaagucggagugggcguucagaaggaagguguguuucauacgauguggcacgucacaagaggggcuguguugacuuacaacggaaagcgacuagagcccaauugggccucugucaaaaaggaccugauuuccuauggcggcggguggcgccucagcgcacaguggcaaaaaggagaagagguccaggugaucgcuguugaaccugguaagaaccccaaaaauuuccagaccaugcccggcacauuccagaccacuaccggggagauuggagccaucgcgcuggauuuuaagccuggcacaucggguucaccgauaaucaaccgggaggggaagauugugggacuuuacggcaauggcgucgugacgaaaaacgggggauauguuucugguaucgcccaaacuaaugcagaaccagacggccccaccccugaguuagaagaggaaauguucaagaaaagaaaccugacaauuauggaucuccacccagggaguggaaagaccaggaaauacuugcccgcuaucgugcgugaggccauaaagcgccggcugagaacucucauucuggcuccuacaagggucguggcagccgagauggaagaggcccuuaagggccugccgauccgauaucagaccacggcuacuaaauccgaacauacaggucgggagaucguagacuugaugugccacgcgaccuuuaccaugcgccuacugagccccgugagaguuccaaauuacaaccucauuaucauggaugaagcacauuucacugacccugccucuauagcugccaggggguacauuagcacacgggucggaaugggcgaggcagccgcuaucuuuaugaccgcgacacccccaggcacugccgaugcauucccucaguccaaugcucccauucaggacgaggaacgagacaucccagagagaucauggaacagugggaaugaauggauaacggauuuugccggaaagaccgugugguucgugccgagcauuaaagcagguaacgacaucgccaacuguuuacgcaagaauggcaaaaaggucauccaacugucuaggaagacauuugauacugaguaucagaaaaccaaacuuaacgacugggauuucguagugacaaccgacauuuccgagaugggggcuaauuuuaaagccgaucguguuaucgacccucggagaugccugaagcccgugauucucacugauggaccagaaagggucauauuggcgggccccaugccugugacggcagccucagcugcccagcgccgagguagaguugggcggaacccacagaaagagaaugaccaauacaucuucaccggccagccccugaacaaugaugaagaccacgcucauuggacagaggcaaagaugcuccuggacaacauuaauacuccugaaggaaucaucccggcccuuuucgagccagagagggaaaagagugcugccauugauggcgaguaucgccuaaaaggggaaagccguaagaccuuuguggagcugaugagacggggagacuugcccgucugguuagcacacaaaguggcguccgaagguauaaaguacacagauaggaaauggugcuucgacggccagcgcaacaaucagauccuggaggagaacauggauguagaaauuuggaccaaggagggggagaaaaagaagcuccgaccuagauggcuggacgcccggacuuauucugauccccuugcucugaaagaguuuaaggacuucgccgcaggaaggaaaucgaucgcucucgauuuggugacagaaauuggccgcguuccaacgcaccuggcccauagaaccaggaaugcacuagacaaccuggucaugcuccacacuagcgagcauggugggaaggccuaccggcacgcuguggaggaacuuccugagacaauggaaacccuguuauugcugggccucaugauccugcuuaccggaggcgcgaugcuguuucucauaucagggaaaggaaucgguaagacauccauuggcuugaucugugugauugccaguucugggaugcuguggauggcagagauccccuuacaauggauagcuagcgccauuguccuagaguucuuuaugaugguucugcucaucccagaaccugagaagcagcguacuccgcaggauaaucaacuugccuaugugguaauuggaauccugacguuggcagcuauaaucgccgcgaacgaaaugggccugcucgagaccacaaaacgcgaccuggguauguccaaggaacccgggguggucucaccaacuucuuaccuugauguggaccuccacccugcuagcgccuggacccuguacgcaguugccacaaccgugauuacucccauguugcgacauacgaucgagaauaguacagcuaacgucucccuggcagccauugcgaaccaggcuguaguguuaaugggccuagacaaaggauggccaaucagcaagauggaucugggcguuccucuccuugcccuggggugcuauucucaggugaaucccuugacccugacugcagccguccuccugcuuauaacccacuacgcuauuaucggaccgggcuuacaggccaaagcaacaagagaggcucaaaagaggacugccgcggguaucaugaagaacccaaccguggacgggauuaugacaaucgaucuggacccugucauauaugauucaaaauucgaaaagcagcucggacaggugauguugcugguucuaugugccgugcagcugcuccuuaugcggacguccugggcacugugcgaggcuuugacccuggccacuggccccauuacaacccucugggaagguaguccaggcaaauuuuggaauacuacaaucgcaguaagcauggcuaacauuuuccgcgggucguaccuggccggagccggcuuagcguuuucugugaugaaguccgucgggaccggaaaaagaggcacggguagccaaggggagacccuuggagaaaaguggaagaaaaagcugaaucagcucucaaggaaagaguucgaccuauauaagaaaaguggcaucacagagguugaucggacugaagcuaaggagggucugaaacgaggcgaaauaacccaucacgcagugucuagaggguccgccaaguugcagugguuugucgagcgcaacauggugauccccgaaggaaggguaauugaccugggcugugggcggggaggcuggagcuacuauugcgcuggucucaagaaagugacagagguucguggguacacuaagggaggcccuggccaugaggaaccggugcccaugucaaccuacggguggaauaucgucaaacuuaugaguggaaaggauguguucuaucugccaccugagaaaugugacacauugcugugcgauauuggugaaagcucccccucuccuaccgucgaggagagcagaacuaucagggugcucaagaugguugaaccaugguuaaagaacaaucaguucuguauuaaaguacugaaccccuacaugccuacggugaucgagcaccuugaacgccugcaacggaagcacggcgggaugcuaguccgaaauccacucuccagaaacucaacacaugagauguauuggauaucuaauggaaccggcaacauuguggccaguguuaauauggugucgaggcuguugcugaaccgcuuuacuaugacccaccggagacccacaaucgaaaaagacgucgaucucggugcagggacgcgucaugugaacgccgagccggagaccccuaauauggacguaaucggagaaaggauuaagcggauaaaagaggaacacaacagcacuuggcacuacgacgaugagaauccauauaagacaugggcuuaccauggcuccuaugaagugaaggcgaccggcucugccucaagcaugaucaacgggguugucaaacuucugacuaagcccugggacguggugccuauggucacacagauggcaaugaccgauacaacuccauucggacagcaacgcguuuuuaaagagaagguggacacccgaacgcccagauccaugccggguaccaggcggguaaugggcauuacagcugagugguuauggcgcacucuggggagaaauaaaaagccuagguugugcacccgagaagaguucacaaagaaagugcggacuaacgccgcaaugggagccgucuuuaccgaagagaaucagugggauagugcuaaggccgcgguggaagacgaggauuucuggaaacucguugaccgugagagagaacugcacaagcuaggcaaaugugguucuugcguguacaacaugauggggaagcgcgagaagaaacuuggagaauuuggcaaagcaaaaggcagcagggccaucugguacauguggcugggggcucgguaucucgaguucgaggcccugggauuuuugaaugaagaucauugguucucaagagagaacuccuacaguggugucgaaggcgaggggcugcacaagcucggauauauucuucgcgacaucagcaaaauacccggcggugcaauguacgcugaugacacggccgggugggacacaaggaucaccgaagaugaccugcauaaugaggagaagauuacucagcagauggauccagaacaccgacaauuagcuaacgccaucuuuaaacugacauaucagaauaaggugguaaagguucagcggccuacccccacuggaaccgugauggacauuaucucuagaaaagaucagaggggcuccggccaagucgggacauacggauugaacacguucaccaauauggaggcacagcucauacgccagauggaaggugagggcgugcugucaaaggcggaccuagaaaacccacaccuucccgagaaaaagauuacucaguggcuggagacaaaagggguggaacgucucaagcggauggccaucagcggagaugacugcgucguuaagccuaucgaugacagauuugcuaacgcccuguuggcauuaaaugauaugggcaaagugaggaaggacauuccacaauggcagccgucgaaagguuggcaugauuggcagcagguacccuucuguucucaccauuuccacgagcugauaaugaaggacgggcgcaaacucguggucccuugccgaccacaagacgaacuuaucggacgggcuagaauuagucagggcgccggcuggucccugagggagaccgcaugucuagggaaggccuaugcgcagauguggagccugauguacuuucaccgcagagaucuccgguuggcuucaaacgccaucugcuccgcagugcccguucauugggugccuacuucuaggacaaccuggagcauucacgcccaucaccaauggaugacgacagaagacaugcugaccgucuggaaucguguguggaucgaggauaacccauggauggaggacaagacucccguaaccacaugggaaaauguuccuuaccuuggaaaacgagaggaucaguggugugguagucugauaggccucacuucccgcgcuaccugggcccagaacaucccgacagcaauucagcaagugaggagcuuaaucgggaaugaagaguuccuggacuauaugccaucuaugaagcgguuuaggaaagaggaagagucagaaggagcuauuugguga

SEQ ID NO: 15523 - RNA, 9873 nt, Artificial Sequence
  derived and/or modified CDS sequence (opt3) from DENV-3__FJ639795__SS-prME
accagccugugccucaugaugauccuucccgccgcucuggcauuccacuugacauccagggacggcgagccuaggaugauuguggggaagaacgaacggggaaaaucuuuacuguuuaagacugccucagguauaaauauguguacgcuaaucgcgauggaucucggcgaaaugugcgacgauaccgucaccuacaaauguccacacauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacaccauuggcguccucgagcaggggaaaagaacucugacaccacagccuauggaguuaaaguacucauggaaaaccuggggaaaggccaagaucgugacagcggaaacucaaaacaguuccuucauaauugauggccccaauaccccagagugccccagcgccucuagggcuuggaacguuugggaaguggaggacuaugguuuuggggucuucacgacaaauaucuggcugaaacuucgggaaguguacacccaguugugugaccaccgccucaugucagcagccguuaaggaugagagagcugugcacgccgacaugggauacuggauugagagucagaaaaacggcagcuggaagcuggaaaaagcaucccuaaucgagguaaagacuugcaccuggccuaagucucauacacuguggucgaaugguguccucgaaagcgauaugauaaucccaaaaucccuggcgggcccgauuucacagcacaacuauaggcccggguaccauacucaaaccgccggaccuuggcaccuuggcaaguuggagcuggacuuuaauuauugcgaggggacaacgguggugaucaccgaaaacuguggaacucguggcccaaguuuacggacaaccacugucucugguaaacucauucacgaguggugcugucgaagcugcacacugcccccucuuagauacaugggggaagauggauguugguauggcauggagaucaggccaauauccgaaaaggaggagaauaugguuaaaucacuggugagcgcugguucuggcgaaguagacaacuucaccauggggguguugugccucgccauucuguuugaggaagucaugcgcggaaaguucggcaagaaacauaugaucgcagggguguucuuuacguucguucuacugcucuccggacagaucacuuggcgggauauggcucacacccugauuaugaucggcaguaaugccagcgacagaauggguauggggauuacauaccuugcauugauagccaccuuuaagauccagcccuuccuggcuuuaggauuuuuccucaggaaacugacuucucgcgagaaccuucugcuaggcgugggccucgcgauggccacaacccugcaauugccggaagauauugagcagauggcaaaugggaucgcucugggauuaauggcccucaagcugauuacacaguuugagacuuaucagcuuuggaccgcccugaucuccuugacguguucaaacacaauauucacccucacugucgcuuggcgaaccgcaacacugauccuagccggugugagucugcuuccuguuugccaaagcucguccaugcggaaaacugacuggcucccaaugaccguggcggcuaugggcgucccaccucugcccuuguuuauuuucucucugaaggauacguuaaagcguagaagcuggccacucaaugaagggguaauggccgugggacugguuucaauccuugcaaguucccuguugaggaacgacgugccuauggccggcccccucgucgcuggugggcugcuaauugcauguuacgugaucacaggaaccucugccgaucugacuguagagaaagcggcugacgugacaugggaagaggaagccgagcagaccggcgucagccauaaccuuaugauaacuguugacgaugacggcacaaugcgcauuaaggaugacgagaccgaaaauauccucacggugcuguugaaaacugcauuacugaucguguccgggauuuuuccauacucaauaccggccacccuccuggucuggcacacauggcagaagcagacccaacggagcggagugcuuugggauguuccuagucccccagagacacagaaagcugaacuggaggaggguguauauagaaucaagcagcagggcauuuucgggaaaacucaagugggagucggcgugcagaaggaagguguuuuucauaccauguggcacgugacgagaggggccgucuugacauacaacggaaagcgacuagagcccaauugggcaucugugaaaaaggaccugaucuccuauggcggcggguggcgccucagcgcucaguggcaaaaaggagaagagguacaggucauugccguggaaccugguaagaaccccaagaauuuccagacuaugcccggcaccuuccagacaaccacuggggagaucggagcgauagcccuggauuuuaagccuggcaccucggguucaccgaucauuaaccgggaggggaagguugugggacuuuacggcaauggcgucgugacuaagaacgggggauauguuucugguaucgcacaaacgaaugcugaaccagacggccccacuccugaguuagaagaggaaauguucaagaaaagaaaccugaccauuauggaucuccacccagggaguggaaagacaaggaaauacuugcccgccaucgugcgugaggcuauaaagcgccggcugagaacccucauucuggcaccuacuagggucguggccgccgagauggaagaggcucuuaagggccugccgauccgauaucagacaaccgcgacgaaauccgaacauacuggucgggagaucguagacuugaugugccacgcaacauuuaccaugcgccuacugagccccgugagaguuccaaauuacaaccucauuaucauggaugaagcccauuucaccgacccugcuucuauagccgcaaggggguacauuagcacucgggucggaaugggcgaggccgcugcgaucuuuaugacagccacacccccaggcacagcagaugcuuucccucaguccaaugcccccauucaggacgaggaacgagacaucccagagagaucauggaacagugggaaugaauggauaacugauuuugcaggaaagacggugugguucgugccgagcauuaaagccgguaacgacaucgcuaacuguuuacgcaagaauggcaaaaaggucauccaacugucuaggaagaccuuugauacagaguaucagaaaacuaaacuuaacgacugggauuucguagugaccacagacauuuccgagaugggggccaauuuuaaagcggaucguguuaucgacccucggagaugccugaagcccgugauucucaccgauggaccagaaagggucauauuggcaggccccaugccugugacugccgcuucagccgcucagcgccgagguagaguugggcggaacccacagaaagagaaugaccaauacaucuucacgggccagccccugaacaaugaugaagaccacgcacauuggaccgaggccaagaugcuccuggacaacauuaauacaccugaaggaaucaucccggcucuuuucgagccagagagggaaaagagugccgcaauugauggcgaguaucgccuaaaaggggaaagccguaagacuuuuguggagcugaugagacggggagacuugcccgucugguuagcgcacaaaguggccuccgaagguauaaaguacaccgauaggaaauggugcuucgacggccagcgcaacaaucagauccuggaggagaacauggauguagaaauuuggacaaaggagggggagaaaaagaagcuccgaccuagauggcuggacgcucggaccuauucugauccccuugcccugaaagaguuuaaggacuucgcagcuggaaggaaaucgaucgcccucgauuuggugacugaaauuggccgcguuccaacacaccuggcacauagaacgaggaaugcccuagacaaccuggucaugcuccacaccagcgagcauggugggaaggcuuaccggcacgcgguggaggaacuuccugagacuauggaaacacuguuauugcugggccucaugauccugcuuaccggaggcgccaugcuguuucucauaucagggaaaggaaucgguaagaccuccauuggcuugaucugugugauugcaaguucugggaugcuguggauggcugagauccccuuacaauggauagccagcgccauuguccuagaguucuuuaugaugguucugcucaucccagaaccugagaagcagcguacaccgcaggauaaucaacuugcauaugugguaauuggaauccugacuuuggcugccacgauagcggcuaacgaaaugggccugcucgagaccacaaaacgcgaccuggguauguccaaggaacccgggguggucucaccaacuucuuaccuugauguggaccuccacccugccagcgcauggacccuguacgccguugcuacaaccgugaucacucccauguugcgacauacgauugagaauaguacagcaaacgucucccuggccgcgaucgcuaaccaggccguaguguuaaugggccuagacaaaggauggccaauuagcaagauggaucugggcguuccucuccuugcacuggggugcuauucucaggugaaucccuugacccugacugccgcuguccuccugcuuaucacccacuacgccauaauuggaccgggcuuacaggcaaaagcuacaagagaggcccaaaagaggacugcggccgguaucaugaagaacccaaccguggacgggaucaugacaauugaucuggacccugucaucuaugauucaaaauucgaaaagcagcucggacaggugauguugcugguucuaugugcagugcagcugcuccuuaugcggacguccugggcucugugcgaggccuugacccuggcaacuggccccauaacaacccucugggaagguaguccaggcaaauuuuggaauacuacaauugcuguaagcauggccaacaucuuccgcgggucguaccuggccggagcgggcuuagcuuuuucuauuaugaaguccguggggaccggaaaaagaggcacggguagccaaggggagacccuuggagaaaaguggaagaaaaagcugaaucagcucucaaggaaagaguucgaccuauauaagaaaaguggcaucacagaggucgaucggacugaagcaaaggagggucugaaacgaggcgaaauaacccaucacgccguuucuagaggguccgcuaaguugcagugguuuguggagcgcaacauggucauccccgaaggaagggugauugaccugggcugugggcggggaggcuggagcuacuauugcgccggucucaagaaaguaacagaggugcguggguacacuaagggaggcccuggccaugaggaaccgguucccaugucaaccuacggguggaauaucgugaaacuuaugaguggaaaggaugucuucuaucugccaccugagaaaugugacacauugcugugcgauauuggugaaagcucccccucuccuaccguggaggagagcagaacuaucaggguccucaagaugguggaaccaugguuaaagaacaaucaguucuguauuaaaguucugaaccccuacaugccuacgguaaucgagcaccuugaacgccugcaacggaagcacggcgggaugcuagugcgaaauccacucuccagaaacucaacacaugagauguauuggauaucuaauggaaccggcaacauugucgcaagugugaauaugguuucgaggcuguugcugaaccgcuuuacuaugacccaccggagacccacaaucgaaaaagacguggaucucggugccgggacgcgucaugucaacgcugagccggagaccccuaauauggacgugaucggagaaaggauuaagcggauaaaagaggaacacaacagcacuuggcacuacgacgaugagaauccauauaagacaugggcguaccauggcuccuaugaaguaaaggccaccggcucugcaucaagcaugaucaacggggugguuaaacuucugacuaagcccugggacgucgugccuauggugacacagauggcuaugaccgauacaacuccauucggacagcaacgcgucuuuaaagagaagguugacacccgaacgcccagauccaugccggguaccaggcgggugaugggcauuacagccgagugguuauggcgcacucuggggagaaauaaaaagccuagguugugcacccgagaagaguucacaaagaaaguacggacuaacgcagccaugggagcuguguuuaccgaagagaaucagugggauagugccaaggcggcagucgaagacgaggauuucuggaaacucguggaccgugagagagaacugcacaagcuaggcaaaugugguucuugcguuuacaacaugauggggaagcgcgagaagaaacuuggagaauuuggcaaagccaaaggcagcagggcuaucugguacauguggcugggggcccgguaucucgaguucgaggcacugggauuuuugaaugaagaucauugguucucaagagagaacuccuacagugguguggaaggcgaggggcugcacaagcucggauauauucuucgcgacaucagcaaaauacccggcggugcuauguacgccgaugacacggcugggugggacacaaggaucaccgaagaugaccugcauaaugaggagaagauuacucagcagauggauccagaacaccgacaauuagccaacgcaaucuuuaaacugacauaucagaauaaggucgugaagguacagcggccuacccccacuggaaccguuauggacauuaucucuagaaaagaucagaggggcuccggccaaguggggacauacggauugaacacguucaccaauauggaggcgcagcucauacgccagauggaaggugagggcguccugcuaaaggccgaccuugaaaacccacaucugcccgagaaaaagauuacucaguggcucgagacaaaagggguggaacgucugaagcggauggcuaucucaggagaugacugcguggucaagccuaucgaugacagauuugccaacgcauuguuagcucugaaugauaugggcaaaguuaggaaggacauuccacaauggcagccgagcaaagguuggcaugauuggcaacaggugcccuucuguucgcaccauuuccacgagcucauaaugaaggacgggcgcaaacuuguagugccuugccgaccacaagacgaacugaucggacgggccagaauuucucagggcgcaggcuggagucuaagggagaccgccugucuggggaaggcguaugcucagauguggucccucauguacuuucaccgcagagauuugcggcuggccagcaacgcaaucugcucagccguccccgugcauuggguuccuacuuccaggacaaccuggucuauucacgcucaucaccaauggaugacgacagaagacaugcuuaccguguggaaucgugucuggaucgaggauaacccauggauggaggacaagacucccgugaccacaugggaaaauguaccuuaccugggaaaacgagaggaucaguggugugguagccucauaggcuuaacaagucgcgccaccugggcacagaacaucccgacagcuauucagcaaguuagaucccugaucgggaaugaagaguucuuggacuauaugccaagcaugaagcgguuuaggaaagaggaagagucugaaggagccauuugguga

SEQ ID NO: 15524 - RNA, 9873 nt, Artificial Sequence
  derived and/or modified CDS sequence (opt3) from DENV-3__FJ639798__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccguggagggaaaagucgugcaguaugaaaaucugaaguacacaguuauaauuacugugcauaccggugaccagcaccaggucggcaacgagacacaaggggugaccgcagaaaucacuccucaggcuuccacgacagaggccauucucccagaauauggaacccuuggccuggagugcucuccgcgaacugguuuggacuucaaugagaugauccuacugaccaugaaaaacaaggcguggaugguacauagacagugguuuuucgaucucccccugccuuggacaagcggggccaccacugaaacaccaacguggaauaggaaagagcuucugguuaccuuuaagaacgcacacgcuaaaaagcaagaaguggucguguugggcucccaggagggagccaugcacacugcucucacaggcgccaccgaaauccagaauucagggggaacaaguauuuucgcaggucaucugaagugucgguuaaaaauggacaagcuggagcuaaaaggcaugagcuacgccaugugcacuaacaccuuuguccucaagaaagaggugucugaaacgcagcacgggaccauacugaucaagguugaguacaagggagaagaugugcccuguaaaauuccuuucuccacagaggacggccaagguaaggcucauaacgggcgucuuaucacugcgaauccaguagucaccaaaaaggaggaacccgugaacauagaggcagaaccgccuuucggcgagucaaauauuguuaucggaaucggcgauaacgccuugaaaauuaauugguauaagaaggggagcaguaucggaaaaauguuugaagcuacagcccgcggugcaagaaggauggccauucugggcgacacugcuugggauuucgggucugugggaggcguccucaacucccuggguaagauggugcaccagauauuugggagcgccuacaccgcacuuuucucgggcguaucuugggugaugaaaaucggaauuggcguucuguugacguggaucgggcucaauuccaagaacacaucaaugaguuuuagcugcaucgcgauuggaauaaucacccuguauuuaggcgcugucgugcaggccgacauggguugugugauuaauuggaaagggaaggagcugaagugcggauccggcaucuucgucacuaacgagguucauacauggaccgaacaguacaaauuucaagcagauucucccaagcggcuagccacugcuauugccggugcaugggagaauggcgugugugggauccgaagcaccacacgcauggaaaaccuccuguggaaacagauagcuaaugagcuuaacuauaucuugugggaaaauaacauuaagcugacggugguagucggagacaucauuggcgugcucgagcaggggaaaagaacccugacuccacagccuauggaguuaaaguacucauggaaaacauggggaaaggccaagaucguuaccgcggaaacacaaaacaguuccuucauaauugauggccccaauacuccagagugccccagcgccucuagggcuuggaacgugugggaagucgaggacuaugguuuugggguguucaccacgaauaucuggcugaaacuucgggaaguuuacacacaguugugugaccaccgccucaugucagcagccgugaaggaugagagagcuguacacgccgacaugggauacuggauugagagucagaaaaacggcagcuggaagcuggaaaaagcaucccuaaucgaggucaagaccugcacuuggccuaagucucauacccuguggucgaauggugugcucgaaagcgauaugauaaucccaaaaucccuggcgggcccgauuucacagcacaacuauaggcccggguaccauacacaaacugccggaccuuggcaccuuggcaaguuggagcuggacuuuaauuauugcgaggggaccacaguggucaucacggaaaacuguggaacccguggcccaaguuuacggacuacaaccguuucugguaaacucauucacgaguggugcugucgaagcugcacucugcccccucuuagauacaugggggaagauggauguugguauggcauggagaucaggccaauauccgaaaaggaggagaauauggugaaaucacugguaagcgcugguucuggcgaaguggacaacuucacaaugggggucuugugccucgccauucuguuugaggaagugaugcgcggaaaguucggcaagaaacauaugaucgcagggguuuucuuuaccuucgugcuacugcucuccggacagaucacguggcgggauauggcucacacucugauuaugaucggcaguaaugccagcgacagaauggguaugggggucaccuaccuugcauugauugccacauuuaagauacagcccuuccuggcuuuaggauuuuuccucaggaaacugaccucucgcgagaaccuucugcuaggcgugggccucgcgauggccacuacacugcaauugccggaagauaucgagcagauggcaaaugggauugcucugggauuaauggcccucaagcugaucacccaguuugagacauaucagcuuuggacugcccugauuuccuugaccuguucaaacacgaucuucacacucaccguugcuuggcgaacugcaacccugauacuagccggugugagucugcuuccugucugccaaagcucguccaugcggaaaacagacuggcucccaaugacuguagcggcuaugggcgugcccccucugcccuuguuuaucuucucucugaaggauaccuuaaagcguagaagcuggccacucaaugaagggguuauggccgugggacuggucucaauucuugcaaguucccuguugaggaacgacgugccuauggccggcccccucguagcuggugggcugcuaaucgcauguuacgugauuacgggaacaucugccgaucugaccgucgagaaagcggcugacguuacuugggaagaggaagccgagcagacaggcgugagccauaaccuuaugaucaccguggacgaugacggcacuaugcgcauaaaggaugacgagacagaaaauauucucaccguccuguugaaaacggcauuacugaucguguccgggaucuuuccauacucaauuccggccacucuccugguuuggcacaccuggcagaagcagacacaacggagcggaguacuuugggaugugccuagucccccagagacccagaaagcugaacuggaggagggugucuauagaauaaagcagcagggcaucuucgggaaaacacaagugggaguuggcgugcagaaggaaggugucuuucauacuauguggcacgugaccaggggggccguauugacguacaacggaaagcgacuagagcccaauugggcaucugucaaaaaggaccugauuuccuauggcggcggguggcgccucagcgcucaguggcaaaaaggagaagaggugcagguuaucgccguggaaccugguaagaacccaaaaaauuuccagacaaugcccggcacuuuccagaccacaaccggggagauuggagcgaucgcccuggauuuuaagccuggcacuucggguucaccgauaaucaaccgggaggggaaggucgugggacuuuacggcaauggcguugugaccaaaaacgggggauaugucucugguauugcacaaacaaaugcugaaccagacggccccacgccugaguuagaagaggaaauguucaagaaaagaaaccugacuaucauggaucuccacccagggaguggaaagaccaggaaauacuugcccgccauugugcgugaggcuaucaagcgccggcugagaacacucauacuggcaccuaccaggguaguggccgccgagauggaagaggcucuuaagggccugccgauucgauaucagacuacagcgaccaaauccgaacauacgggucgggagaucguugacuugaugugccacgcaacuuuuacaaugcgccuacugagccccgucagagugccaaauuacaaccucaucauuauggaugaagcccauuucaccgacccugcuucuaucgccgcaaggggguacauaagcacccgggugggaaugggcgaggccgcugcgauuuuuaugacugccacacccccaggcaccgcagaugcuuucccucaguccaaugcccccauccaggacgaggaacgagacauuccagagagaucauggaacagugggaaugaauggaucacagauuuugcaggaaagacugucugguucguaccgagcauaaaagccgguaacgacauugcuaacuguuuacgcaagaauggcaaaaaggugauccaacugucuaggaagacguuugauaccgaguaucagaaaacaaagcuuaacgacugggauuucguugugacuaccgacaucuccgagaugggggccaauuuuaaagcggaucgugucauugacccucggagaugccugaagcccgugauccucacagauggaccagaaaggguuauuuuggcaggccccaugccugugaccgccgcuucagccgcucagcgccgagguagagucgggcggaacccacagaaagagaaugaccaauacauauucacuggccagccccugaacaaugaugaagaccacgcacauuggacggaggccaagaugcuccuggacaacaucaauaccccugaaggaauuaucccggcucuuuucgagccagagagggaaaagagugccgcaaucgauggcgaguaucgccuaaaaggggaaagccguaagacauuuguggagcugaugagacggggagacuugcccguaugguuagcgcacaaaguggccuccgaagguauuaaguacacugauaggaaauggugcuucgacggccagcgcaacaaucagauacuggaggagaacauggauguugaaaucuggaccaaggagggggaaaaaaagaagcuccgaccuagauggcuggacgcucggacauauucugauccccuugcccugaaagaguuuaaggacuucgcagcuggaaggaaaucgauugcccucgauuuggucaccgaaaucggccgcgugccaacucaccuggcacauagaacaaggaaugcccuagacaaccuggugaugcuccacacgagcgagcauggugggaaggcuuaccggcacgcggucgaggaacuuccugagaccauggaaacucuguuauugcugggccucaugauucugcuuacaggaggcgccaugcuguuucucaucucagggaaaggaauagguaagaccuccaucggcuugauuuguguuaucgcaaguucugggaugcuguggauggcugagauucccuuacaauggaucgccagcgccauagugcuagaguucuuuaugaugguacugcucauuccagaaccugagaagcagcguaccccgcaggauaaucaacuugcauauguggucaucggaauucugacauuggcugccacuaucgcggcuaacgaaaugggccugcucgagacgaccaaacgcgaccuggguauguccaaggaacccggggugguuucaccaacaucuuaccuugauguggaccuccacccugccagcgcauggacucuguacgccgucgcuaccacaguaauaacccccauguugcgacauacuaucgagaauaguacggcaaacgugucccuggccgcgauugcuaaccaggccguuguguuaaugggccuagacaaaggauggccaaucagcaagauggaucugggcgucccucuccuugcacuggggugcuauucucaggugaaucccuugacacugaccgccgcuguccuccugcuuauuacucacuacgccaucauaggaccgggcuuacaggcaaaagcuaccagagaggcccaaaagaggacagcggccgguauuaugaagaacccaacuguggacgggaucaugaccaucgaucuggacccuguuauuuaugauucaaaauucgaaaagcagcucggacaggugauguugcugguacuaugugcagugcagcugcuccuuaugcggacauccugggcucugugcgaggccuugacgcuggcaaccggccccaucacuacacucugggaagguaguccaggcaaauuuuggaauaccacuauagcugucagcauggccaacauuuuccgcgggucguaccuggccggagcgggcuuagcuuuuucuaucaugaaguccguugggacaggaaaaagaggcaccgguagccaaggggagacgcuuggagaaaaguggaagaaaaagcugaaucagcucucaaggcgggaguucgaccuauauaaaaagaguggcauuaccgagguggaucgaacagaagcaaaagagggucugaagagaggcgaaaucacucaucacgccgucucucgcggguccgcuaaauugcagugguuuguggagaggaacaugguaauacccgaaggacgggugaucgaccugggcugugggcguggaggcuggagcuacuauugcgccggucucaagaagguuaccgaggugagaggguacacaaaaggaggcccuggccaugaggaaccgguccccaugucaacuuacggguggaauauugugaagcuuaugaguggaaaagaugucuucuaucugccaccugagaagugugacaccuugcugugcgauaucggugaaagcucccccucuccuacaguggaggagagcaggaccauucgcguucucaaaaugguagaaccaugguuaaagaacaaucaguucuguaucaaggugcugaaccccuacaugccuacugucauugagcaccuugaacggcugcaacgaaaacacggcgggaugcuagugagaaauccacucuccaggaacucaacgcaugagauguauuggaucucuaauggaacaggcaacauaguugcaagugugaauauggucucgcgccuguugcugaaccgguuuaccaugacucacagacgucccaccauugaaaaggacguggaucucggugccgggacaaggcauaucaacgcugagccggagacgccuaauauggacguaaucggagaacggauuaaacgcauaaaggaggaacacaacagcaccuggcacuacgacgaggaaaauccauauaaaacuugggcguaccauggcuccuaugaggugaaggccacaggcucugcaucaagcaugaucaacgggguugucaagcuucugaccaaacccugggauguggugccuauggucacucagauggcuaugacagacaccacaccauucggacagcaacgaguuuuuaaggagaaaguggauacuagaacccccaggccgaugccugguacgcggcgcguaaugggcauuaccgccgaaugguuauggagaacacuggggaggaauaagaaaccccgauugugcacucgggaggaauucaccaagaaggugcguacaaacgcagccaugggagcugucuuuacugaggaaaaucagugggacuccgccaaagcggcaguggaggaugaggacuucuggaagcucguugauagagaacgcgagcugcacaaacuaggcaagugugguaguugcguguacaacaugauggggaaaagggaaaagaaacuuggagaguuuggcaaggccaagggcucucgggcuaucugguacauguggcugggggccagauaucucgaguucgaagcacugggauuuuugaaugaggaccauugguucagccgcgaaaacucauacuccggugucgagggcgaagggcugcacaaacucggauauauucuuagggauaucaguaagauaccaggcggugcuauguacgccgacgauaccgcugggugggacacgcgaaucacagaggacgaucugcauaaugaggaaaaaauuacccagcagauggacccugagcaccggcaauuagccaacgcaaucuuuaagcugacuuaucagaauaaagugguaaagguucagagacccacaccaaccggaacugugauggauauuaucagcaggaaggaccagcgcggcucuggccaagucgggaccuacggauugaacacauucacgaauauggaagcgcagcucauacgucagauggagggugaaggcgugcuguccaaagccgaucuagagaacccccaccuuccugagaagaaaauuacccaguggcuggaaacuaaggggguggagcggcucaaaagaauggcuaucucaggagacgauugcgucguuaagccaaucgacgauagguuugccaacgcacuguuggcuuuaaaugacaugggcaaggugcgcaaagauauuccgcaauggcagcccagcaaggguuggcaugacuggcagcagguaccuuucuguucgcaccauuuccacgaacugauaaugaaagaugggcgaaagcucguggucccaugccggccccaagacgagcuuaucggaagagccaggauuucucagggcgcaggcuggagucugcgcgaaacagccugucuagggaaagcguaugcucagauguggucccugauguacuuucacagacgggaccucagguuggccagcaacgcaaucugcucagccgugccuguucauugggugccaaccucccguacuacauggucuauucacgcucaucaccaauggaugaccacggaggauaugcugacagucuggaaucgaguguggaucgaggacaaccccuggauggaagauaagaccccuguaacuaccugggagaauguuccguaccuuggaaagcgcgaagaccaguggugugguagccugauaggccucacaaguagagccacuugggcacagaacaucccaaccgcuauucagcaagugcgguccuuaaucgggaaugaggaguuccuggauuauaugcccagcaugaaaagguuucgcaaggaagaggaaucugagggagccauuugguga

SEQ ID NO: 15525 - RNA, 9873 nt, Artificial Sequence
  derived and/or modified CDS sequence (opt3) from DENV-3__FJ639799__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacgucacgaccgauagccggugcccuacacagggcgaagcuguuuugccagaggaacaggaccagaauuauguguguaaacacacuuacguagaucgcgguugggggaacggaugcggccucuucggcaaggggagucuggugaccugcgccaaguuucaauguuuagagcccaucgagggaaaagucgugcaguaugaaaaucugaaguacacaguuauaauuacugugcauaccggugaccagcaccaggucggcaacgagacacaaggggugaccgcagaaaucacuccucaggcuuccacgacagaggccauucucccagaauauggaacccuuggccuggagugcucuccgcgaacugguuuggacuucaaugagaugauccuacugaccaugaaaaacaaggcguggaugguacauagacagugguuuuucgaucucccccugccuuggacaagcggggccaccacugaaacaccaacguggaauaggaaagagcuucugguuaccuuuaagaacgcacacgcuaaaaagcaagaaguggucguguugggcucccaggagggagccaugcacacugcucucacaggcgccaccgaaauccagaauucagggggaacaaguauuuucgcaggucaucugaagugucgguuaaaaauggacaagcuggagcuaaaaggcaugagcuacgccaugugcacuaacaccuuuguccucaagaaagaggugucugaaacgcagcacgggaccauacugaucaagguugaguacaagggagaagaugugcccuguaaaauuccuuucuccacagaggacggccaagguaaggcucauaacgggcgucuuaucacugcgaauccaguagucaccaaaaaggaggaacccgugaacauagaggcagaaccgccuuucggcgagucaaauauuguuaucggaaucggcgauaacgccuugaaaauuaauugguauaagaaggggagcaguaucggaaaaauguuugaagcuacagcccgcggugcaagaaggauggccauucugggcgacacugcuugggauuucgggucugugggaggcguccucaacucccuggguaagauggugcaccagauauuugggagcgccuacaccgcacuuuucucgggcguaucuugggugaugaaaaucggaauuggcguucuguugacguggaucgggcucaauuccaagaacacaucaaugaguuuuagcugcaucgcgauuggaauaaucacccuguauuuaggcgcugucgugcaggccgacauggguugugugauuaauuggaaagggaaggagcugaagugcggauccggcaucuucgucacuaacgagguucauacauggaccgaacaguacaaauuucaagcagauucucccaagcggcuagccacugcuauugccggugcaugggagaauggcgugugugggauccgaagcaccacacgcauggaaaaccuccuguggaaacagauagcuaaugagcuuaacuauaucuugugggaaaauaacauuaagcugacggugguagucggagacaucauuggcgugcucgagcaggggaaaagaacccugacuccacagccuauggaguuaaaguacucauggaaaacauggggaaaggccaagaucguuaccgcggaaacacaaaacaguuccuucauaauugauggccccaauacuccagagugccccagcgccucuagggcuuggaacgugugggaagucgaggacuaugguuuugggguguucaccacgaauaucuggcugaaacuucgggaaguuuacacacaguugugugaccaccgccucaugucagcagccgugaaggaugagagagcuguacacgccgacaugggauacuggauugagagucagaaaaacggcagcuggaagcuggaaaaagcaucccuaaucgaggucaagaccugcacuuggccuaagucucauacccuguggucgaauggugugcucgaaagcgauaugauaaucccaaaaucccuggcgggcccgauuucacagcacaacuauaggcccggguaccauacacaaacugccggaccuuggcaccuuggcaaguuggagcuggacuuuaauuauugcgaggggaccacaguggucaucacggaaaacuguggaacccguggcccaaguuuacggacuacaaccguuucugguaaacucauucacgaguggugcugucgaagcugcacucugcccccucuuagauacaugggggaagauggauguugguauggcauggagaucaggccaauauccgaaaaggaggagaauauggugaaaucacugguaagcgcugguucuggcgaaguggacaacuucacaaugggggucuugugccucgccauucuguuugaggaagugaugcgcggaaaguucggcaagaaacauaugaucgcagggguuuucuuuaccuucgugcuacugcucuccggacagaucacguggcgggauauggcucacacucugauuaugaucggcaguaaugccagcgacagaauggguaugggggucaccuaccuugcauugauugccacauuuaagauacagcccuuccuggcuuuaggauuuuuccucaggaaacugaccucucgcgagaaccuucugcuaggcgugggccucgcgauggccacuacacugcaauugccggaagauaucgagcagauggcaaaugggauugcucugggauuaauggcccucaagcugaucacccaguuugagacauaucagcuuuggacugcccugauuuccuugaccuguucaaacacgaucuucacacucaccguugcuuggcgaacugcaacccugauacuagccggugugagucugcuuccugucugccaaagcucguccaugcggaaaacagacuggcucccaaugacuguagcggcuaugggcgugcccccucugcccuuguuuaucuucucucugaaggauaccuuaaagcguagaagcuggccacucaaugaagggguuauggccgugggacuggucucaauucuugcaaguucccuguugaggaacgacgugccuauggccggcccccucguagcuggugggcugcuaaucgcauguuacgugauuacgggaacaucugccgaucugaccgucgagaaagcggcugacguuacuugggaagaggaagccgagcagacaggcgugagccauaaccuuaugaucaccguggacgaugacggcacuaugcgcauaaaggaugacgagacagaaaauauucucaccguccuguugaaaacggcauuacugaucguguccgggaucuuuccauacucaauuccggccacucuccugguuuggcacaccuggcagaagcagacacaacggagcggaguacuuugggaugugccuagucccccagagacccagaaagcugaacuggaggagggugucuauagaauaaagcagcagggcaucuucgggaaaacacaagugggaguuggcgugcagaaggaaggugucuuucauacuauguggcacgugaccaggggggccguauugacguacaacggaaagcgacuagagcccaauugggcaucugucaaaaaggaccugauuuccuauggcggcggguggcgccucagcgcucaguggcaaaaaggagaagaggugcagguuaucgccguggaaccugguaagaacccaaaaaauuuccagacaaugcccggcacuuuccagaccacaaccggggagauuggagcgaucgcccuggauuuuaagccuggcacuucggguucaccgauaaucaaccgggaggggaaggucgugggacuuuacggcaauggcguugugaccaaaaacgggggauaugucucugguauugcacaaacaaaugcugaaccagacggccccacgccugaguuagaagaggaaauguucaagaaaagaaaccugacuaucauggaucuccacccagggaguggaaagaccaggaaauacuugcccgccauugugcgugaggcuaucaagcgccggcugagaacacucauacuggcaccuaccaggguaguggccgccgagauggaagaggcucuuaagggccugccgauucgauaucagacuacagcgaccaaauccgaacauacgggucgggagaucguugacuugaugugccacgcaacuuuuacaaugcgccuacugagccccgucagagugccaaauuacaaccucaucauuauggaugaagcccauuucaccgacccugcuucuaucgccgcaaggggguacauaagcacccgggugggaaugggcgaggccgcugcgauuuuuaugacugccacacccccaggcaccgcagaugcuuucccucaguccaaugcccccauccaggacgaggaacgagacauuccagagagaucauggaacagugggaaugaauggaucacagauuuugcaggaaagacugucugguucguaccgagcauaaaagccgguaacgacauugcuaacuguuuacgcaagaauggcaaaaaggugauccaacugucuaggaagacguuugauaccgaguaucagaaaacaaagcuuaacgacugggauuucguugugacuaccgacaucuccgagaugggggccaauuuuaaagcggaucgugucauugacccucggagaugccugaagcccgugauccucacagauggaccagaaaggguuauuuuggcaggccccaugccugugaccgccgcuucagccgcucagcgccgagguagagucgggcggaacccacagaaagagaaugaccaauacauauucacuggccagccccugaacaaugaugaagaccacgcacauuggacggaggccaagaugcuccuggacaacaucaauaccccugaaggaauuaucccggcucuuuucgagccagagagggaaaagagugccgcaaucgauggcgaguaucgccuaaaaggggaaagccguaagacauuuguggagcugaugagacggggagacuugcccguaugguuagcgcacaaaguggccuccgaagguauuaaguacacugauaggaaauggugcuucgacggccagcgcaacaaucagauacuggaggagaacauggauguugaaaucuggaccaaggagggggaaaaaaagaagcuccgaccuagauggcuggacgcucggacauauucugauccccuugcccugaaagaguuuaaggacuucgcagcuggaaggaaaucgauugcccucgauuuggucaccgaaaucggccgcgugccaacucaccuggcacauagaacaaggaaugcccuagacaaccuggugaugcuccacacgagcgagcauggugggaaggcuuaccggcacgcggucgaggaacuuccugagaccauggaaacucuguuauugcugggccucaugauucugcuuacaggaggcgccaugcuguuucucaucucagggaaaggaauagguaagaccuccaucggcuugauuuguguuaucgcaaguucugggaugcuguggauggcugagauucccuuacaauggaucgccagcgccauagugcuagaguucuuuaugaugguacugcucauuccagaaccugagaagcagcguaccccgcaggauaaucaacuugcauauguggucaucggaauucugacauuggcugccaucauagcggcuaacgaaaugggccugcucgagacuacgaaacgcgaccuggguaugucccgagaacccggggugguuucaccaaccucuuaccuugauguggaccuccacccugccagcgcauggacacuguacgccgucgcuacuaccguaaucacacccauguugagacauaccauugagaauaguacugcaaacgugucccuggccgcgaucgcuaaccaggccguuguguuaaugggccuagacaagggauggccaauuagcaaaauggaucugggcgucccucuccuugcacuggggugcuauucucaggugaaucccuugacgcugacagccgcuguccuccugcuuaucacccacuacgccauaauuggaccgggcuuacaggcaaaggcuacuagggaggcccaaaaacggaccgcggccgguaucaugaagaacccaacaguggacgggaucaugacuauugaucuggacccuguuaucuaugauucaaaguucgaaaaacagcucggacaggugauguugcugguacuaugugcagugcagcugcuccuuaugcgcaccuccugggcucugugcgaggccuugacacuggcaacgggccccauaaccacucucugggaagguaguccaggcaaguuuuggaauacaaccauugcugucagcauggccaacaucuucagagggucguaccuggccggagcgggcuuagcuuuuucuauuaugaaauccguugggacuggaaagaggggcacagguagccaaggggagacccuuggagaaaaauggaagaagaaacugaaucagcucucacggaaggaguucgaccuauauaaaaagaguggcaucacggagguggaucgaaccgaagcaaaagagggucugaagagaggcgaaauaacacaucacgccgucucucgcggguccgcuaaauugcagugguuuguggagaggaacaugguaauccccgaaggacgggugauugaccugggcugugggcguggaggcuggagcuacuauugcgccggucucaagaagguuacugaggugagaggguacaccaaaggaggcccuggccaugaggaaccgguccccaugucaacauacggguggaauaucgugaagcuuaugaguggaaaagaugucuucuaucugccaccugagaagugugacacuuugcugugcgauauuggugaaagcucccccucuccuaccguggaggagagcaggacaauccgcguucucaaaaugguagaaccaugguuaaagaacaaucaguucuguauuaaggugcugaaccccuacaugccugcagucaucgagcaccuugaacggcugcaacgaaaacacggcgggaugcuagugagaaauccacucuccaggaacucaacccaugagauguauuggauaucuaauggaacuggcaacauuguugccagugugaauauggucucgcgccuguugcugaaccgguuuacgaugacacacagacgucccaccaucgaaaaggacguggaucucggugcugggacuaggcauguaaacgcggagccggagaccccuaauauggacgugaucggagaacggauuaaacgcauaaaggaggaacacaacagcacauggcacuacgacgaugagaauccauauaaaacgugggccuaccauggcuccuaugaaguuaaggcaaccggcucugcuucaagcaugaucaacggggucgugaagcuucugacuaaacccugggacguggucccuaugguuacacagauggccaugaccgauacuacaccauucggacagcaacgaguguuuaaggagaaaguagacaccagaacacccagguccaugccggguacucggcgcgugaugggcauuaccgcagagugguuauggagaacgcuggggaggaauaagaaaccucgauugugcacccgggaagaguucacaaagaagguccguacuaacgccgcuaugggagccguguuuaccgaagagaaucagugggauagugcgaaagcagccguugaagacgaggauuucuggaagcucguggacagagagcgcgaacugcacaaacuaggcaagugugguucuugcgucuacaacaugauggggaaaagggagaagaaacuuggagaauuuggcaaggcuaagggcagccgggccaucugguacauguggcugggggcaagauaucucgaguucgaggcucugggauuuuugaaugaagaucauugguucucacgcgagaacuccuacagugguguggaaggcgaggggcugcacaaacucggauauauucuuagggacaucagcaagauacccggcggugccauguacgcugaugacacagccgggugggacacucgaaucaccgaagaugaccugcauaaugaggagaaaauuacgcagcagauggauccagaacaccggcaauuagcaaacgcgaucuuuaagcugacauaucagaauaaaguaguuaaggugcagagaccuacccccacuggaacagucauggacauuaucucuaggaaggaucagcgcggcuccggccaaguggggaccuacggauugaacacuuucaccaauauggaggcccagcucauacgucagauggaaggugagggcgugcugucaaaagcugaccuagaaaacccacaccuucccgagaagaaaauuacacaguggcuggagacgaagggggucgaacggcucaaaagaauggccaucagcggagaugacugcguugugaagccuaucgaugacagguuugcaaacgcucuguuggccuuaaaugauaugggcaagguacgcaaagacauuccacaauggcagccgucgaaggguuggcaugauuggcagcaggugcccuucuguucucaccauuuccacgagcugauaaugaaagacgggcgaaagcucgucgugccuugccggccacaagacgaacuuaucggaagagcaaggauuagucagggcgccggcuggucccugcgcgagaccgcgugucuagggaaagcuuaugcccagauguggagccugauguacuuucacagacgggaucucagguuggcaucaaacgccaucugcuccgcuguucccgugcauugggucccuacuucucguacaaccuggagcauucacgcccaucaccaauggaugacuacagaagacaugcugaccguguggaaucgaguauggaucgaggauaacccauggauggaggacaagacgcccguuacaaccugggaaaaugugccuuaccuuggaaagcgcgaggaucaguggugugguagucugauaggccucacuuccagagcaaccugggcucagaacaucccgacagccauucagcaaguccggagcuuaaucgggaaugaagaguuccuggacuauaugccaucuaugaaaagguuucgcaaggaggaagagucagaaggagcgauuugguga

SEQ ID NO: 15526 - RNA, 9873 nt, Artificial Sequence
  derived and/or modified CDS sequence (opt3) from DENV-3__FJ639800__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaagugcagaauucagggggaacaaguauuuucgcaggucaucugaagugucgguuaaaaauggacaagcuggagcuaaaaggcaugagcuacgccaugugcacuaacaccuuuguccucaagaaagaggugucugaaacgcagcacgggaccauacugaucaagguugaguacaagggagaagaugugcccuguaaaauuccuuucuccacagaggacggccaagguaaggcucauaacgggcgucuuaucacugcgaauccaguagucaccaaaaaggaggaacccgugaacauagaggcagaaccgccuuucggcgagucaaauauuguuaucggaaucggcgauaacgccuugcgcauuaauugguauaaaaaggggagcaguaucggaaagauguuugaagcuacagccagaggugcaaggcggauggccauucugggcgacacugcuugggauuucgggucugugggaggcguccucaacucccuggguaaaauggugcaccagauauuugggagcgccuacaccgcacuuuucucgggcguaucuugggugaugaagaucggaauuggcguucuguugacguggaucgggcucaauuccaaaaacacaucaaugaguuuuagcugcaucgcgauuggaauaaucacccuguauuuaggcgcugucgugcaggccgacauggguugugugauuaauuggaaggggaaagagcugaagugcggauccggcaucuucgucacuaacgagguucauacauggaccgaacaguacaaguuucaagcagauucucccaaacgacuagccacugcuauugccggugcaugggagaauggcgugugugggauccgcagcaccacaagaauggaaaaccuccuguggaagcagauagcuaaugagcuuaacuauaucuugugggaaaauaacauuaaacugacggugguagucggagacaccaucggcgugcucgagcaggggaagaggacucugacaccacagccuauggaguuaaaauacucauggaagaccuggggaaaagccaagauuguuacagcggaaacucaaaacaguuccuucaucauagauggccccaauaccccagagugccccagcgccucucgggcuuggaacgugugggaagucgaggacuaugguuuugggguguucacgacaaauauuuggcugaagcuucgcgaaguuuacacccaguugugugaccacagacucaugucagcagccgugaaagaugagagggcuguacacgccgacaugggauacuggaucgagagucagaagaacggcagcuggaaacuggaaaaggcaucccuaauugaggucaaaacuugcaccuggccuaagucucauacacuguggucgaauggugugcucgaaagcgauaugaucauaccaaagucccuggcgggcccgaucucacagcacaacuaucgucccggguaccauacucaaaccgccggaccuuggcaccuuggcaaauuggagcuggacuuuaauuauugcgaggggacaacgguggucauuaccgaaaacuguggaacucggggcccaaguuuacgaacaaccacuguuucugguaagcucauccacgaguggugcuguagaagcugcacacugcccccucuuagguacaugggggaagauggauguugguauggcauggagauucgcccaaucuccgaaaaagaggagaauauggugaagucacugguaagcgcugguucuggcgaaguggacaacuucaccaugggggucuugugccucgccauacuguuugaggaagugaugcggggaaaauucggcaagaagcauaugauugcagggguuuucuuuacguucgugcuacugcucuccggacagaucacuuggagagauauggcucacacccugaucaugauuggcaguaaugccagcgacaggauggguaugggggucacauaccuugcauugaucgccaccuuuaaaauucagcccuuccuggcuuuaggauuuuuccuccgcaagcugacuucucgagagaaccuucugcuaggcgugggccucgcgauggccacaacccugcaauugccggaagauauagagcagauggcaaaugggaucgcucugggauuaauggcccucaaacugauuacacaguuugagacuuaucagcuuuggaccgcccugaucuccuugacguguucaaacacaauuuucacccucacuguugcuuggcggaccgcaacacugauccuagccggugugagucugcuuccugucugccaaagcucguccaugcguaagacugacuggcucccaaugaccguagcggcuaugggcgugcccccucugcccuuguuuauauucaaucugaaagauacguuaaagagaaggucuuggccacucaacgaagggguuauggccgugggacuggucagcauccuugcaucaagucuguugcgcaacgacgugccuauggccggcccccucguagcuggugggcugcuaauugcauguuacgugaucacaggaaccuccgccgaucugacugucgagaaggcggcugacguuacaugggaagaggaagccgagcagaccggcgugucucauaaucuuaugauuacuguggacgaugacggcacaaugcggaucaaagaugacgagaccgaaaacauacucacgguccuguugaagacugcauuacugauugugagcgggaucuuuccauacuccaucccggccacccuccugguuuggcacacauggcagaaacagacccaaagaucaggaguacuuugggaugugccuagccccccagagacacagaaggcugaacuggaggagggugucuauaggauuaaacagcagggcauauucgggaagacucaagugggaguuggcgugcagaaagaaggugucuuucauaccauguggcacgugacgcgaggggccguauugacauacaauggaaagcgccuagagcccaacugggcaagugucaagaaagaccugaucucuuauggcggcggguggcggcucuccgcucaguggcaaaagggagaagaggugcagguuauugccguggaaccugguaaaaauccaaagaacuuccagacuaugcccggcaccuuccagacaaccacuggggagaucggagcgauugcccuggauuuuaaaccuggcaccagcgguucgccgaucauaaauagagaggggaaggucgugggacuuuacggcaacggcguugugacaaagaaugggggauaugucucagguaucgcacaaacgaacgcugaaccagacggccccacuccugaguuagaagaggaaauguucaaaaagaggaaucugaccauuauggaucuccacccagggucuggaaaaacacguaaguacuugcccgccaucgugcgcgaggcuauuaaacggagacugaggacccucauccuggcaccuacucgaguaguggccgccgagauggaagaggcucuuaagggccugccgauacgguaucagacaaccgcgacgaagagugaacauacuggucgcgagauuguugacuugaugugccacgcaacauuuaccaugagacuacugucccccgucagggugccaaacuacaaucucaucaucauggaugaagcccauuucaccgacccugcuagcauugccgcacggggguacaucucuacucgagugggaaugggcgaggccgcugcgauauuuaugacagccacccccccaggcacagcagaugcuuucccucagagcaacgcccccauucaggacgaggaaagagacaucccagagcgcuccuggaauucagggaacgaauggauuacugauuuugcaggaaaaacggucugguucguaccgaguaucaaggccgguaacgacauagcuaauuguuuaaggaaaaacggcaagaaagugauucaacugagccguaagaccuuugauacagaguaucagaagacuaaacuuaaugacugggauuucguugugaccacagacaucucugagaugggggccaacuuuaaggcggaucgggucaucgacccuagaaggugccugaaacccgugauucucaccgauggaccagaacgcguuaucuuggcaggccccaugccugugacugccgcuuccgccgcucagcgaagaggucgggucgggaggaauccacagaaggagaacgaccaauacauuuucacgggccagccccugaauaacgaugaagaccacgcacauuggaccgaggccaaaaugcuccuggacaauauaaacacaccugaaggaaucauuccggcucuuuucgagccagagcgcgaaaagucagccgcaaucgauggcgaguaucgucuaaagggggaaaguagaaaaacuuuuguggagcugaugcggaggggagacuugcccguaugguuagcgcacaagguggccagcgaagguaucaaauacaccgaucgcaaguggugcuucgacggccagcgaaauaaccagauucuggaggagaauauggauguugaaauauggacaaaagagggggaaaagaaaaagcucagaccucgguggcuggacgcuaggaccuauuccgauccccuugcccugaaggaguuuaaagacuucgcagcuggacgcaagucuaucgcccucgauuuggucacugaaauuggcagagugccaacacaccuggcacauaggacgcggaacgcccuagacaaucuggugaugcuccacaccucggagcauggugggaaagcuuaccgucacgcggucgaggaacuuccugagacuauggaaacacuguuauugcugggccucaugauccugcuuaccggaggcgccaugcuguuucucauuagcgggaagggaaucgguaaaaccucaauaggcuugaucuguguuauugcauccagugggaugcuguggauggcugagauccccuuacaauggauugccucugccaucgugcuagaguucuuuaugaugguacugcucauaccagaaccugagaagcagcgcacaccgcaggauaaccaacuugcauauguggucauuggaauccugacuuuggcugccauuaucgcggcuaaugaaaugggccugcucgagacgaccaagcgagaccuggguaugagcaaagaacccggggugguuuccccaacaucauaccuugauguggaccuccacccugccucugcauggacucuguacgccgucgcuaccacaguaauaacccccauguugagacauacuaucgagaacagcacggcaaacgugagucuggccgcgauugcuaaucaggccguuguguuaaugggccuagacaagggauggccaaucuccaaaauggaucugggcgucccucuccuugcacuggggugcuauagccaggugaaccccuugacacugaccgccgcuguccuccugcuuauuacucacuacgccaucauaggaccgggcuuacaggcaaaggcuaccagggaggcccaaaaacggacagcggccgguauuaugaagaauccaacuguggacgggaucaugaccaucgaucuggacccuguuauuuaugauucuaaguucgaaaaacagcucggacaggugauguugcugguacuaugugcagugcagcugcuccuuaugcgcacaucaugggcucugugcgaggccuugacgcuggcaaccggccccaucacuacacucugggaagguuccccaggcaaguuuuggaacaccacuauagcugucaguauggccaauauuuucagagggagcuaccuggccggagcgggcuuagcuuuuucgaucaugaaaucuguugggacaggaaagaggggcaccgguucccaaggggagacgcuuggagaaaaauggaagaagaaacugaaccagcucagccggaaggaguucgaccuauauaaaaagucaggcauuaccgagguggaucgaacagaagcaaaagagggucugaagagaggcgaaaucacucaucacgccgucagucgcgggucugcuaaauugcagugguuuguggagaggaauaugguaauacccgaaggacgggugaucgaccugggcugugggcguggaggcugguccuacuauugcgccggucucaagaagguuaccgaggugagaggguacacaaaaggaggcccuggccaugaggaaccgguccccaugagcacuuacggguggaacauugugaagcuuaugucaggaaaagaugucuucuaucugccaccugagaagugugacaccuugcugugcgauaucggugaaaguagccccuccccuacaguggaggagucuaggaccauucgcguucucaaaaugguagaaccaugguuaaagaauaaccaguucuguaucaaggugcugaaucccuacaugccuacugucauugagcaccuugaacggcugcaacgaaaacacggcgggaugcuagugagaaacccacucagcaggaauuccacgcaugagauguauuggaucucaaacggaucuggcaauauaguugcaagugugaacauggucucgcgccuguugcugaaccgguuuacaaugacccacagacgucccacuauugaaaaggacguggaucucggugccgggaccaggcauguaaaugcugagccggagacaccuaacauggacgugaucggagaacggaucaaacgcauuaaggaggaacacaauagcacguggcacuacgacgaugagaacccauauaaaaccugggcguaccauggcuccuaugaaguuaaggccacuggcucugcaucaagcaugauaaauggggucgugaagcuucugacaaaacccugggacguggucccuaugguuacccagauggcuaugacugauacaaccccauucggacagcaacgaguguuuaaggagaaaguagacacaagaacucccagguccaugccggguacccggcgcgugaugggcaucacggccgagugguuauggagaacccuggggaggaacaagaaaccucgauugugcacacgggaagaguucacuaagaagguccguaccaaugcagccaugggagcuguguuuacagaagagaaccagugggauagugccaaagcggcaguugaagacgaggauuucuggaagcucguggacagagagcgcgaacugcacaaacuaggcaagugugguucuugcgucuacaauaugauggggaaaagggagaagaaacuuggagaauuuggcaaggccaagggcagccgggcuauuugguacauguggcugggggccagauaucucgaguucgaggcacugggauuuuugaacgaagaucauugguucucacgcgagaauuccuacagugguguggaaggcgaggggcugcacaaacucggauauauccuuagggacauuagcaagauccccggcggugcuauguacgccgaugacacugcugggugggacacccgaauaacggaagaugaccugcauaacgaggagaaaaucacacagcagauggauccagaacaccggcaauuagccaaugcaauuuuuaagcugaccuaucagaacaaaguaguuaaggugcagagaccuacucccacaggaaccgucauggacaucauuucuaggaaggaucagcgcggcuccggccaaguggggacuuacggauugaauaccuucacaaacauggaggcgcagcucauccgucagauggaaggugagggcgugcugucaaaagccgaccuagaaaacccacaccuucccgagaagaaaauaacgcaguggcuggagaccaagggggucgaacggcucaaaagaauggcuauuagcggagaugacugcguugugaagccuaucgaugacagguuugccaaugcacuguuggcuuuaaacgauaugggcaagguacgcaaagacaucccacaauggcagccgucgaaggguuggcaugauuggcagcaggugcccuucuguucucaccauuuccacgagcugauuaugaaagacgggcgaaagcucgucgugccuugccggccacaagacgaacuuauaggaagagccaggaucagucagggcgcaggcuggucccugcgcgagacugccugucuagggaaagcguaugcucagauguggagccugauguacuuucacagacgggaucucagguuggccucaaaugcaauuugcuccgccguucccgugcauugggucccuacaucucguaccacuuggagcauccacgcucaucaccaauggaugacaaccgaagacaugcugacgguguggaaccgaguauggauugaggauaauccauggauggaggacaagacacccguuaccacuugggaaaacgugccuuaccuuggaaagcgcgaggaucaguggugugguagucugaucggccucaccuccagagccacaugggcacagaauauaccgacugcuauccagcaaguccggagcuuaauugggaacgaagaguuccuggacuauaugccaucuaugaaaagguuucgcaaggaggaagagucagaaggagccaucugguga

SEQ ID NO: 15527 - RNA, 9873 nt, Artificial Sequence
  derived and/or modified CDS sequence (opt3) from DENV-3__FJ639801__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacaccauuggcguccucgagcaggggaaaagaacucugacaccacagccuauggaguuaaaguacucauggaaaaccuggggaaaggccaagaucgugacagcggaaacucaaaacaguuccuucauaauugauggccccaauaccccagagugccccagcgccucuagggcuuggaacguuugggaaguggaggacuaugguuuuggggucuucacgacaaauaucuggcugaaacuucgggaaguguacacccaguugugugaccaccgccucaugucagcagccguuaaggaugagagagcugugcacgccgacaugggauacuggauugagagucagaaaaacggcagcuggaagcuggaaaaagcaucccuaaucgagguaaagacuugcaccuggccuaagucucauacacuguggucgaaugguguccucgaaagcgauaugauaaucccaaaaucccuggcgggcccgauuucacagcacaacuauaggcccggguaccauacucaaaccgccggaccuuggcaccuuggcaaguuggagcuggacuuuaauuauugcgaggggacaacgguggugaucaccgaaaacuguggaacucguggcccaaguuuacggacaaccacugucucugguaaacucauucacgaguggugcugucgaagcugcacacugcccccucuuagauacaugggggaagauggauguugguauggcauggagaucaggccaauauccgaaaaggaggagaauaugguuaaaucacuggugagcgcugguucuggcgaaguagacaacuucaccauggggguguugugccucgccauucuguuugaggaagucaugcgcggaaaguucggcaagaaacauaugaucgcagggguguucuuuacguucguucuacugcucuccggacagaucacuuggcgggauauggcucacacccugauuaugaucggcaguaaugccagcgacagaauggguaugggggugacauaccuugcauugauugccaccuuuaagauacagcccuuccuggcuuuaggauuuuuccucaggaaacugacuucucgcgagaaccuucugcuaggcgucggccucgcgauggccacaacccugcaauugccggaagauaucgagcagauggcaaaugggauugcucugggauuaauggcccucaagcugaucacacaguuugagacuuaucagcuuuggaccgcccugauuuccuugacguguucaaacacaaucuucacccucacuguggcuuggcgaaccgcaacacugauacuagccgguguuagucugcuuccugugugccaaagcucguccaugcggaaaacugacuggcucccaaugaccgucgcggcuaugggcguacccccucugcccuuguuuaucuucucucugaaggauacguuaaagcguagaagcuggccacucaaugaaggggugauggccguuggacuggugucaauucuugcaaguucccuguugaggaacgacgucccuauggccggcccccucguggcuggugggcugcuaaucgcauguuacguaauuacaggaaccucugccgaucugacuguggagaaagcggcugacgucacaugggaagaggaagccgagcagaccggcguuagccauaaccuuaugaucacuguggacgaugacggcacaaugcgcauaaaggaugacgagaccgaaaauauucucacggugcuguugaaaacugcauuacugaucgucuccgggaucuuuccauacucaauuccggccacccuccugguguggcacacauggcagaagcagacccaacggagcggaguucuuugggauguaccuagucccccagagacacagaaagcugaacuggaggaggguguguauagaauaaagcagcagggcaucuucgggaaaacucaagucggagugggcguucagaaggaagguguguuucauaccauguggcacgucacgaggggggccguguugacaugcaacggaaagcgacuagagcccaauugggcaucuguaaaaaaggaccugauuuccuacggcggcggguggcgccucagcgcucaguggcaaaaaggagaagagguccaggugaucgccguugaaccugguaagaacccaaaaaauuuccagacuaugcccggcaccuuccagacaaccacuggggagauuggagcgaucgcccuggauuuuaagccuggcaccucggguucaccgauaaucaaccgggaggggaagguggucggacuuuauggcaauggcgugguuacaaaaaacgggggauacgugucugguauugcacaaacgaaugcugaaccagacggccccacuccugaguuagaagaggaaauguucaagaaaagaaaccugaccaucauggaucuccacccagggaguggaaagacaaggaaauauuugcccgccauuguccgugaggcuaucaagcgccggcugagaacccucauacuggcaccuacuagggugguagccgccgagauggaagaggcucuuaagggccugccgauucgauaccagacaaccgcgacgaaauccgaacauacuggucgggagaucguggacuugaugugucacgcaacauuuaccaugcgccuacugagccccguuagagucccaaauuauaaccucaucauuauggaugaagcccauuucaccgacccugcuucuaucgccgcaaggggguacauaagcacucgggugggaaugggcgaggccgcugcgauuuuuaugacagccacccccccaggcacagcagaugcuuucccucaguccaaugcccccauccaggacgaggaacgagacauuccagagagaucauggaacagugggaaugaauggaucacugauuuugcaggaaagacggugugguucgucccgagcauaaaagccgguaacgacauugcuaacugcuuacgcaagaauggcaaaaagguaauccaacugucuaggaagaccuuugauacagaguaccagaaaacuaagcuuaacgacugggauuucgugguuaccacagacaucuccgagaugggggccaauuuuaaagcggaucgugugauugacccucggagaugccugaagcccgucauccucaccgauggaccagaaagggugauuuuggcaggccccaugccuguuacugccgcuucagccgcucagcgccgagguagaguggggcggaacccacagaaagagaaugaccaauauauauucacgggccagccccugaacaaugaugaagaccacgcacauuggaccgaggccaagaugcuccuggacaacaucaauacaccugaaggaauuaucccggcucuuuucgagccagagagggaaaagagugccgcaaucgauggcgaguaccgccuaaaaggggaaagccguaagacuuuugucgagcugaugagacggggagacuugcccgugugguuagcgcacaaaguagccuccgaagguauuaaguauaccgauaggaaaugguguuucgacggccagcgcaacaaucagauacuggaggagaacauggauguggaaaucuggacaaaggagggggaaaaaaagaagcuccgaccuagauggcuggacgcucggaccuacucugauccccuugcccugaaagaguuuaaggacuucgcagcuggaaggaaaucgauugcccucgauuugguuacugaaaucggccgcgucccaacacaccuggcacauagaacgaggaaugcccuagacaaccuggugaugcuccacaccagcgagcauggugggaaggcuuaucggcacgcgguggaggaacuuccugagacuauggaaacacuguuauugcugggccucaugauucugcuuaccggaggcgccaugcuguuucucaucucagggaaaggaauagguaagaccuccaucggcuugauuugcgucaucgcaaguucugggaugcuguggauggcugagauucccuuacaauggaucgccagcgccauaguucuagaguucuuuaugauggugcugcucauuccagaaccugagaagcagcguacaccgcaggauaaucaacuugcauacguagugaucggaauucugacuuuggcugccacgaucgcggcuaacgaaaugggccugcucgagaccacaaaacgcgaccuggguauguccaaggaacccggggucgugucaccaacuucuuaucuugauguugaccuccacccugccagcgcauggacccuguacgccguggcuacaaccgucauaacucccauguugcgacauacgaucgagaauaguacagcaaacguaucccuggccgcgauugcuaaccaggccgugguuuuaaugggccuagacaaaggauggccaaucagcaagauggaucugggcgugccucuccuugcacugggguguuacucucaggucaaucccuugacccugacugccgcugugcuccugcuuauuacccacuaugccaucauaggaccgggcuuacaggcaaaagcuacaagagaggcccaaaagaggacugcggccgguauuaugaagaacccaaccgucgacgggaucaugacaaucgaucuggacccugugauuuacgauucaaaauucgaaaagcagcucggacagguuauguugcuggugcuaugcgcaguacagcugcuccuuaugcggacguccugggcucugugugaggccuugacccuggcaacuggccccaucacaacccucugggaagguaguccaggcaaauuuuggaauacuacaauagcugugagcauggccaacauuuuccgcgggucguaucuggccggagcgggcuuagcuuuuucuaucaugaaguccgucgggaccggaaaaagaggcacggguagccaaggggagacccuuggagaaaaguggaagaaaaggcugaaucagcucucacggaaggaguucgaccuauacaaaaagaguggcauuacagagguugaucgaacugaagcaaaagagggucugaagagaggcgaaaucacccaucacgccgugucucgcggguccgcuaaauugcagugguuugucgagaggaacauggugauacccgaaggacggguaaucgaccugggcugcgggcguggaggcuggagcuauuacugugccggucucaagaaggugacagagguuagaggguauacuaaaggaggcccuggccaugaggaaccggugcccaugucaaccuacggguggaauauugucaagcuuaugaguggaaaagauguguucuaccugccaccugagaagugcgacacauugcugugugauaucggugaaagcucccccucuccuaccgucgaggagagcaggacuauucgcgugcucaaaaugguugaaccaugguuaaagaacaaucaguucugcaucaagguacugaaccccuauaugccuacggugauugagcaccuugaacggcugcaacgaaaacacggcgggaugcuagucagaaauccacucuccaggaacucaacacaugagauguacuggaucucuaauggaaccggcaacauaguggcaaguguuaauauggugucgcgccuguugcugaaccgguuuacuaugacccacagacgucccacaauugaaaaggacgucgaucucggugccgggacgaggcaugugaacgcugagccggagaccccuaauauggacguaaucggagaacggaucaaacgcauuaaggaggaacacaacagcacuuggcacuaugacgaugagaauccauacaaaacaugggcguaucauggcuccuacgaagugaaggccaccggcucugcaucaagcaugauaaacgggguugucaagcuucugacuaaacccugggacguggugccuauggucacacagauggcuaugaccgauacaacuccauucggacagcaacgaguuuuuaaggagaaaguggacaccagaacgcccagguccaugccggguacccggcgcguaaugggcaucacagccgagugguuauggagaacucuggggaggaauaagaaaccucgauuguguacccgggaagaguucacaaagaaggugcguacuaacgcagccaugggagcugucuuuaccgaagagaaucagugggauagugccaaagcggcaguggaagacgaggauuucuggaagcucguugacagagagcgcgaacugcacaaacuaggcaagugcgguucuugcguguauaacaugauggggaaaagggagaagaaacuuggagaauuuggcaaggccaagggcagccgggcuauuugguacauguggcugggggccagauaccucgaguucgaggcacugggauuuuugaaugaagaucauugguucucacgcgagaacuccuauaguggugucgaaggcgaggggcugcacaaacucggauacauccuuagggacauuagcaagauccccggcggugcuauguaugccgaugacacggcugggugggacacacgaauaaccgaagaugaccugcauaaugaggagaaaaucacucagcagauggauccagaacaccggcaauuagccaacgcaauuuuuaagcugacauaccagaauaaagugguaaagguucagagaccuacccccacuggaaccgugauggacaucauuucuaggaaggaucagcgcggcuccggccaagucgggacauauggauugaacacguucaccaauauggaggcgcagcucauccgucagauggaaggugagggcgugcugucaaaagccgaccuagaaaacccacaccuucccgagaagaaaauaacucaguggcuggagacaaaggggguggaacggcucaaaagaauggcuauuagcggagaugacugugucguuaagccuaucgaugacagguuugccaacgcacuguuggcuuuaaaugauaugggcaaggugcgcaaagacaucccacaauggcagccgucgaaggguuggcaugauuggcagcagguacccuucugcucucaccauuuccacgagcugauuaugaaagacgggcgaaagcucguggucccuugucggccacaagacgaacuuauaggaagagccaggaucagucagggcgcaggcuggucccugcgcgagaccgccugccuagggaaagcguacgcucagauguggagccugauguauuuucacagacgggaucucagguuggccucaaacgcaauuuguuccgccgugcccguucauugggugccuacuucucguacaaccuggagcauccacgcucaucaccaauggaugacgacagaagacaugcugaccgucuggaaucgaguguggauugaggauaacccauggauggaggacaagacucccguaaccacaugggaaaauguuccuuaccuuggaaagcgcgaggaucaguggugcgguagucugaucggccucacuuccagagccaccugggcacagaacauaccgacagcuauccagcaagugcggagcuuaauugggaaugaagaguuccuggacuacaugccaucuaugaaaagguuucgcaaggaggaagagucagaaggagccaucugguga

SEQ ID NO: 15528 - RNA, 9873 nt, Artificial Sequence
  derived and/or modified CDS sequence (opt3) from DENV-3__KF955471__SS-prME
accagccugugccucaugaugauccuucccgccgcucuggcauuccacuugacauccagagacggcgaaccuaggaugauuguggggaagaacgaacggggaaaaucuuuacuguuuaagacugccucagguauaaauauguguacgcuaaucgcgauggaucucggcgagaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucaaucugaaggauaccuuaaagcguagaucuuggccacucaacgaaggggugauggccguuggacuggugagcauccuugcaucaagucuguugaggaacgacgucccuauggccggcccccucguggcuggugggcugcuaauugcauguuacguaaucacgggaacauccgccgaucugaccguggagaaagcggcugacgucacuugggaagaggaagccgagcagacaggcguuucucauaaucuuaugauaaccguggacgaugacggcacuaugcgcauuaaggaugacgagacagaaaacauccucaccgugcuguugaaaacggcauuacugaucgucagcgggauuuuuccauacuccauaccggccacucuccugguguggcacaccuggcagaagcagacacaacggucaggaguucuuugggauguaccuagcccaccagagacccagaaagcugaacuggaggaggguguguauagaaucaagcagcagggcauuuucgggaaaacacaagucggagugggcguucagaaggaagguguguuucauacuauguggcacgucaccagaggggccguguugacguacaauggaaagcgacuagagcccaacugggcaagugucaagaaggaccugaucucuuauggcggcggguggcgccucuccgcucaguggcaaaaaggagaagagguccaggugauugccguugaaccugguaagaaucccaagaauuuccagacaaugcccggcacuuuccagaccacaaccggggagaucggagcgauagcccuggauuuuaagccuggcacuagcgguucgccgaucauuaaucgggaggggaagguggucggacuuuacggcaacggcgugguuaccaaaaaugggggauaugugucagguaucgcacaaacaaacgcugaaccagacggccccacgccugaguuagaagaggaaauguucaagaaaagaaaucugacuauuauggaucuccacccagggucuggaaagaccaggaaauacuugcccgccaucguccgugaggcuauaaagcgccggcugagaacacucauucuggcaccuaccagggugguagccgccgagauggaagaggcucuuaagggccugccgauccgauaucagacuacagcgaccaaaagugaacauacgggucgggagaucguggacuugaugugccacgcaacuuuuacaaugcgccuacugucccccguuagagucccaaacuacaaucucauuaucauggaugaagcccauuucaccgacccugcuagcauagccgcaaggggguacauuucuacccgggugggaaugggcgaggccgcugcgaucuuuaugacugccacacccccaggcaccgcagaugcuuucccucagagcaacgcccccauucaggacgaggaacgagacaucccagagagauccuggaacucagggaacgaauggauaacagauuuugcaggaaagacugugugguucgucccgaguauuaaagccgguaacgacaucgcuaauuguuuacgcaagaacggcaaaaagguaauccaacugagcaggaagacguuugauaccgaguaucagaaaacaaaacuuaaugacugggauuucgugguuacuaccgacauuucugagaugggggccaacuuuaaagcggaucgugugaucgacccucggagaugccugaagcccgucauucucacagauggaccagaaagggugauauuggcaggccccaugccuguuaccgccgcuuccgccgcucagcgccgagguagaguggggcggaauccacagaaagagaacgaccaauacaucuucacuggccagccccugaauaacgaugaagaccacgcacauuggacggaggccaagaugcuccuggacaauauuaacaccccugaaggaaucaucccggcucuuuucgagccagagagggaaaagucagccgcaauugauggcgaguaucgccuaaaaggggaaagucguaagacauuugucgagcugaugagacggggagacuugcccgugugguuagcgcacaaaguagccagcgaagguauaaaguacacugauaggaaauggugcuucgacggccagcgcaauaaccagauccuggaggagaauauggauguggaaauuuggaccaaggagggggagaaaaagaagcuccgaccuagauggcuggacgcucggacauauuccgauccccuugcccugaaagaguuuaaggacuucgcagcuggaaggaaaucuaucgcccucgauuugguuaccgaaauuggccgcgucccaacucaccuggcacauagaacaaggaacgcccuagacaaucuggugaugcuccacacgucggagcauggugggaaggcuuaccggcacgcgguggaggaacuuccugagaccauggaaacucuguuauugcugggccucaugauccugcuuacaggaggcgccaugcuguuucucauaagcgggaaaggaaucgguaagaccucaauuggcuugaucugugucauugcauccagugggaugcuguggauggcugagauccccuuacaauggauagccucugccauuguucuagaguucuuuaugauggugcugcucaucccagaaccugagaagcagcguaccccgcaggauaaccaacuugcauauguagugauuggaauccugacauuggcugccauaaucgcggcuaaugaaaugggccugcucgagacuacgaaacgcgaccuggguaugagcaaggaacccggggucguguccccaaccucauaccuugauguugaccuccacccugccucugcauggacacuguacgccguggcuacuaccgucauuacacccauguugcgacauaccaucgagaacagcacugcaaacguaagucuggccgcgauugcuaaucaggccgugguuuuaaugggccuagacaaaggauggccaaucuccaagauggaucugggcgugccucuccuugcacuggggugcuauagccaggucaaccccuugacgcugacagccgcugugcuccugcuuauaacccacuacgccauuaucggaccgggcuuacaggcaaaagcuacuagagaggcccaaaagaggaccgcggccgguaucaugaagaauccaacagucgacgggauuaugacuaucgaucuggacccugugauauaugauucuaaauucgaaaagcagcucggacagguuauguugcuggugcuaugugcaguacagcugcuccuuaugcggaccucaugggcucugugcgaggccuugacacuggcaacgggccccauuaccacucucugggaagguuccccaggcaaauuuuggaacacaaccaucgcugugaguauggccaauauuuuccgcgggagcuaccuggccggagcgggcuuagcuuuuucgaucaugaagucugucgggacuggaaaaagaggcacagguucccaaggggagacccuuggagaaaaguggaagaaaaagcugaaccagcucagcaggaaagaguucgaccuauauaagaaaucaggcauaacggagguugaucggaccgaagcaaaggagggucugaaacgaggcgaaaucacacaucacgccgugaguagagggucugcuaaguugcagugguuugucgagcgcaauauggugauucccgaaggaaggguaaucgaccugggcugugggcggggaggcugguccuacuauugcgccggucucaagaaagugacugagguucguggguacaccaagggaggcccuggccaugaggaaccggugcccaugagcacauacggguggaacauugucaaacuuaugucaggaaaggauguguucuaucugccaccugagaaaugugacacuuugcugugcgauaucggugaaaguagccccuccccuaccgucgaggagucuagaacaauuagggugcucaagaugguugaaccaugguuaaagaauaaccaguucuguaucaaaguacugaaucccuacaugccuaccgugauagagcaccuugaacgccugcaacggaagcacggcgggaugcuaguccgaaacccacucagcagaaauuccacucaugagauguauuggauuucaaacggaucuggcaauaucguggcaaguguuaacauggugucgaggcuguugcugaaccgcuuuacgaugacacaccggagacccaccaucgaaaaagacgucgaucucggugccgggacucgucaugugaaugcugagccggagaccccuaacauggacguaauuggagaaaggauaaagcggaucaaagaggaacacaauagcacauggcacuacgacgaugagaacccauauaagacgugggcguaccauggcuccuaugaagugaaggccaccggcucugcaucaagcaugauuaaugggguugucaaacuucugacuaagcccugggacguggugccuauggucacacagauggcuaugaccgauacuacaccauucggacagcaacgcguuuuuaaagagaagguggacacccgaacacccagauccaugccggguacuaggcggguaaugggcaucaccgccgagugguuauggcgcacgcuggggagaaacaaaaagccuagguugugcacccgagaagaguucacaaagaaagugcggacuaaugcagccaugggagcugucuuuaccgaagagaaccagugggauagugccaaggcggcaguggaagacgaggauuucuggaaacucguugaccgugagagagaacugcacaagcuaggcaaaugugguucuugcguguacaauaugauggggaagcgcgagaagaaacuuggagaauuuggcaaagccaaaggcagcagggcuauuugguacauguggcugggggcccgguaucucgaguucgaggcacugggauuuuugaacgaagaucauugguucucaagagaaaauuccuacaguggugucgagggcgaggggcugcacaagcucggauauauccuucgcgacauaagcaaaauccccggcggugcuauguacgccgaugacacagcugggugggacacuaggauuaccgaagaugaccugcauaacgaggagaagaucacgcagcagauggauccagaacaccgacaauuagccaaugcaauuuuuaaacugacauaucagaacaaggugguaaagguucagcggccuacccccacuggaacagugauggacaucauaucuagaaaagaucagaggggcuccggccaagucgggaccuacggauugaauacuuucaccaacauggaggcgcagcucauucgccagauggaaggugagggcgugcugucaaaggccgaccuagaaaacccacaccuucccgagaaaaagaucacacaguggcuggagacgaaagggguggaacgucucaagcggauggcuaucagcggagaugacugcgucguuaagccuauugaugacagauuugccaaugcacuguuggcuuuaaacgauaugggcaaagugaggaaggacauaccacaauggcagccgucgaaagguuggcaugauuggcagcagguacccuucuguucucaccauuuccacgagcugaucaugaaggacgggcgcaaacucguggucccuugccgaccacaagacgaacuuauuggacgggccagaaucagucagggcgcaggcuggucccugagggagaccgccugucuagggaaggcguaugcucagauguggagccugauguacuuucaccgcagagaucuccgguuggccucaaaugcaauuugcuccgccgugcccguucauugggugccuacuucuaggacaaccuggagcauccacgcucaucaccaauggaugacuacagaagacaugcugaccgucuggaaccguguguggauagaggauaauccauggauggaggacaagacgcccguaacaaccugggaaaacguuccuuaccuuggaaaacgagaggaucaguggugugguagucugaucggccucacuucccgcgccaccugggcacagaauauuccgacagcuauccagcaagugaggagcuuaauugggaacgaagaguuccuggacuauaugccaucuaugaagcgguuuaggaaagaggaagagucagaaggagccaucugguga
